United States Patent 7,745,391 (HUMAN THROMBOSPONDIN POLYPEPTIDE) - sequence listing, part 207

SEQ ID NO: 499935 - DNA, 6224 bp, Homo sapiens
  misc_feature (436)..(436): n is a, c, g, or t
tgatctagaggtcccatgcgcgacgcttccatcaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcntgatggaagcccgttggaaccatgagctggctggatgtgagatgaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccatgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggca

SEQ ID NO: 499936 - DNA, 2120 bp, Homo sapiens
acttctgctcggtacccagaaaagatgccccagaccaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggca

SEQ ID NO: 499937 - DNA, 180 bp, Homo sapiens
tctacctcttggagaaggaagccgagcgggaacggaaccgacagctggagcgagagaaacgtcgggagcacatgtcgtggagagggacagggagagagagagagaaagggagcgggacagtggggaccgatgatcgacgatagggaaatgggaccgatgaactgaggcagtggaaatggt

SEQ ID NO: 499938 - DNA, 283 bp, Homo sapiens
gagggacccatggcagttgctcccagtgcatcccaggccacaggaagcttttttgagtggcagggaaggggatgggggggctttttccacacccagcaggggcaaccagagtttcatgtgtgccgcccacaggagccaagccttttcccctgtgtggattcatgtggccaaggttaggcctggtcccccaggaccctccccacgtgaccccagccaatcgggacagttcaaggaggaggagccccctattacacaggttggaataaaatatttaattttggta

SEQ ID NO: 499939 - DNA, 5569 bp, Homo sapiens
  misc_feature (436)..(436): n is a, c, g, or t
tgatctagaggtcccatgcgcgacgcttccatcaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcntgatggaagcccgttggaaccatgagctggctggatgtgagatgaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccatgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgtgggggaaggggggatcctctatcagccc

SEQ ID NO: 499940 - DNA, 247 bp, Homo sapiens
  misc_feature (160)..(160): n is a, c, g, or t
  misc_feature (169)..(169): n is a, c, g, or t
ctaggatccctttgtagccctcttccccagccagctgagcatgggcacagaagccttccctgctccatgctgtctgtgagcaggccccatgcccagcacacctagccctgcgctggggaagaggggccaaagctcagagcaggccattggcacggcatcntgatcctgncttaacttgccctgcagcacaggtgtggagacacttgtggccttgtcaggctagagggactgggtgtaggactgggta

SEQ ID NO: 499941 - DNA, 5605 bp, Homo sapiens
  misc_feature (436)..(436): n is a, c, g, or t
tgatctagaggtcccatgcgcgacgcttccatcaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcntgatggaagcccgttggaaccatgagctggctggatgtgagatgaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccatgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatactaatttctctcgaaaactgggccagg

SEQ ID NO: 499942 - DNA, 535 bp, Homo sapiens
  misc_feature (450)..(450): n is a, c, g, or t
cgatctagaggacccggtggagcgggggtctcagaaaggaacgaacaagaggttggccaacaactaccggtactacggagggatctcactttagggtaaaagaaaaaaagtgagtgcatgtatgtggcagtgtgtaatgctgatggccccctagggacacctcagggtgttcatgcctctgtagtaatttcaccttgaaaggggcggggctggtgatggcttaaactaactgaatgtcgatgaagcgacacgggcaattctaggccgaagccttaaaagggccggctgacttcggcttttatactttggaaagccctgagctacccggttagagagaccacataaagaggaacgggcccgggccaggcaggggggttcaggccggtgatcccaacacttggggaggccaacgtcagtagatcgaggtcaggagatcgagaccatcccggntaaaacggtgaaaccccgtctctactaaaaatacaaaaaattagccgggcgtagtggggggggcctgtaagtcccagttacttgg

SEQ ID NO: 499943 - DNA, 196 bp, Homo sapiens
gaggtcaatagtcatcgaacatctttactatctgtagctccacatacctgttagtgtcttccacatcgagcaggaccatatatgcccaatagctatcttcactcctggacaggctggcctattcctatatcacgtaagacttgatgtagataataccaacgtagggcatgacacaagtacgtacttgcgggggcag

SEQ ID NO: 499944 - DNA, 5402 bp, Homo sapiens
  misc_feature (436)..(436): n is a, c, g, or t
tgatctagaggtcccatgcgcgacgcttccatcaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcntgatggaagcccgttggaaccatgagctggctggatgtgagatgaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccatgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgca

SEQ ID NO: 499945 - DNA, 253 bp, Homo sapiens
cgctacacgttagagaaagaagactccagtgtcgcctttgcatttcaggcattgtctaagttcttcctgcatttatgtggactctgcccaaggctccctaaagacataagcttcacttcttggatagtctgtaaggagaagcaaggggaggctggtgtggaggcaaggaggaataaaggcagggctggagacaaaggctccaggctggcagacacacagggtccagtaggggtttccctgccctgcggccgct

SEQ ID NO: 499946 - DNA, 228 bp, Homo sapiens
cacgagggaagctgatcagagaagtggggctgcaggtggatgactcaaggggacactcagttattgtgaggggtccccctgtggcctgtgcagccctaggggcaggggtggccatgaatgtactgagcccccagtcccttgtaggtggcaagcagggtccaatccctggccctcagggtggactgtgacccactctaggttccctgcaagctggggctctgactcaac

SEQ ID NO: 499947 - DNA, 768 bp, Homo sapiens
ctggcctgccccattcaccggccaggcccaaaggctggcccaggctcaccagctctggactgggcgtcccgtctgaggtggggatgaccaacatgccagctctgggttttagctgaggatgggcacatcaagcactgacagccagcaagctgggcacaggcgatgctcaacctctaacacatcggctgagaacctcacctgcctctccctgcctgggagccctggcaagacagctcctctcccaggcccagcacaggcaggcgctggacagccacttcctaaggggtgcgcggccgtcaaggcagaggtgggtatccctgcacctcacacctctcaggaggtcaggatccacatccgtcgcctgctttcctgggctgcccctggggcttgtgggctgagatcaaccccttgtgccctgctttcctgggctgcccctggggcttgtgggctgagatcaaccccttgtgccctgccccaggccctccctcaggcgaggccctgcccaggcaggtggttcttccctggctgttcccttccaacaggtggggcccagaccatcctatctctttggacctggagacatttccttaactgggctttgcagcagagggaagagaacagtggcagagccaggcgcgtacctcctgtgcccaggacagcacctgtaagcaagggggaagggagcctaccacccagaactcaaatggagagaaagtcaagacaatcacccctgacgtggggctgcaccaatccctgacgtcttgacac

SEQ ID NO: 499948 - DNA, 254 bp, Homo sapiens
tcgtaaaaattatggaaatgaataattttgctaccccctttgaaatttcaaacttctggaaaatatgaaaatattccttgttccttatgaatttaaattgtaaggtatgaatgtgatttgtctgtccctcttgtatcttttccaaaaaatgattctgtttcttttggaaaaaacccgagagttgaagatagtatatttctggtagtactgaatatttccttcccgtttctatccaaaatatatatttgtttcta

SEQ ID NO: 499949 - DNA, 293 bp, Homo sapiens
ctggactatcattcaaatacaaaaacttagtgcatccagaaacaaatccaccaggctaacaagtcaccccacagaacaggagaaaacctttgccacgtatacatgtgatacgcgattaatatccagaacacataactatctacaactcaacaacatacaaacaaataacctgatacacaaatgggcaactatatagactagacattctccaaagaacatacacgaatggccaatcagcccgtgcaaagatgctcaatctcatacgtaatcaggtaaatgcaactccaaaccac

SEQ ID NO: 499950 - DNA, 375 bp, Homo sapiens
aaattgaatcaccgctcacactgctgatgatttagagtgctgtccggtggagatcccacccgaacgtcttatctaatcatgaaactccctagttccttcatgtaacttccctgaaaaatttaagtgtttcataaatttgagagtttgtgacccccttcccttgcttttccaaggtagccagtaaatacttaccacccaaggcttcctaatggtccttgcccccccggtaatattcttttttcaaaaaaatccatccagccatcacttctcaaaccaattatttttcacttcaaaacagtattgacttgtataccttgtaatttgaaatattttctttgttaaaatagaatggtatcaataaatagaccattaatc

SEQ ID NO: 499951 - DNA, 458 bp, Homo sapiens
tcctagaggatccccttgagatatcctagtgtgtctgtgtgcatgcatatgcatgtgcaagtgtgggtgtggtctgtgtgcatgtgtgtgagtgtggtctatgtgcatatgtgtgtgcgtgtgtgcatgtgtgtgtgtgtgtgcatatgcgaatgtgtgtgtgtggcctgtgtgcatttgtgtgcatgtatgtagtaggtctgtgtggatagtagtgtagagtatgtgtagtagcatagtagtatatagtactgtgtgcatagtgtagcctctgcatagtgtgtaggtctatgtgtatgtgtatctgtagtgcgtgtgtgaatgtatagtgtagcatagagtgtgagtctgtgtgcatgtataatagtgggaatgtggtctgtgagagtgtgtgtgtagtgggggggactgtggtctgtgtgcatgtgtgtgagtgtgctctgtgtgaatgtgtgtag

SEQ ID NO: 499952 - DNA, 543 bp, Homo sapiens
ccaggattgggtgtatggcaagaagtacagtgcaaaggtttcaacaaagcccttccagccccccatcgaaaaaaccatttccaaaaccaaagggaaagccccgagaacccaggtggtacaccttgcccccatcccgggaggaaatgaccaaaaaccaggtcaacctgacctgcttggtcaaaggtttttaccccaacgacatccccgtggagtgggaaaacaacgggcagccggagaaaaattacaacaccacgcctcccaatgtggaatccgaggggtcctttttcctttaaaacaagctccccgtggacaaaaacaggtggcaacaagggaaaattttttcatgctccgttaagcaaaagggtttgcccaacccctttacccaaaaaaacctttccctgtttccgggtaaaaaaatgggacggccggcaaaccccccctccccgggcttttggggttgggggaaaaagtttggcaagtaccccgtgtaaaaactttccgggcccccagcatggaaaaaaagcccccagcgctgccctggga

SEQ ID NO: 499953 - DNA, 472 bp, Homo sapiens
ggcgtgaacccagtaggcggaggttgcagtgagccgagatcgcaccactgcactccagcctgggtgacagagtgagactctgtctcgaaaacaaacaaacaaacaaacaaacaaaccgtaagccccctaaagggctgtcttggctttcttcctgaaagtcccaggtgagcttcagtcaggtaaagctggatccagggctcccacactgcccttctcttctgagctttactttcctttgtgttaacatcattcttaaggacgtgagaactccagatgattacctttccatttagcaacattggcaccttggaccctggggccgtgtttccaggatagcgtctgactagatgaacatgcatcacgtgccctctgcggaatccgtcaccgaggctggggtggttaacagtcctcttgttggccaagcctgggatcctatttaaaccaagtggattgagagaagtaggggtactgg

SEQ ID NO: 499954 - DNA, 840 bp, Homo sapiens
agcgggagaagggccatgcggacggcgagggagtccagagccttgagcccggtgctcctccctcgcgcagcggtggctctgcggccgctggagtaaacactgcctttgttccctagcgcctcgtctttcgtcgccccgtgccctcacgccgccgggctctggccggcccgccctcggtccttgaaccccatttcggctcgtgccgtgcggatgcagctgccgggcctgggtttgggcattgagcgggaggaggaggaggaacggcggcgcctgggcggcatgcgatggggaactgctgctggacgcagtgcttcggactgcttcgcaaggaagcggggcggctgcagcgagtaggcggcggcggaggatccaagtattttagaacatgctcaagaggtgagcacttaacaatagagttgagaatctagtagaaaggtggttgaagggggaaaagcccaggagccaagtccataggcctcttacggagcgacaaattggtggacctaggagaaagggcatttatgattccattgccgaaaaacaaaaagatcttgataagaaacattcacaaaagacgccaagaaaggcacgagaaattggtgcagcaatatcatccttccaacaattggagaatattcaagagttcaggaccagaagatgacttcgacatctgggttggagaacatattgaagtcaccagtatgacaggttttccgaagtagttgaacatctcatcagatgctacagtttgacaccgaatacagaaaagccagtgtatttaatgaccaaaattaatcacttattggaactgagacggacatctagatctaagtgggagca

SEQ ID NO: 499955 - DNA, 138 bp, Homo sapiens
  misc_feature (42)..(42): n is a, c, g, or t
gttcgggaggggtgtttaggggtcggtagggtataattgtcntggtcctaggaggtctggtgagaatagtgttaatgtcctcagtcgatcagcaatgatccacaagtctgccgctgctgtctgatcctcgtagtagtc

SEQ ID NO: 499956 - DNA, 305 bp, Homo sapiens
cagggccccacgtgtgcagggctggcctcccagcaccaccaggcagctccgcaggcacagagccaggcagcacagccagaaagaacgccagaaattcccagtccttatccaccggcttcatctggacgctgtgttcgctgatctggaaaccaggggtggggggtggggctggagcacagcacagggcggggcagggatggcggcgggcagtggggggagcctgggtgcccagcccagactggctcctagagccagctgaagtgtcctcgttttttacacttcactaaataactcatagtagcgcc

SEQ ID NO: 499957 - DNA, 1245 bp, Homo sapiens
  misc_feature (555)..(555): n is a, c, g, or t
  misc_feature (558)..(558): n is a, c, g, or t
  misc_feature (583)..(583): n is a, c, g, or t
  misc_feature (585)..(585): n is a, c, g, or t
  misc_feature (611)..(611): n is a, c, g, or t
  misc_feature (1114)..(1114): n is a, c, g, or t
gaaaatggtagcgatggcggttgggccgagtgggtgtctggtgccggcgttaggggtacggttgttgttggcgattgtggttcataggcggtgtctgattttggggcagagattttcatcggaggcatgcagagagttaggcatttgctaggccaacttgctttgcagttgcttgtgatcttgctcgggacagttaaacgtggttaaggttggattccggatggcagagagagtcggtgtacaggaggaaggcacaattttgaaaccagaaaggctgtatgcgggagactacttcttgaagtttgtggatgaacaagtgggaaggttccctcaagtccaagctttggttaggagtgataaaccgaaactgtgcagaggactgcagaatcaagtatgtccagtggttacagatcctgtagttaacagctttggggacggacaatggggaacatggctgaagaaactgagcattctcaggatggaacacagacaggtgaagaattcctgagtgaaaagttggaacgcatataatcttgcttaattgtcctatccttngtnaccttatcaaatgaaatattacagnanctaaaataattagttgtggttccatngatcagtcttttacttgaggcattaaatatctaattaaatcgtgaaatggcagtatagtccatgatatctaaggagtggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttattatagtttacaatgaatgcactgcataaaaactttgtagcttcattattgtaaaacatattcaagatcctacagtaagagtgaaacattcacaaagatntgcgttaatgaagactacacagaaaatctttctagggatttgtgtggatcagatacatacttggcaaatttttgagttttacattcttacagaaaagtccattaaaagtgatcatttgtagaccaatatag

SEQ ID NO: 499958 - DNA, 114 bp, Homo sapiens
acatctactgagctgtgttgaaaaggcagatgtctgcatacaggacgcacatgagatcttgatcttcttcaccggctagtaggtagtagtaaggtgacgtggacataagagtgc

SEQ ID NO: 499959 - DNA, 182 bp, Homo sapiens
accctcttctgtatcttagcaaatacaagaaaggagatgggtactatcatagtctctggttactcaaaagtgacacattaacagatgatgagaggataggtgcataacgcccttcagtggtgagaatcttcctctgttccttatgatagcatacatcggggtacacaccgaagggggtgcct

SEQ ID NO: 499960 - DNA, 857 bp, Homo sapiens
  misc_feature (39)..(39): n is a, c, g, or t
  misc_feature (45)..(45): n is a, c, g, or t
  misc_feature (48)..(48): n is a, c, g, or t
  misc_feature (64)..(64): n is a, c, g, or t
  misc_feature (130)..(131): n is a, c, g, or t
  misc_feature (223)..(223): n is a, c, g, or t
  misc_feature (726)..(726): n is a, c, g, or t
agagacatgtcatcagaactgtgaactaccacgtacagntgttanganaagcaactttcactgnatgttggacgaaaggtatgcgagcacgcgatttagtacaatcattggctataagatgtttgatgcnntatcctttttgtctactcttaatcagaatgaagatgattgactagcatcctgagcaaagaatacatttcacgttttgcgtatgcgttccatngatcagtcttttacttgaggcattaaatatctaattaaatcgtgaaatggcagtatagtccatgatatctaaggagtggcaagcttaacaaaacccattttttataaatgtccatcctcctgcatttgttgataccactaacaaaatgctttgtaacagacttgcggttaattatgcaaatgatagtttgtgataattggtccagttttacgaacaacagatttctaaattagagaggttaacaagacagatgattactatgcctcatgtgctgtgtgctctttgaaaggaatgacagcagactacaaagcaaataagatatactgagcctcaacagattgcctgctcctcagagtctctcctatttttgtattacccagctttctttttaatacaaatgttattatagtttacaatgaatgcactgcataaaaactttgtagcttcattattgtaaaacatattcaagatcctacagtaagagtgaaacattcacaaagatntgcgttaatgaagactacacagaaaatctttctagggatttgtgtggatcagatacatacttggcaaatttttgagttttacattcttacagaaaagtccattaaaagtgatcatttgtagaccaatatag

SEQ ID NO: 499961 - DNA, 116 bp, Homo sapiens
cagcctgtggatcctggggcatttggaagggcgcacacatcagcagcctcaccagatgtgagcatgctacccggcctgcccctccaataaaagtgtgtaaaactccaaaaaaaaaa

SEQ ID NO: 499962 - DNA, 236 bp, Homo sapiens
tttgtatttttattaaagacaggggggtttcaccgtgttagccagggtggcctcgatatcctgacctggtgatccgcccgtctcagcctcccaaagtgtggggattacaggggtgagccaccgtgtctcgccagtatcttattatttaattaagtgtatgtagaaataatgatatttaattttggcatgccaaattatttccatttacttttacatcccctttaccccaacattta

SEQ ID NO: 499963 - DNA, 265 bp, Homo sapiens
atgagatgtgcatcatagtctcaggcacattgtgaactttgggggatgctcgctccaaccgactgctgtcaccttcaccgttccagtttttaaatcctgagtcaagccaaaaaaaaaaaaaacccaaaacaaaccaaaaaaaacaattaaggccatgccattctcatctggtttcctgcccaattaaggtttggtcaaaaaggggtgtacggcaactaatgttatgcacattctcccaatgggggcatcctctaaaagtcgcacc

SEQ ID NO: 499964 - DNA, 136 bp, Homo sapiens
ccccagttggcagagaacaaagcagcagttcgtaaagctcaaagagatgttttctaactcaactggccggcttcctgtgccaaccgacgagaagaaatacggcaatataaagtcctggttcactctcaggaacgag

SEQ ID NO: 499965 - DNA, 165 bp, Homo sapiens
tagaggacccgtgacattcaggtgataggttcaggtgaggactcgttttctacaaaaaaaatataaaaattagccaggcgtggtggcatgtgcctagtggtctcagctactcaggaggctagaggtgggaggatcacctgggtccacgaggtggaggctgcagtg

SEQ ID NO: 499966 - DNA, 205 bp, Homo sapiens
  misc_feature (107)..(107): n is a, c, g, or t
tggctgcaacctctgcactgcttttatttatctacttatttttatagagttgaggtctcactatgttgcccaggctggtctcaaactcctaggctcaagttgacctncggccttggcctcccgaagtgctgagattacaggcatgagccaccgcaccacctgcctgtcttactgtgtgaggaaaaaaataaacggtgatgtgatt

SEQ ID NO: 499967 - DNA, 1954 bp, Homo sapiens
  misc_feature (14)..(14): n is a, c, g, or t
gagcctaccatgcntgaggagactgtgtttaaatgctctcttctcttggtttgttcagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggca

SEQ ID NO: 499968 - DNA, 1045 bp, Homo sapiens
gctgggttgggtgtcctggtccgcgcgagaccccagcgcgcctcgtcgtcatgcctcggaaaatcgaggaaatcaaggacttcctgctcacagcccgacgaaaggatgccgaatctgtcaagatcaagaaaaatagggacaacgtgaagtgtagcagttcgatgcagcagatacctttacagcctggtcatcactgactaaagagaaggcagagaatctgaagcagtcccgtgccggccccggttgggcgggtgaatggaactgaaatgaagcctagagactagcgtgagttggtaactgtattatattaaaatactaatcgatcctactgatgagatccggaagagaagagcggcacagggtctctatagtgatgtggcctgggaggccaaagcggtgcaagcgggctggaggagggccgttcctgtttcatgctctgccttatggaggccctcggggcacaatgaggggagacacgctcatggtgaaggaacttgaaaattggggccaacaccacgcgtgattcggcacccggtccatgcccgttcgcgaaagtcctataacgaagggagaaagctcgagtcatcactgaggaagagaagaatttcaaaagcttcgctagtctccgtatgggcccgtgcaacgcccggtcttcggcatacgggcaaaaagagccagggaagcgcagaacaggatgttgaacaagaacaaaattaagccctcctggggactgggaattcagtcggccgtccacacaaaccacacaaaaacactgttgagaaggcttatctgggagcgtaaaccctcggggatcttgataaaaaggcggggggtcactaaaatatgcgaaagaatagccccagacatggggtgacgaaggctacacgaaaacgataaggattcaggcaagggcagaccgaacgcgaagcaagcgctccgatggaagacgaatgggaactagtagagacagagaccatgagagaggagaagcgacagggaggacaggacgcacagaacacgaaagaaactgcataaaaccgcatca

SEQ ID NO: 499969 - DNA, 346 bp, Homo sapiens
cctcaaggactgcaaactgtactgccactatagctttttgatgactttgagcgagcctggctaacctggccttcccccccactattaacctcgtgggagaactctttgtggtggtaaccacgttttcgtgatcaaatatcactgtcctacttacggggctcaacatactagtcccagccctataccccctctacaaatttaccccaacacaatgggggtccctcaccccccccattaacaacataaaaccctcattcacaggagaaaaccccctcaggttcatacacctatcccccattttcctcctatccctcaaccccgacatcattaccgggttttcctctta

SEQ ID NO: 499970 - DNA, 5623 bp, Homo sapiens
  misc_feature (436)..(436): n is a, c, g, or t
tgatctagaggtcccatgcgcgacgcttccatcaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcntgatggaagcccgttggaaccatgagctggctggatgtgagatgaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccatgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagaggatccagacgatcggtgagcgcgatacttggtccggtgttgtcacagagcatgcaagcgctgattctgtacagaatatgcgtctaacacgtcaggtcctctatgcgagcaactttatctcggatcaat

SEQ ID NO: 499971 - DNA, 4834 bp, Homo sapiens
  misc_feature (436)..(436): n is a, c, g, or t
tgatctagaggtcccatgcgcgacgcttccatcaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcntgatggaagcccgttggaaccatgagctggctggatgtgagatgaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccatgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattc

SEQ ID NO: 499972 - DNA, 205 bp, Homo sapiens
agagtgatactccatctcaaaaaaataaaaattaaaaaaaaattcaaagggaaaatgagggccatgagaaggaaaaaaaaaatggcttgtcctaggaggacaaataagagtttctataactgcctattcaaagttggcaatgaagttcaaaataggaatgtttaacatgtaaaagctgtaaggttgctatatgcatctttccata

SEQ ID NO: 499973 - DNA, 133 bp, Homo sapiens
ggataagagggtgatgtggtgaaggtatagtggtcaagagtggatggtccaattctgttcttcccctcacagaggtccccttcctgacctctcagataccaaggcttcaacagacagaggtccttcttgcagc

SEQ ID NO: 499974 - DNA, 1262 bp, Homo sapiens
agcgcgcaataaccctcattaaagggaacaaaagctggagctccaccgcggtgccggccgctctagaactagtgaatcccccgggctgcaggaattcgattcccttccccacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggca

SEQ ID NO: 499975 - DNA, 130 bp, Homo sapiens
gactggttcctaactctctccctcctcctgcccacacacatcaaaagaattttccctacacccttttctgcctttattttttgatttgtgccacttgtaactaggtgtttatggaataaaggagaatgga

SEQ ID NO: 499976 - DNA, 5336 bp, Homo sapiens
  misc_feature (436)..(436): n is a, c, g, or t
tgatctagaggtcccatgcgcgacgcttccatcaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcntgatggaagcccgttggaaccatgagctggctggatgtgagatgaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccatgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcattagatgactgtaaacttggtcacaggcctggttctggcagttctttgcggacttttttctagcattatgccaaataaacatgcagtctcagtgtgctctcgca

SEQ ID NO: 499977 - DNA, 166 bp, Homo sapiens
atgtcaccacaagaagtactgcagggaggaagccagcgctcaaattgcccctaggactcacccttattccccgaagtcagaagctccccggacgactcgggatgagatacgaagagcttcagcattaatgatagtggagcgtcgccccccgagacaagactcacca

SEQ ID NO: 499978 - DNA, 352 bp, Homo sapiens
gaaaaaacaaaaaaattagtagcataaaaacatgaccctaagtctcacagcctggagtagccccaggtttataaatccatggtcagggctgcaaacaacttgagagcaaccggcctggctgataacaagtcagcagtgttactagcattggcttgtaaacaatacctcaataagggacaagaagaagggaggtgaaatttaaatgtgccaattttgaaactggctaggcattctagtagtgagttgggtggagaacgaagttaaaattatctaaaaataacgttttggaatttcttactatctgtgccatctctccatatgtggtcagaatctttttttttctactaactgg

SEQ ID NO: 499979 - DNA, 4943 bp, Homo sapiens
  misc_feature (436)..(436): n is a, c, g, or t
tgatctagaggtcccatgcgcgacgcttccatcaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcntgatggaagcccgttggaaccatgagctggctggatgtgagatgaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccatgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggagcctgagagacactctcgtaagttacatgcaaactaaagaaagtgaaattcttcctgaaatggcatctcagttcccagaagagatactgctcgccagctgtgtctcagtgtggaaaacagctgctgtgctgaaatggaatcgagaaatgagatagaattatttcctcagctatctttggatgactttggagagaagactcctctctcctcgtctgcggcgtggacttgatcatggactggtgcctttgcattcagaaggagagctgtcagcgtagcaccgaattcaagaccaaggcgtgctacctgagctgacagctttttgaaagccgagctgtttctgaaccatgtacatacatgttctgaaactttctcatcattttatgagtactgttcattgagagatgacaatgaagattagatgaaattggaaataaaccaacattgtttacattccaggagacttgtagctcagccacacacgcagtaatgacctgtgccattttgttcttgatgtccataaagagatgttcatagttccagtcgtggcagcaccaccaataca

SEQ ID NO: 499980 - DNA, 254 bp, Homo sapiens
tctgggtcggagtgagttgaggcaggatatcaggctctgaaggagacaagaggagaggtctgagcctggaagagggagaggagaggtctgagctggaagagggagaggagagggtctgagccgtggaaggagggagaggagagggtctgagcctggaaggagggagaggagagggtctgagccgtggaaggaggaagaggagagggtctgaggcctgggaaggggggagcaggagaaggctctgagccgtggaa

SEQ ID NO: 499981 - DNA, 273 bp, Homo sapiens
cggcacgaggctcctggcacaggatatgagggcacttacaagaggaggacttggagactcgacaagtcacctccctgaccacaaataaggtcctcccaaggcagaaatcaatgatgaatgtgttttgtttttttgttttgttttgttttgtttttaaagaaagaaagaaaagtcatcgtaggaacacctgcctctgaggaacattactattaggatcctaaatacagcaattgtctgtattcttattgcataggtccccttaaaaaaaaaaaa

SEQ ID NO: 499982 - DNA, 1200 bp, Homo sapiens
  misc_feature (40)..(40): n is a, c, g, or t
ccccggaaaacagcttttaaccttatttccggttcaagcncctgtcccttagcgggctcttgccttggctaccctggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggca

SEQ ID NO: 499983 - DNA, 206 bp, Homo sapiens
  misc_feature (115)..(115): n is a, c, g, or t
tgccgcggttgcatctcgacgagctcccctcactcctggcgtgttgcctgtcttttcgacccgcaggtttctttcttcgtttttttcttcatttccagcccatcctcattggtgngttcactgtcggtcacacttcctctcaagccactcatttccacattcaccatctttcacgtggggtcccggcagctcgcacattcgtcaca

SEQ ID NO: 499984 - DNA, 1014 bp, Homo sapiens
  misc_feature (16)..(16): n is a, c, g, or t
aatttctctcggaccnacattggtccgagagaaattagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcatggtgccaccagtgtctgatgaagggcagagtgacccagactgcaggcagtaactgacttcacacagtccctggcatttagtcatctgtgattgttttatcactctggactgtgcagagccacctgccaccgagatctgcattccgactgcctatgaacgggtgtgggggccgggggctggcttgctgaagtcttcaacttgcactcggagctcctttgatacctcagagctggctgtcaggtggcagctcacacccagactcactggccacacctcagcagggggggagtcgagtgtcagtctctttctgtgaaggctttttttttcctttggcctgggaatttttcccatttttatgaaggggttttaaattgtttcattttgtgtgctgtgcttcaaagccttaactgtcaaatcttgcattatcttgtttgtacagaaatatactggcctagcagaggca

SEQ ID NO: 499985 - DNA, 4596 bp, Homo sapiens
  misc_feature (436)..(436): n is a, c, g, or t
tgatctagaggtcccatgcgcgacgcttccatcaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcntgatggaagcccgttggaaccatgagctggctggatgtgagatgaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccatgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaatacccactctggtgtacagacacgactggaactatgaacatctctttatggacatcaagaacaaaatggcacaggactccctccccagctcggtcattagtgccatcagtggacagctgcagtcctacagcgatgcctgtgaagtgctgtctgtcgtagaagtcactctggggtttctgagcacagctggtggggatccaaacatgcagctgaatgtgtatactcaagacatcctgcaaatgggtgatcagacgattcacgtgttaaaggccttaaacagatgccagttaaaacacaccattgccctctggcagttcctgtctgctcataagtctgaacagctgctgcggctgcacaaagagccatttggggaaatcagttcaaggtacaaagcggatctgagcccggaaaatgctaagctcctcagcacattcctaaatcagactggcctagacgccttcctgctagagctgcacgaaatgataatcttgaaactaaagaacccccaaacccaaaccgaggagcgcttccgccctcagtggaggtatggatttgcacacctatggggcggggcagacacaatgttgtgctgtctctcctgtgatcttctatagacacaaaaatagttcttttcttaccacagaatcccatttcctgctttttgtcattaccagggcacctgaggactggctttttggttttaatctccagcctgggcaacagagggagacttcatctcaaaaacaaacaaaaaaaaa

SEQ ID NO: 499986 - DNA, 121 bp, Homo sapiens
actgagcataagcacagtggccaagaacagctgtaacagccgctggtccattccatttggtggcagcgcggtcacagcaaggcaaaattcccaagacagctccatggtgtatccaggtgca

SEQ ID NO: 499987 - DNA, 4122 bp, Homo sapiens
  misc_feature (436)..(436): n is a, c, g, or t
tgatctagaggtcccatgcgcgacgcttccatcaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcntgatggaagcccgttggaaccatgagctggctggatgtgagatgaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctgtctgccctgcgaccacgtgcactgcctgcgctgcctcagggcctggtttgcctcagagcagatgatatgcccctactgtttaactgccttgccagacgaattctctccagctgtttcccaagcgcacagggaagccattgaaaagcatgcccgcttccggcagatgtgcaacagtttcttcgtagacctggtgtccaccatttgcttcaaggacaacgctccgcctgagaaggaagtgattgagagcctgctctctctcctcttcgtccaaaaggggcgcttaagagatgctgcccagagacactgtgaacacacaaaatctctctctccattcaatgatgttgtggataagactcctgtcatccgctcagtgatactgaaactgcttttgaagtacagctttcatgatgtaaaagattatattcaggaatatttgaccctgttaaaaaagaaagcattcataactgaagataaaactgaactgtacatgctcttcatcaactgcctggaggattcaatacttgagaagaccagtgcttactccagaaatgatgaactgaaccacctagaagaggaaggtcgtttccttaaggcatattctccagcaagccggggccgagagcctgccaacgaggcctcggttgaatacctgcaagaggtggcccggatccgcctctgcctcgacagagctgcagatttcctctcggagcctgagggaggcccagagatggccaaggagaagcagtgctacctgcagcaagtcaagcagttctgtatccgggtggagaacgactggcaccgggtgtacctggtgcggaagctcagcagccagcgggggatggagttcgtgcagggcctctccaagcccggccgcccgcaccagtgggtgtttcccaaggacgttgtcaagcagcaggggctgcggcaggaccacccaggccagatggataggtacctggtgtacggcgatgaatacaaggctctccgtgatgctgtggccaaagctgtcctcgagtgcaagccactgggcattaagactgctctgaaggcctgcaagaccccccaaagccagcagtcagcctacttcctgttaacactgtttagagaggtggctattttgtacagatcccacaatgcaagcctccaccccacgccagagcaatgtgaagctgtgagcaaattcattggcgaatgcaagatcctttcacctcctgatatcagccgttttgcaacatcgctcgtggacaattctgtgccattgttgagggcggggcctagtgacagcaaccttgatggaacggtgacagaaatggccattcatgctgcagccgtccttctgtgtggacagaatgaactcttggagcccctaaagaatctggccttctccccagccaccatggcgcatgcttttcttccaaccatgcctgaagacttgctggctcaagctcggaggtggaagggtctggagcgagtccactggtacacttgtcccaacggccatccttgctccgtgggagagtgtggcaggccgatggaacagagcatctgcattgactgccatgcgccgattggaggcattgaccacaaacctcgggacggctttcatctggtcaaagacaaggcagacagaacgcagaccggccatgtgctgggcaacccgcagcggagagacgtggtgacatgtgaccgagggctgcccccagtggtcttcctccttatccggctactcactcacttggctctgcttctgggagcgtcccagagttcccaggctctgataaacatcattaagcctccagtgagggatccaaaaggctttctgcagcagcacatcctgaaggacctggagcagttggccaagatgctgggacacagtgccgacgagaccatcggcgtggtccacctcgtcctgcgcaggcttctccaagagcagcaccagctctctagcagaaggcttttaaattttgacacagaattgtcaactaaagaaatgaggaacaactgggaaaaggaaatcgcagctgtgatttctcctgaactggagcatctagataaaacccttcccaccatgaataatctcatcagccaagataagcgtatcagctctaaccctgtggccaaaataatatatggtgacccagtgaccttcctgccccacctgccccggaaaagtgtggtccattgctctaagatttggagctgcaggaaaagaattacagttgagtacctccagcacattgtggaacagaaaaatggcaaagaaagagtgcccatcctctggcatttcctgcagaaggaagcagagctgaggctggtaaagttcctgcctgagattttggccttgcaaagggatctagtgaagcagttccagaacgtccagcaagttgaatacagctccatcagaggcttcctcagcaagcacagctcagatgggttgaggcagctgcttcacaacaggatcacagtctttctgtccacatggaacaaactgaggagatcgcttgagacgaacggtgagatcaacctacccaaagactactgcagcactgacttggatctggacactgagtttgagatcctcttgccacgccgacggggcctgggcctctgtgctaccgctctcgtcagctacttgattcgcctacacaatgaaattgtctacgccgtggaaaaactctccaaggaaaacaacagctattccgtggatgccgccgaggtcactgaactgcatgtcatcagttatgaagtggagcgggacctgactccactgattctctccaactgccagtaccaggtggaggagggcagagagaccgtgcaggagttcgatctggagaagattcagcggcagatcgtcagccgcttcctccagggcaagccccggctgagcctcaagggaacacacagagagaaaaccgtgtctagggaaggcgatgcctggggctggaaaaaggaagcactctgcttgcccagaggctggaaggagctgctctgttccctccattcacccctgcctggttaagacctgcggtattcgggagcgtctgcacgcaagtgttcagtgagcatatatggggagtcttcagttccgaagtcagccccgtaggtcattcccctaccatgctgggagcacgtgtcatccacacagagcgtggccagaaggaggggtcctctagagtcacct

SEQ ID NO: 499988 - DNA, 348 bp, Homo sapiens
ggtggcgattaacattcctcagcctcactgagcgccgctgacccatctgtgaaagggctggctcccggcgggcctcagagatcagaactcaggaagccgaagacacccactcggtagctgggaagtgaccacgatggaggttgccaaacagcagccaagaaaggagccgtcgaatagccggccatccttcactcatcctcccggctccagtggggtgggtggaagaaacaccagccacatgacgcgttaagcgggccacatttcgtgagggcatgacacacattgtgagattacaaagcaactcgttcacgtgagcgtccgaggagaacggtggagtggcacgaagcg

SEQ ID NO: 499989 - DNA, 135 bp, Homo sapiens
tgagatcaggttatgagactggctaatttttgatttttgttagagactcaccatgcaaggctgtcgaactctggctcagcactcctctcagctaagtctggatcagatagccacgcacttacatatgcatagaag

SEQ ID NO: 499990 - DNA, 987 bp, Homo sapiens
  misc_feature (5)..(5): n is a, c, g, or t
  misc_feature (115)..(115): n is a, c, g, or t
  misc_feature (136)..(136): n is a, c, g, or t
  misc_feature (161)..(161): n is a, c, g, or t
  misc_feature (195)..(195): n is a, c, g, or t
  misc_feature (225)..(225): n is a, c, g, or t
  misc_feature (239)..(240): n is a, c, g, or t
  misc_feature (261)..(262): n is a, c, g, or t
  misc_feature (271)..(271): n is a, c, g, or t
  misc_feature (278)..(278): n is a, c, g, or t
  misc_feature (302)..(302): n is a, c, g, or t
  misc_feature (326)..(326): n is a, c, g, or t
  misc_feature (329)..(329): n is a, c, g, or t
  misc_feature (335)..(336): n is a, c, g, or t
  misc_feature (339)..(339): n is a, c, g, or t
  misc_feature (341)..(341): n is a, c, g, or t
  misc_feature (348)..(348): n is a, c, g, or t
  misc_feature (350)..(350): n is a, c, g, or t
  misc_feature (352)..(352): n is a, c, g, or t
  misc_feature (355)..(355): n is a, c, g, or t
  misc_feature (357)..(357): n is a, c, g, or t
  misc_feature (366)..(366): n is a, c, g, or t
  misc_feature (371)..(371): n is a, c, g, or t
  misc_feature (375)..(376): n is a, c, g, or t
  misc_feature (391)..(391): n is a, c, g, or t
  misc_feature (395)..(395): n is a, c, g, or t
  misc_feature (444)..(444): n is a, c, g, or t
  misc_feature (458)..(458): n is a, c, g, or t
  misc_feature (478)..(478): n is a, c, g, or t
  misc_feature (505)..(505): n is a, c, g, or t
  misc_feature (513)..(513): n is a, c, g, or t
  misc_feature (521)..(521): n is a, c, g, or t
  misc_feature (537)..(537): n is a, c, g, or t
  misc_feature (541)..(541): n is a, c, g, or t
  misc_feature (603)..(603): n is a, c, g, or t
  misc_feature (950)..(950): n is a, c, g, or t
aatanggatatatttataataatataataattatataaagaaaatataataattggatatgaaatgagtataaagatgtaattattaagtaaaaaaataagtagtaagaatgtanaagaaagaaaaaaatataaanaaaagtatgctgagtgtagggagtnggtgagggatataataaaatattgtgaaggagtnaaaatagaaaaaatgaagaaaaagttatantgatttataagatnnatggaaaataaaaaagtaaanntggtagtgnagtaaanatttggttaaaaggaaaaaattantgatggaaaaagatagtaattaantgnatttannttntntaaattntntnttnanaaaaattanttttntttnntttaagatgggtttnatantgttgaaaaaagatttggttttatttgtaaagtaaagaagataatatantgattgaagtattnaatgatttagttgaggatgnttggggataaaaatttgtaaaaaggtnaattaagntagttagnagagaatataagtggnttgnagaaaaaaaattaggataatatgtttgttaaaaagaaaaaaagaataagaggtgaaaaatantagggattaatgtgaaatagaaaataaaaagaagataggtgaaatttgattaaataaatttaattgtggagtgagataaaaggaggataaaagaaagagtttggttaaaaaaagtgtaagtggaaaaagggaaaaataagaaggtataataatatagtaggaaatggaaaaaggatgagaagtatttatttgagtagaaatttgaaaaaataataatgtagatatgatgggaaagaatgaaaagaaggattgggatatttgtgatggtagaagagtattgtgaaaataaaagataattagaaatgagtgttgttaaaaataaaaaatgatagttattagaagagggnaagaaataaataaataaaggtaaaggattataagtgt

SEQ ID NO: 499991 - DNA, 411 bp, Homo sapiens
tttttttttagaagcttcaatctcaaacctttattttgctgtaaaggggaggaaaatggttagtgggtttgtacactgaacactttagtacagagaagcgtgtgcgaccaaccgtgcagttacagctttcttcacatttccccattccacacagctgttccaatgagcgatcttgccctggtcacaccacttttaagcacactcacaaaacaaccacatatacagggttttcacaaatatgcaaataaacagggttttcagaaccaatttttacaaagtgttatctaagtaagatgacccagggcccagtctcttttatttcccaaactgctttgactgacagtttaacagcttcccctctgctcagggatggttttttaagcaccattcaagccaaacccacaatggatg

SEQ ID NO: 499992 - DNA, 95 bp, Homo sapiens
aggtttcccttttaaagagctccccccttaaccccaaaaaaaccggggtatggttttttaaaaaggaagggggaattaaaaaatttccaagctta

SEQ ID NO: 499993 - DNA, 1061 bp, Homo sapiens
ttgaaccctgggaggcggaggttgcagtgacccgagatctcgccaccgcactccagcctgggcgacagagcgggactccacctcaaaaaaaaaaaaaaaggggaaactgactctactctgtgatgccaaaacagatgggagttcccttgtacaccacttttctctcctttctattctcaaggctaattggtgtaacagctctgctttgtgtggcactcattccagttcctttcagcccacttacagttatcgtgggacagaagctgggttgtcagcctgaccagtggcgcgggagccgttgggcagctttgtggtccctttgagggggactcaaggtctcgcaggtggcgccgtcggtcttcccagggctcaaaagggaggccacacccccttgcaggtttctcagcgggagcgcgcttacatcgctgggagaccctttgaaccccatttggtttgcgaccgtttgtgtaccgggcgaagcgccccttgaaagccccagttagcacggtgtgggcagcgagggccctcgcggtggccacgtttaccgcgtgttgccttggtgcggtgggaccgaacctttcgagtgtgtgtgctccctgtgaagccctgttgggcctttgggggggccgggaatgggacgtggtgccataagaaacccttctccattctccaccttaagcgtggccagaagaggccaccgcgtgtgtttgcctgggggcaacaccttaaaaggggggggacacacctatgttgtgtgtggcgctccctttgtggttgcacacaaaaaacaacagggtgggaaaaaattttgcgcggcaagggcaattgaaggggacacaaatgtggcagctttcccgtggcctgtgaaagtgtgcgccccttcgagggtcccctccaggaacgcccattcgctgcacatcccttggccggtgccttgaagcggcgccctgtggcccccacgctgtgggccttctcgtgcgcaggaggcaaattgttggcccgccgggggacgacggccgatgggaagggaactccccgtggctgggcggggccaacaccca

SEQ ID NO: 499994 - DNA, 157 bp, Homo sapiens
cacccgacgtgctgggattacaggcatgagcagatgcaccaaggccgaagacagtatatcgcttgtagccagctgctttgggttcaactcccagatttctgggagtttcctcatcccctgacttgagtgacgggtacatatgttggggctgtttgag

SEQ ID NO: 499995 - DNA, 210 bp, Homo sapiens
tggtatgtaatatctcactgatgacagctggagaatcccagctgatcagtaggctggtgggggtcgcagcaaacaacttccaggtccctcggaacatcagaaactgttgattgttggccactcaataagggactttcctctctgccattatgagcaatgatgctgaccacatactctgtgcctggagtgagtgttggtgagggtgatgga

SEQ ID NO: 499996 - DNA, 297 bp, Homo sapiens
gccctggattaagatgcactgatcaacatggtgaaagcgcattctatactaacaatacacaacattagccaggtgtggtggcatgcgcctgtaatctcgtgctactcagtgaggctgaggcgggagactcgcttaaacccgggaggcagacggctgcagtgaaccgaggtggcgccactgcgctcacccctggggcaagactctatctcaaaaacaaaaattaaaaaaacattaatctgggtagatggtcatcccagtaacgggatatggctgtaagaatttcatgaactttgaaat

SEQ ID NO: 499997 - DNA, 833 bp, Homo sapiens
  misc_feature (189)..(189): n is a, c, g, or t
tgccgggcgggggttgtcgtagtgtattgggcggtggctgactagcaccgccccgcgtctccctgagcgtgacggcaggtggggcttctgcgctgagccgggcgatggacgacagcggcgagctgggtggtctggagaccatggtgaccctcacaggaggctgggcgacgagctgaccctgggagacantcgacgagatgctgcaattctgtcacgtaaatcagggtgggagagttccctgacttgttttcagaacagctgtgtagctcctttcctggcagtggtggtagtggtagcagcagcggcagcagtggcagcagcatgcagcagcaggcaattggcaggggctagcagcagcggagcttgtggacccttcagttgcaaggggtcattcacgccaggtcacattaccttccttctctccctcgggggcctccccaagaggctccaactctgcaaggtcaatggtttctcccacctcagttcccaccaaacccaggcaactcctattcttcaggccccgcccccagccccagctcatcctcaaactcaggcttgcaacaacagacggtaatgatcacgccaacatttcagcaaccactccgcagacgaggattcatcccagcagcctttgatattcccagaaattgcagctactaagctttcaaagttctttcacccttaaagtcgaaagcctgggtgacatcttcgcaggtaacatcgggtcaccaattcagcaggcatgttgagactgtacaggccacggtggtcgtgcaacaaacggcatggctccgttgaaccttttcccggtacggtgcgacacgtgctggcca

SEQ ID NO: 499998 - DNA, 744 bp, Homo sapiens
  misc_feature (254)..(254): n is a, c, g, or t
  misc_feature (296)..(296): n is a, c, g, or t
  misc_feature (332)..(332): n is a, c, g, or t
  misc_feature (391)..(391): n is a, c, g, or t
  misc_feature (498)..(498): n is a, c, g, or t
gggaactgtgcttagggaacacacattccttttgacagggctctgtcactgggtgcggtgatgaacttatacagactgacatgtgctcttttttctctttatttcaacctcaatggtattcctacaggacatggataaccatatttaactgtattttattgcagcccgtaccttctttgggaatacaattgtcataactttttattcttaggtctggctgtagtggtgtgcaaaactccgtacattgctatttngccacactgcaacaccttacagatgtggaagatgtgaaattngtcatcaattatgactaccctaactcctcagaggantatattcatcgaattggaagaactgctcgcagtaccaaaacaggcacagcatacacttnctttacacctaataacataaagcaagtgagcgaccttatctctgtgcttcgtgaagctaatcaagcaattaatcccaagttgcttcagttggtcgaagacagaggtncaggtcgttccaggggtagaggaggcatgaaggatgaccgtcgggacagatactctgcgggcaaaaggggtggatttaatacctttagagacagggaaatttttaacagaggttcctttacccggttaaaaagattttgggggcaaactcccaaaggggtgtccagggttgcaaatttccccctgggggccttttgaggaatttttgggtcgctggttggcaatcccgactatttgtagggatggt

SEQ ID NO: 499999 - DNA, 461 bp, Homo sapiens
  misc_feature (33)..(33): n is a, c, g, or t
  misc_feature (67)..(67): n is a, c, g, or t
gaggcattgaggcagccagcgccaaggggggcnttttctgctgaaggggggggcagggcggggagcnttggatggaataccgagatagtttctctgaagataatatacatataaaatatgtcaaggtactagatatgtagtagtttagtattatagctagattagagaatatgagataagagtaggaggagaagataaggtttctaaaacatgacggaggtgagatgaagcttcttcatggagtaaaaatgtttaagaaaatgagagaaaggactacagagcccgatataccaatagagggcaatgtttaataaatgaagtgataaagtaagttagttaagtgtaggtgtaaatattgaaggattttaaagagataacgggtgataagactgaatcatggcagagatggtcttaagctagtaagattataagcgagaaatggagatattggagtgtggaga

SEQ ID NO: 500000 - DNA, 131 bp, Homo sapiens
gatctagccgatgcttatcgacggtcccaacaaaaggacagctccttctgccagggaggccatggggactgaggggaaagggctgccccttgtgaggggcatggaaggtggcggcagttctgggacgccca

SEQ ID NO: 500001 - DNA, 1438 bp, Homo sapiens
gtcttcctgggcatgttaccgtatgacatatgcgaagagcgtgcactccgtgagtttacctcttgtcagttggctgctgacttgagtacgttggccaacgtacgatatgataatcctacttgctagaagatagtgcatgtgcactgcttgccaggtatcctcgatggagatgtcgtattgcgcaaagatgttcctgatgagatttaatacccttcttggttggagacgcaggcctcgaggaattttgaattcagaaatcgacacataattggtagcatggcttcttttcgatgcaggccttgtgtgacgtatgtagctaagattcgctaagaaagtagtcggtctagtctaacgtttaccttataggcatcgcaaaagggaaaaagctgagctcgctcataatgctgttgcgagaacattccaaagctgcagttaggttgaaagaattgtggttcgtcaagagagaaagagccacttacggtggaaatctaagcttgcgtgcgaacgcgatagacttgctttggctatagaacaattctccttggacaaggcaaacaatagtgagaatgcccccatcggtccgccaggaagaaagaagcttagttcgtaagtccccggcttggggtaccccatttgaacattcacagatggtaataattgggcttgatttgttctcgcggcaaagttgaccggtaacaccagaacctggcacaatgtgttaaaaactgcgtcgagcccattggagggttcgcaggcgccaagaagaagtcgggcttggcgaagcacattgataaattccccatattggcggatttagaaaacatcaagggtggcgagaagctcccaaattttgcctgtatagtgtcccaggggcttttcgttggagaaagcggttccccggaacttgggactagcaccccaagattaaccggctttgtccccccaaatagaagggacacgcttctgtaataagtcggccgttgcaaagagaccaatattgtttcaagccgccgttttccccgagtttggtccaagggacacttcgttagttggctacctaagcgggtttgtcaagtgggagaggacaacggggcagcaaagaaaccacatagaggtttccaaacaggaagatacgccgtgacaactttgggcgcacctttgtgtttcttgcaccgccctttggtcggtaagcaaacgagaccaaagaggagctccgccaagatatggtccacactccgtacacgacaacgtgaagggcgaaacctttagtgaatataagatccctcgggtttgatttcggggcctgtcggagtcctcgcccggccgacagtctttgtgttggtttgcagaacagtcagaagtttcagccttcggccagaacctggggatctgagcagcgctggagtacatcatgggagatggcagaccccatcggccg

SEQ ID NO: 500002 - DNA, 843 bp, Homo sapiens
ccaggaacgtcaagctgctgctggagctgtcactggtgatcgtgcaccattcccttgcacccttttggcatgccgttcctccagcgtgggcagccacgccagcttcctgctggactggaggctgggggccttgccggagcggtctgaggctcctcctgagtactcggaggtggtagccgacactgaggaggcgagccttggaggcagtaggtccccattccacgctttccgcatggaacccgatatgagctctgtgaaggcccgttacttcgactacatccaagagttccggatagctgccgtcatcgccatgtactctgtaggtaggtatccagagacccagtcttggagggacatgaggccgcgctgcgttgacttgctttaacgggacagggtaccccgtcgaggaacaatggtatgcacaccagacttttcagccaccatgactgctgagggagtgcgctggactcaagggctgacctcccgctgactgtcgattctaaagtaggggaaccgaaagtctcgagcacgtgaggcgaggggcctattcggcacttctcgacaatggagaacagaggaggagcccggttggactctgacttacctggaccgttgaccttgtgaggcattgagatgcccagtgcagtatccgagagactggccaataagcctgtcgtccaagagcaataggtggtgctggaagtccccgtaggagcctcacagtctgggagaagcagagccagacatagagagatccaagtatcagagaacccagaagaagagaccatgcaacgtgtgaggagtccagacaggaaggacgagaaggagtccttgcgggacagg

SEQ ID NO: 500003 - DNA, 751 bp, Homo sapiens
gggaggctgacggccgcgggcgtaagctggactgcagccgcgagctcctggaggcggcgggatggaggctggcggccgagcctggaaacctgtgccggctgtcaggcacatcatcctggtcctctcagtgaaaggggggcgttgtggaaaatgcaccatctccactggagctggccctgtgcactgctgccatgcaggcaagaagtgtgtggaatcctgtgatgttgtgaccttgtgtggacccatgtatacccctgcatgctcgggtgctgcatgggcagggctgtgcaccagtgctgacctgcaggctggtgcaccctgtcttcctggaccgggagcagagcatctcgctcatgtctgtgtgtgcttcctgctgtgagaatgccggacgaggccgtggatgtggagaggccccaagaaaaacgcgctgatacagcagtattgtgtccgacgtggccatggggggagctggactaccttggtggtgtgacactgccccctggtggacctcctgatgcagcactatggccacccatcagaagcccgtgcgtccctaccagcccctgtggggcccacgctggtcaccacggccccaaggcgagtgaccgtgggggaacgtgaggcgcgagatggacctacggaggaagagggctgccggctgactgggaatcgggagaatatggcgggtgaccagcccacctgacgagggcacagcgactctcagggcgcggcgaggctgccactgcagggc

SEQ ID NO: 500004 - DNA, 987 bp, Homo sapiens
ggagtttcatctcactcggctggaccatgaccgatactatgtccccatcgccgtttgtgcgccattgtataatatcatttcccgtcgaaaatcgcgatccccccggggtcttgcaccacccgcgttccagggcacgggtgtgggacccgagatgtgttctctgcaaagggtgtattcctccctgcaaagtgcccatgggttgaaaatggccgagcgctaagtcacaggccaattaatagcctaaagttcaaagtgataatgcgacctgtgcatgtctctgcgatgggcagagcatagggttttatcacccaatcgcggcaggtttaaaagagcattcttcccgtggtgcgtgaacaattgttggttcaaaggatctcttggttcggacactgttcttcatggtcccccgtgtcagtgccccaagtaagtagggccaactgttctacggtgtgaaagttgtaggggtgaaagtctacaccgcggaaagggttattgtataaggtgagtacgtggggacgtataagaaattggtaggagagcgcgttgtgctcaaaaggcggtgttcacgccgacgggtcgttttaaaagtacacctttgtgatacctccacggcaccagcgggatgtacattggcgtgagcggttcaacgcacgcggttttgagagccggtgtgtagtcgtagtggccgtgcctcatggtgagctcgaatcgtaaattggggcattgaggaagtggcggaacaatctgtggggagtaagaagagaagatctgttaatgggtataaccgtgtaaacaactatctttactgggacggtcgctagacataagagtactatagaaagaaaattagggaggaaattctaaaagagtagtcaacatcacgctcttatgacaggatgacaacagatgacgttgtcaagcccccacaatgttgggacaccaaaaaaaaaaaccacgttggcgaaccaaaaatcaagggccaaaaaa

SEQ ID NO: 500005 - DNA, 1307 bp, Homo sapiens
  misc_feature (436)..(436): n is a, c, g, or t
  misc_feature (1087)..(1087): n is a, c, g, or t
  misc_feature (1093)..(1093): n is a, c, g, or t
  misc_feature (1103)..(1104): n is a, c, g, or t
tgatctagaggtcccatgcgcgacgcttccatcaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcntgatggaagcccgttggaaccatgagctggctggatgtgagatgaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagggattacctggccttgtggagtgaccccagaacagaccactagcctggcatctgtggaagctgttaccattttcatagtcatggagacaaggatgtcagagaatgccaccggggtttggggtcttcaaaacagtgctgtcaacagaaccaaggaacaggaagccaccatgcctgtcactcaacacccttcataaagctactaatgtggggtggtctgcagaaagaaacctgtgaccctacagtgatgcccctctgtggccacgcagtggtgtccagcaacagtggccactcagccaaacacagnctcagnctctgcctcnnccgcacggtgaccttcacgtgagcacatccagagccctcacctgccaggggtctggaagaggcagcgctggtgtccgaccttgtggagcacaggaaggtttactacaaggaggccagcatggatgctggatgtgttgactctgacctatcaaaaacatcagcggcttagacacagtatcaggtggattccacccaggcatggg

SEQ ID NO: 500006 - DNA, 966 bp, Homo sapiens
  misc_feature (436)..(436): n is a, c, g, or t
tgatctagaggtcccatgcgcgacgcttccatcaacgtccctttcagctggaaaatcaaggactatctggaggagctgtgggtccaggctcagtacatcacagacgcagaaggactgcccaagaagttcgtggacatctttcagcagactcctctgggcaggtttcttgcccagctccatggagagccgcagcaggaacttcttcagtgttacttgaaggatttcattctcttgaccatgcgtgtgtcaacggaggaggaattaaagtttctgcagatggctctgtggtcctgcactaggaaactgaaagcggcgtcagaagcgcccgaggaagaggtttccttaccgtgggtgcaccttgcctaccagcgtttcagaagccgtctgcagaacttttccagaatcctgaccatctaccctcaggttctccacagcntgatggaagcccgttggaaccatgagctggctggatgtgagatgaccctggacgcatttgccgcaatggcctgcacggagatgctgacaagaaacaccctgaagcccagtccccaggcgtggctacagttggtgaagaatctttccatgccgctggagctcatctgctccgatgagcacatgcaaggcagcgggagcctggcccaggctgtcatcagggaagtcagagcccagtggagtcggattttctccaccgcactcttcgtggagcacgtgctcctaggaaccgagagccgcgtccccgagttacaggggctggtgaccgagcacgtcttcttactagacaagtgtcttcgagagaactctgacgtgaagacgcacgggccttttgaggccgtgatgcgcactctctgtgaatgcaaggagacagccagcaagaccctcagcaggtttgggattcagccgtgctccatctgcctgggagatgcaaaggaccccgtctaggagcgtaatcggtacgagctcgatcga

SEQ ID NO: 500007 - DNA, 745 bp, Homo sapiens
ggctgcaggaattcggcacgaggagagagagagcgagagagagagagagagagagagagagagagagagagagagagagagagagagagagagagagagagagagagagagagagagagagagagagagagagagagagagagagagagagagagagagagagagagagagagagagagagagagagagagagagagagagagatagggagataggagaagagagagagagatagtgagatagagtgagagagagatatataggatagtagatattaagagagatattaaagataggatagatgtggtgtgaaagaagagtggatgagaatgtgagtaatatggtagtatttaaagatagtggtttgagagagataagttgagatggaagaagagttttataaatagagaaagagattggggaggtttagagtgagttgagagagatgatattgagaggtgtaaggtttaaaggaagatgaggataaggatgttgggagtgtgagatagatgtgaaggaagtatttagaaagagtgaaaggtagtaatgaggaatagaatgatgaagggaatagaagatattatagaaaagtggtataatagataagaggatataggagtgtgtgggtaagaataagagagtgaagatattgaataaatttgaatttagtgtagaaggatgagtgattattgaggtaaattgaagtttgttaaaaggaatgtggatgaagagattagggatggtg

SEQ ID NO: 500008 - DNA, 942 bp, Homo sapiens
  misc_feature (35)..(35): n is a, c, g, or t
  misc_feature (88)..(88): n is a, c, g, or t
  misc_feature (131)..(131): n is a, c, g, or t
  misc_feature (148)..(148): n is a, c, g, or t
  misc_feature (154)..(154): n is a, c, g, or t
  misc_feature (156)..(158): n is a, c, g, or t
  misc_feature (171)..(171): n is a, c, g, or t
  misc_feature (178)..(178): n is a, c, g, or t
  misc_feature (188)..(188): n is a, c, g, or t
  misc_feature (193)..(193): n is a, c, g, or t
  misc_feature (213)..(213): n is a, c, g, or t
  misc_feature (225)..(225): n is a, c, g, or t
  misc_feature (235)..(236): n is a, c, g, or t
  misc_feature (239)..(239): n is a, c, g, or t
  misc_feature (243)..(244): n is a, c, g, or t
  misc_feature (247)..(247): n is a, c, g, or t
  misc_feature (257)..(257): n is a, c, g, or t
  misc_feature (271)..(271): n is a, c, g, or t
  misc_feature (301)..(301): n is a, c, g, or t
  misc_feature (330)..(330): n is a, c, g, or t
  misc_feature (349)..(349): n is a, c, g, or t
  misc_feature (372)..(372): n is a, c, g, or t
  misc_feature (388)..(389): n is a, c, g, or t
  misc_feature (400)..(400): n is a, c, g, or t
  misc_feature (407)..(407): n is a, c, g, or t
  misc_feature (416)..(416): n is a, c, g, or t
  misc_feature (425)..(425): n is a, c, g, or t
  misc_feature (427)..(427): n is a, c, g, or t
  misc_feature (449)..(449): n is a, c, g, or t
  misc_feature (564)..(564): n is a, c, g, or t
  misc_feature (594)..(594): n is a, c, g, or t
  misc_feature (631)..(631): n is a, c, g, or t
  misc_feature (817)..(817): n is a, c, g, or t
  misc_feature (862)..(864): n is a, c, g, or t
  misc_feature (882)..(882): n is a, c, g, or t
  misc_feature (921)..(921): n is a, c, g, or t
ttgtaaataagaagcccgtagatttttctcatctnatgaacttgttttcagtaagatgttctctttgttctgacacctctcgccaacnccaatgcccaaagcatcaaggaacagatcaggatgtcattccntcctttaatcccatggngccgtncnnnagactgacacagntgccganctcttccctnatggnagccatttttaactgccaancttcccattccntactccattnnggncctnncanagtgtgtcancattcgttcctcanctgaatccagaagggctggaagtcctacanctgtcacagaagaaggaacattctcttcnacccacttcaaatcatctncctgtccctcgcttaactttacnatttccattgggttcnngtctggtactnctcattntcattcctncaaagcctncnttcagcataggctccttttgtncatcctcctcctcttcctcagacaatggtgataaggcaaacctctggttgtttttagatggtcgccagagaaccatgaagacaaagaggatcatggagaacagcaagcgccaganggcatcgtctacccacagctcccgccagtncgactgacatgtcactattctgaacttcatggttgtncagatgataaacacaatggatgctgccactgccaaaataagcgtgttggtgaaatgccgatacaaagagagtcttacaatgttcctccgaagttttaatagcttcattgtttgagtgaggctaataaatatccaccagcacaaggcagtgtctaggaaagccaaggggataaaggccaaggaagcnagatcagtcttgggccccagttactctgaggaccccttccatgcnnnaaaacaaatgtatttttnttcctgctactacaaccttatgaagagtgaatccaaggnggggctggacgatgcaaaacc

SEQ ID NO: 500009 - DNA, 274 bp, Homo sapiens
gagtaacatatgtgtagagatcgaagtgtgtgagatgagagatagggtgggaaaggtaagtggtgtatggcacattgtgagaatcggcgtagccagttaatagcccctctgatagtcatgttagcttgatcgaatgagttcaggcaaaagtctggccctccagcgtgaacaggtccacagaggagggaataaatgactaccatctcaaatctccaactaatatctcagaagtcagttctgaaactctaaggaggggggccacctcccctaacaa

SEQ ID NO: 500010 - DNA, 417 bp, Homo sapiens
tcagccggtccatacattgtctgatgacaagaagtgtcagatgccaagaaagaaagggtgcatgacgatagacttgggggggctcgagtagtggcttcctggaacgatgtgacattcagactgaatactggaacgatatgagtaagaggctaattcggaccaagtatgaaggagtatacagtaatcatgaaggaacagttagcgatacaaatgctcagaatgtgcaaaatcaaagctttggaatattttgagcgcaactgcaaaagcgaaacaacaaacaaatatgccatccctgtgacctagactaagtgcaccttggggtcatgatccttgaatggtgcttggcatgtatctacttcttcctgctatgttaagacttttgttactatgacattataagcgagccattggagtagc

SEQ ID NO: 500011 - DNA, 161 bp, Homo sapiens
  misc_feature (11)..(11): n is a, c, g, or t
  misc_feature (13)..(13): n is a, c, g, or t
  misc_feature (116)..(116): n is a, c, g, or t
  misc_feature (120)..(120): n is a, c, g, or t
tcacaggcganancctggaatgcaccggccagaggcatgctgctgctgctcacgcttgccctcctggggggccccacctgggcagggaagatgtatggccctggaggaggcaagtntttnagcaccactgaagactacgaccatgaaatcacagggctgcg

SEQ ID NO: 500012 - DNA, 981 bp, Homo sapiens
ggtgccatccagtctgcaggagtgagggagaccctcaagcgggacaggagtctacacagtcttcgcttctccatcaaattgatatgtcgcttcgcgacggccctggcaccagagaagaacggacgcagactcttgggagatggcatgggaacttgcgcagagcagtcctgaaatagccagcattaggtgatgaaatcctggttagcggaggcatcgtgggccctgtgtgcggtctagaagtcttctcctagagtgtgagcaagctgggaagtcaagcattgagagaagagcagatgtggtgatgtgtcaacaaaggagcctgttggccgagcctgacagtcagtggccacaaggtggcgtggtccatgtcatcaccaagtgttctgcagcctccagccaatcagacctcaggaaagaggggatgaacttggagactctgcgcttgagatcttcaaacaagcatcagcgttttccaggggcttcccagaggtctgtgcgactagcccctgtctgatcaaaagttattagagaggatgaagcattagcttgaagcactacaggaggaatgcgaccacggcagctctccgacaatttctctcagatttccacaggagactgtgagaatgttgtcaaaaccgaagtatcacacttgaatgtaacatggggccggaccataatcagattgtgagccttgtgcatgtggggcgaaggacgggaacaaacatgtccgtggaaatcatgttccccctaaaacatgggtgtcaacccaatgcattgcgaaaattgggattgtcctggcctgagattcacttcccagacagggacctatttccccaaatgtgtggcaatttgagctgggtaatgccaagttcccgggcaagggagcgcccaggattgtggggggccacataagagtggattaggcaaccaggctctggggagtcttggaccaacactggaaagcctgacacttgttaactg

SEQ ID NO: 500013 - DNA, 984 bp, Homo sapiens
  misc_feature (24)..(24): n is a, c, g, or t
  misc_feature (30)..(30): n is a, c, g, or t
  misc_feature (125)..(125): n is a, c, g, or t
  misc_feature (197)..(197): n is a, c, g, or t
  misc_feature (301)..(301): n is a, c, g, or t
  misc_feature (303)..(303): n is a, c, g, or t
  misc_feature (307)..(307): n is a, c, g, or t
  misc_feature (320)..(320): n is a, c, g, or t
  misc_feature (400)..(400): n is a, c, g, or t
  misc_feature (405)..(405): n is a, c, g, or t
  misc_feature (427)..(427): n is a, c, g, or t
  misc_feature (441)..(441): n is a, c, g, or t
ggttgcggggaggcccgggtggtncccggngctcggtcccagtctcctgggcttctccagtccttcagcgccgtctccggtcacagggaatgaaagcgaggaagaaggaaacggtgtcgagaatngcgaagagagaaagcatagaaaacccacattagaggcactcccagagcagaaacccttcggagcatcccganttcctcggcccgcgtgcaatccaggcaaaattgaggttgtctctgagccgccctccctaagcaggtcggaaagcccccgaatcatcccaggtcccgccggctgnantcgnaacctgggtgganggtccctctagtggttggcaccaaacaaaagttctgtcttatgaagagccgaggtcaggaagcatttccctgtgcccagngccanggtctgggaccttaggtccaanaaaagcgttggcantgtctgaccacaggaatgggttctcgaactggggaggactgaagctggagatctggtccagcccctacctccagcgtgtggcctgaacccgttttggttgtactgctatgttgtggccctgcccaggcctccaaggactggctgctgttaagctgtttaaaatccctgtaggcctcagatggcagcgacaccagggactcggcatagtccccagctctggcaggagtcaccacagccctagcctttagttctctacaggctggagtgtcgacaaactccacaggacacaactttttcaaaccaatttaccctcgcggtctgaaatgaccagtaggcccaggagattttccctgtgacaggaacctaaccacctggcaatatgagaagtgtggccctgccgggacctggcccagcggcgaccgagcccagccgccggggaaggtgggcccccacgactgtgttcccaggcaccctcagtcctttactgcttaatagccccacgccttgtgcgccgcggcgcgtccccggctgggttcggatccc

SEQ ID NO: 500014 - DNA, 332 bp, Homo sapiens
ttttttttggatatggagtctcactctgttgcccaggctggagtgctgtggtacgatttcagctcaatgcaagctctgcctcctgggtttaagcaattctcctgcgtcagctccccagtaggtgggactacgggtgtgcaacacaacatccggctaatttttgtatttttcgtagagacagggtttcacatgttggccaggctggtcttaaactcctgacctcagttgatccacctgcctgggcctcccaaagtgctgggattacaggcataagccactgtgcccaagctgaattgttgctgttttttattgttagttaagagaggtcgacg

SEQ ID NO: 500015 - DNA, 216 bp, Homo sapiens
actcgtagtcgcgcagttcttcaggcttaaaccataagctgattgcttattcagcgacttgtgactgaatcattgccatgaatgatgttcctgcctacctgaatgcagaattcccacgaatggtgcctggctttgaatctgttggcttggtctcccaaagcatcactcggcctggtggtattagcctcggtggtatagagtgatagggtggtatag

SEQ ID NO: 500016 - DNA, 153 bp, Homo sapiens
ggctctccctacacccaccttctttttcagcttgtcgcgcgcttggcggccctggcgctgttggggactttgggctccgtgctgttgatgaattccagcagctcatccacatctcggtggtccgcaccccccagggatcccgcccaggtcccc

SEQ ID NO: 500017 - DNA, 400 bp, Homo sapiens
ccttcttgcagctcacgatcaggaagtagattcattggtgagtatatgatgtggggcaggtcagtggaagtcctctatgcgtgctcgcactgctatgtcgttctcagcagcggcgatgcactggcgcatgttcacttaaccccgatcgtcatttggaatgacctgcttttcagccaccatgtcttcaaattcatcagcattgaacttggtgaagccccacttctttgagatgtggatcttctggcggccaggaaacttgaacttggccctgcgcagggcctcaatcacatgctccttgttctgcagcttggtgcggatggacatgataacttggccaatgtgaaccctggccacagtgccctggggctttccaaaggcacctcgcatgcctgtttggagc

SEQ ID NO: 500018 - DNA, 789 bp, Homo sapiens
gaaagagccggcggagcctggagcaccgctcccggagacgccgcctcgcgatccccgcgcgggcgggacctgggcggccggcatcaatagaccctagtaatcacttcgggaactgcttcgctactatgcctactataccccatactatacatacacctacaagtgcagcggcctagtaccgagtacaacgcctatctaggaaatgcgtccaggctggagtacaccgtacctacttatgtaccaactactagcaagatgctagtatctatggccactttctttcccacctgggaagtgcggcatactatgacttacatatgggtgagttcatagaagtgccagcgtggatagtaggcagacctgatagtgtcaaaaccttgtcatgtacccggaatgccggcaagggagagtacaagatacatggttgctgccctgggctgggccactgctgagcttattatgtcccgctgcataacccctatagggtcggagcccggggcatatgagtttgactggaagtacatccagatgagcatagactccaacatcagtctggtccattacatcgtcgcgtctgctcaggtctggattgataaacacgctatgatctgtaccacagcttccggcagcctgtcctcctgctgatgttcctcagtgtctaccaggcctttgttatggagaccttcgtccacctctgctcgctgggcacttggccgctctactggcccgcgcagtgtaacggggctgtggcctcagccttggcctttttcccttgtcatgcctctagca

SEQ ID NO: 500019 - DNA, 169 bp, Homo sapiens
aagaagaaggagagacagcctcagaagagacggaagaaatagccgtggagggtgcggaaggggaagccgaggaggaggaagaaactgcagaaggagaagaagagcctggagaagacgaatatacctaggcctttccatgcgttcatttctgacactgtatgcagaaaat

SEQ ID NO: 500020 - DNA, 871 bp, Homo sapiens
caccagtaagcttcaagctgcttcctttcttgaaaactaaacgtttaacgtataatgtctgtttggatactgtccaaatagtagatgcatgtggataatgttgcattagagcactttgcagttgcataattcattaatgttttgtgatgacttgcatttgtgagttattggttgatcagactgaattttgtctagtatcacattgtgcatccttgcctagatgtcgatgactgcaagtaagtaatacagtgtataatgaaactatctacagagttcttgtgtttgtagcacatctgttatccgtagaacatctgtaatagctttctaaatccagtttatttgagagttataggagttagcgaatcactaatttgtagttgctgaggttggattgtagtgattgattaagctacttctgtcagtctttgaaagatgtaacgtattttttgtgcgtgaagatctctgaagaattgcttttataatagaatgggcatgtattgtagcagtgtttatgtcacatgatctgtgctgtagaaaagattatgccttgttcacaagaatggtgagtggcctttctagggtagaatgacctgtcagtataagtcttcggctcttaccttctgttctgaattcatctcttagtataggcgataacttcccggaaaaaacgcggaaggccatggtttctccaaactcctctacgggccggttgggctcacattggcttggggtttacccaattaatttgtgtgcggctccagccaagtgcgccggggccacgcggtgctcaccaaaacccctggccacatatagctgcccccaacgcaaacagtcatcatataaccccgtgtacaaattttaacagtagcgc

SEQ ID NO: 500021 - DNA, 140 bp, Homo sapiens
tataggcgctagtgcatacagtgctctacccccacatatcttctattaaggctgcacctaaatgcatttcggagagaacgagctatctccgtagttcgattggcttttgcacccctaagacctatctcatctccccaact

SEQ ID NO: 500022 - DNA, 797 bp, Homo sapiens
  misc_feature (32)..(32): n is a, c, g, or t
  misc_feature (39)..(39): n is a, c, g, or t
  misc_feature (73)..(73): n is a, c, g, or t
  misc_feature (287)..(287): n is a, c, g, or t
  misc_feature (299)..(299): n is a, c, g, or t
  misc_feature (327)..(327): n is a, c, g, or t
  misc_feature (371)..(372): n is a, c, g, or t
  misc_feature (375)..(375): n is a, c, g, or t
  misc_feature (377)..(377): n is a, c, g, or t
  misc_feature (380)..(380): n is a, c, g, or t
  misc_feature (392)..(392): n is a, c, g, or t
  misc_feature (395)..(395): n is a, c, g, or t
  misc_feature (399)..(399): n is a, c, g, or t
  misc_feature (402)..(402): n is a, c, g, or t
  misc_feature (408)..(408): n is a, c, g, or t
  misc_feature (410)..(410): n is a, c, g, or t
  misc_feature (430)..(430): n is a, c, g, or t
  misc_feature (445)..(445): n is a, c, g, or t
  misc_feature (462)..(462): n is a, c, g, or t
  misc_feature (520)..(520): n is a, c, g, or t
  misc_feature (522)..(522): n is a, c, g, or t
  misc_feature (531)..(531): n is a, c, g, or t
  misc_feature (539)..(539): n is a, c, g, or t
  misc_feature (580)..(580): n is a, c, g, or t
  misc_feature (584)..(584): n is a, c, g, or t
  misc_feature (699)..(699): n is a, c, g, or t
  misc_feature (703)..(703): n is a, c, g, or t
  misc_feature (737)..(737): n is a, c, g, or t
  misc_feature (754)..(754): n is a, c, g, or t
acctagaaacagaatacaggacgaatagctanaatgaanaagcaatacaatttgtatttgggatgcaattgtnttgtaaagtttcaaataatcaatttataaatttgttgcttttacttttacaaaaatattcatttaacccataacatgagttgcaaaattatctccagacttctacagatgattataaactgtaattgtgtttcagttacacagcaggtgaaaaatttaactgaaccgttacttcaaaatacaatgcattaaaaataattgttacaatataggcnccaataaaaagnattttcttggcatacaacaccacaacanctttctcaagtatctgtattatgtaaattaaaaagagggtgtcnngcncnccntggctgggggcngtnttcnttncagggngngtatctttcttttaaaattngacaaatactcaganttttttaaaagactttngtgcaaaaaccaaactgtgcagatccaaacaattaaacattagctatcaaaactaaanancaaaaaatnctacaacnactgaaatacagccccagttcagaacttaggcaggcaaaanatangtactgggcttaaaagaaaaaggcaacacccacataaaagtaccaaaaaaaaaagtgaaaaataactgtgcaatctaaattaacctttgtgtggacagaaaacaacctggactanggtnattttcatatgaactagaaaatgctcacttaaanatccttttaaaaacaanaaactgatgcttattagtgataattatgaagaacaaaaatata

SEQ ID NO: 500023 - DNA, 174 bp, Homo sapiens
cttaagtagcaggaaagcttatcagctgaattgtatttaacaaaatagttaactagcaacctcaaacagacaccatggtgcatctaaatcctgaggagaagtctgccgttactgaccctgtgggcaagggtgaaacgatggatgaaagttggtggtgaggaccctgggcaggct

SEQ ID NO: 500024 - DNA, 122 bp, Homo sapiens
tataggaccttacatatgttactttgtatgtatgtgttattatgtgctatgcatatgtgagaaataggtctggaatgacacacaagtcatggtaggatacctctgcgggttagggcaagtga

SEQ ID NO: 500025 - DNA, 683 bp, Homo sapiens
cgcctgtaattccagcgctttgggaggccgagacgggtggatcacttgaggtcaggagttcaagacagcctggccaacatggtgaaacctcatctctactaaaaatacaaaaaaaaaaaaaaaaatcagctgagtggtgggcgggcaggcgccggtaacccccagctactcaggaggctagaggcgggacaaatcgttagaacacaaggaggtggcgaggtagacacaaagagctggagatcacgccactgcctcccagcctggggcgaaaagaagtgagtgagacccccgaatcaacacaagaaccaaaacacacaacaaaaccagaactaatacacagaaaaaacaaacaacacaacaacaccaacacaacggcgtgggcgacaccacagcaccaaaaaacaattaacaaaccagacaagcagaggagagagacacaaacgagaagtacaacagacacaaaaggaaccacacgagagcaagcaggacaaaaaaaagaggaacaacaaaccgaaaaaaaaaggcgcgggcggacacgatcgccacaaaaaaccaagagagctagaggacaacaggggcaaacaaaggcgaacacagcaagtaaaaatcaaaaccagcgagaaaatacaaaaagccgagacaacgacgagacaagaaacaaaaaggaagcagaaagaagaacg

SEQ ID NO: 500026 - DNA, 139 bp, Homo sapiens
aagtgaagtacctggttagtaagggactaccttttaaacgttctgttgatattggacaatgctcctggctcacccagagactctatgagttaacaccaactggtgttcgatgatggtctagcttgcaccccaaggcaca

SEQ ID NO: 500027 - DNA, 780 bp, Homo sapiens
gcaccgatcaataatcagggcatcccccagatggccaggccgcgtttcgttggggcaggaggggcagacgctcgtcctccagtgtcagccatttgtattcgtccgtgcctcccattctggttcaattgctctcgggcagaaacttgtgttggccacccactgcccgttgcccagacccatgggctctgggagtggacttcccttgggcgccccagcccttggcccagcccggaaaggcaacctttctgccatgtgtctctgccttgggacacaacaccccggggtgtttttcccgcgcgcatcccctgagtggggtcgccccctctgtctccccactgtcgagagggcgccacccccactctcagcactccaccggcactggccttgccgtgtccccaggcgtaattatactattaacccctatgctgtgacaccagtttgccagtctccagcgtgttggtgaacccgcctcccggcgtcggggagggcccccgggcgtgggaacgccctgtgcccctctctgcgcgcgaagcccacgccccctttgtccttccctggccctgctgcgcgagcccggaggctgcgcccgcctgtgggcggtctggctccttctcctcccttctgctccttttttatattagtgattttataaagggaatttttcaaggacttgtttaatggttttgggggtccccaggcacttaagcttggggttgggaggtcccctgtttcaaatagaggcacccccaataatataaggccccccatttgtcctttgga

SEQ ID NO: 500028 - DNA, 901 bp, Homo sapiens
ggatgcctttcagctcgtgtgcaaaccacaagcttctcctgacaggtggaatttcctcaggactgtccgtctcaggtgcgtccatgtctgtctgcacctggatggcatcgcctctccatctcgaggacgccattctgagggggccagggcagggtggctgatcccctgcaggcccagccctgtgactcagccacacaaagcccaatctccagcccaaggaaaccaaggggtatcttcttcatcatccttccagtcctcttccccttcgcgggctccagcctcagtttggcctcacctccatctctccccttcttaacccttgcccccattccaattcatctccctccctcaaccttaagggcacctctggcattgctccttaatgctgacgtgattttctacaatctctacatcagccaagagatctcatcacctaaaaacacgtgatgtgacccttaagatcacaatatgtcattatgggggtgaaaggtgggggtgggaaggcactaaagggcaggccatgcaaggtggttcaagccccaggtgtgacaatagatgggggtccagggtccagaagaagaacccttaaaacaattaaagcaattgataagccggaaaacaacaaacaaaaccacagcaacaacaaattgtgcggcgcgcctgcggcccagcaaaaatatcaagccatcgttggggcgcgacagatggagtgaatgggcacgactggcccaggaacccgctagacaggtggtgttccccaaaaagcggggaccgctcgacacaccatgggtgggtcacggattcacgggcaggcgtgacccgcgaggcgagagacgcacagagacacaaacacagaagcagcgacacaccaacacacacaggacacacgacggacgacgca

SEQ ID NO: 500029 - DNA, 439 bp, Homo sapiens
  misc_feature (351)..(351): n is a, c, g, or t
  misc_feature (411)..(411): n is a, c, g, or t
gagacggagtctcgctctgtcgcctaggctggagtggagtggcacgatctcggctcactgcaatcttaacctcccaggttcaagcgattctcctgcttcagcctccccagtagctgggattacagacgtccgccatgacgcctggtaatttttgtatttttagtagagacgggggtttcaccacgttagtcaggctggtctcgaactcctgacctcaggtgattcgcccaccttggcctccaaaagtgctgggattacaggcatgagccacagtgcccagtcagcaatttttatattgatcagaactcttaccaccaccctttgttgactgcatgtgttacaaatatcttntcccactttgcaacttgttcttgtactttcaaaatatatcttttgcggaatgtcctattnttagtacagtagaatttgccagcctttc

SEQ ID NO: 500030 - DNA, 205 bp, Homo sapiens
ggctggtcacatgattgctcacgctcccttatttttttttttagtcttttcaactttccatggaagttggttgtaccttgtaaactatgtttttaaaattaaaaattaagataaagtgtagtccccgtcccgttacaaagtgccaaaacttctaatgtgttgggttcgccttttttttgtccttccttttcatttggtaaacctt

SEQ ID NO: 500031 - DNA, 368 bp, Homo sapiens
ctgaagccacccataatcctctctatttctgataatgaattatcagatcttcaaccaaaacctaatattagataaagggaacctgagtgaacaaataacacaacagttacctacttatttatttgatttcataaactaagttatgcaacacccaatgccctgtgtgaaaaagtaattgcacccttacactcaataactggttgtgccacctttagctgcaatgactccaaccaaacacttcctgtagttgttgatcagtctctcacgtcgctgtggaggaattttggctcaatcctccatgcaaaactgctttaattcagtgacatttgtgggttttcaagcacgaactgctcgtttcaagtcctgcc

SEQ ID NO: 500032 - DNA, 103 bp, Homo sapiens
tgcggtcacgttgggttggtcaagataaaaactaagttgagagatgaatgcgaaggaaacaaatcttttccaaagtccatgtcccaacggtgaccggcgactt

SEQ ID NO: 500033 - DNA, 727 bp, Homo sapiens
ggctcagcgtgccaggacccctccactgtcccggaggaaagctgtagacatgcggctgcgagatggagttgggtgctccatgaagagatggggcaggtgcccccacttgactctcgccccagactccccagccctctacttcacccacgatgccagcctggttcacataagtctccagtaccccttcggagcagtagcagctcagaagttcatgcctggccctactcctatgttgtgccatcagttggtcacctagactagcgtacgatgatcatgtggctccaggaagcctggttggctattgacaacaaaatcgagcatagcctatggacttggtgaagtcccacctccatgtttgcggtccgggcaggaggtggcaggctgctgaacggagcagtatccggtgcaattcgcggccgtgagtcgtgatacgctgcgctgtgcagcaggagaactggtgctgctgctgcgccctggctctatgccctggagcagctggctcagctgccctcctcgtggggtcccacggcttgggcccccctgcgcccaatgggccctccgtctgagcctcccttcgcttacaatgtgcctttggggctgctccggccttgcgtcagtctgctgtccctcttcctatgcagctttaatgtccccgtgtcccggagatgggagttcaaggctcagtaatggctgggtccccgagccctgccaatctcctcatgaatgc

SEQ ID NO: 500034 - DNA, 1570 bp, Homo sapiens
  misc_feature (258)..(258): n is a, c, g, or t
  misc_feature (727)..(727): n is a, c, g, or t
  misc_feature (1157)..(1157): n is a, c, g, or t
  misc_feature (1570)..(1570): n is a, c, g, or t
tggaaactttaaaatccctcaaaaacggtttattatacaagtgagtttggagtcacgaggggcttatcggtaggatttctggttagcgagcgcgggcaccagggccctccaaacttttgggacctcgcagcgacgagggctcagcttaccagcagggctccggctcatacgtggagtgaggagtgtcttgtgactctcctttctgtggaagcctacattccacaaatatttctcgtggataatatagcgccaccaagnggcttgtgtgggaaagtggcactgtgacgggatatagcatataaatctctgtggcgccacgggtgaaccaccaacccctttatacacgggcaccacgggatgtgttctataccaccaagaacaaatctcgccctccttgggcgcgagagaagagccagaaaagcgtgtggctctcccgagcgcgagccgtgtggtacgtggatagcgcggtggcggcggatctcaaatctcactctctccgaggggggccgcgccgcgtgtatcaaccgtgtgtagtgcagacaccattgtggcccggcgttatggggccaggtggcgcccaacgaggcgtgagtgcggcgtgggtactatcatgagggcgttcccgaaaagaaaccgtggcacagaagtgtggccagcgcggggcccctgtggacagcggcaagtgggcccccgaagcgcggtggaaactagaaacacaccctccagnctgggtatcacccgagggggggcgggcggcgagggggctactataacagcccgaatgtgtggcacacgaaagaagcgcgcctacaggggaccgtgggagggtcccctcgaggggaaatggaccccggatgtgggggcgaaccaccgaggcaaggcaaacccaagggcggggtgggtcaaagaaaaacccccaagaaacactaccaaagggcctcctgttgggggaacaggtgtggaggccacgcggcatgcaatgcgtcgccacgggaatcccaaggcgcacccttttctccccttggcgagggactcaccctttggggcccgctgaaagggggaacaaacgtcattggccccaagttaaccttggcccctcaacaacgtgcccggggcggggaaatgcccggcaaagacgccttccccgcaaaaaggcnccaacggggcccccatgtgtgggggaggggcgcaactacatataaccccgagtgtagtggatgtccaggggcggcacacaaagcggaagaaaacgacactatgcaacggtggcgccacggacaagcacgacccggcggaaaaaaaaaaccgggtctcagggggagaaaccctcggcagggcgtgggtgaagccccacaccaacacagggccccgcgcgggagagaccccacccgcatgtggggccggccgcggtgtgacaaacgcgtgagaggtacccccccggaggaagaacaccgtattgtcagcacccagaggcgccgacaaacacgaggggcagcagagaggcggccaactaaaaaagcagagcacgtcatcgacaagatgccaacatactatgcagacggaaataatn

SEQ ID NO: 500035 - DNA, 844 bp, Homo sapiens
actaatcgactgatctcacttcccttccgctccaagcaccagcttccggtggtactggcgggaataccagtgaaatagttttggttctccctgaagcatctgcatattgaatagaacgctttccccactgtgtgtcttctaccccctcctcccaggtaaaaacgagtcccggctgtgggctgctgatggcatcgcgttcattgtacatcccaggcactttcgggagagccgtagggtgtgtgccggattcaccctgtaggtcgaggagttctgatgaccatgcgctggccaagcactggctgtgaaaccccgctctctatctaaaatatacaacagaagaagatttagccgtggcttagttgtgcaacctgtggatcccagtctacttgggagagctgaagtgccacgtgagaatctgccttgaagcctgggagaagctaaggcaggagaatcgacctgacacctggagagcgcagtatggtatgcagatgacgtcccagatcggcgaccattgctactcatagccatggtagcaacaacactgcatggacgtcctgatcccatacaacagaaaagtgctacacaacatacatttggacaggagtactcattcatgaatcggcgcgagcaggaaagaaagggacgggatgacaatgagagttgtggccctggtggtgcataaagcgttggttttccttgaccccctggtattcctctgacgttaccaaagtgtgtcaatgaaactcgagccaggaacaccaccctgaatacggtaagcgctaagataatattcagagtacacaccaagcggtaaccccgtgcttatcgactatctaataagaat

SEQ ID NO: 500036 - DNA, 1200 bp, Homo sapiens
gcagtgtacaaggtgtcacgagtagtgcacggcgcttctgctgttccggtcattgctgatggaggaatccaacatgtgggtcatacttgcgaaagcctatggaccttggtgcctccacaggtcactgatggggctctctcctgaggcatgaccatcagatgagagccccctggtgaatagcattctttgccgactgggattccggtctaaatgaatctatcgcggtccatgggttctctcgtgtgccattggacaatgcagcctcagtgagtccagaacagattattatcacgtgaaagctgacatataatcaaaggtggcccaggtagtgtctggtgctgtgcacgtgacaatagggtcagatccatcaacactttgtccccttagcgtgattgcgtgtccatccaatgacctcatgccagagacgattggtcgccaatgagcgtttgaccacatagtccagagccaatgatgtactctcgtgggacgcgttaaggtttgacgacatgagaacgtcctcagcccaggtggaaagggtggcggtctcaataggctctccaattcgtatgatgaagcggcttctgcgtgaaacaggggatccagcaatcatcatcctcgggatgttgcttacaatttgactgttttagacaagagcgtcaataacatctgattccaggacagcatttggcacatagacactagaagaaggcttgccacatctaatcggatcctctccaatgatgtcttcgacagaaaaaacgtaagaaactgcgtgatagacagccccaaaggtttggaatacggggaaaatgcctcaattgggaggccttcgactggatcgaaatcggcaagacagtcctcgggcatgaaggccactgggcgaacgacgaaccaaggagatggcttaacgtgggtttgacacccgaatgcttgattggggaaaaacaatgagcaacacaccagacccactgatgacccccaaagaaacttctctgggtttacaaaaggggttccagcaacacgtgcgcaaccatcaacttcggggacagaagtgacaccacacatggcgccatacatctgtgttgcacaaacgacagacacacaccggcaagcgatcaacagaagacaacccagcgcgagggtacacataagaaataaccagagagagggcggaaactccacaacaaaggacaaacgaga

SEQ ID NO: 500037 - DNA, 691 bp, Homo sapiens
ctacacaagagatattgattaatggtcggttgaatttacagttttaacatagcaaaccaagatgaattaccacttgggcagaaagcacatcattctacattataacccactggtttctgctaacacattggaaaagctagtggtgcgggatgttagggatcatctcaaaagatccaagctacttctttctttgctcctaagtacctaatcctctgcttactgccagactttgagctaatcaccaggagacaagaggacaataaggggggtgggggcgggggtagcgtttaaaagatatcacaggaaaatgtgggtctagtgacgattaccccaggactaagcgctgtgaagctcatccctgactagggtacagtgcaaatccctggatagtgctccttgccacctgcgcgtgaatcaaatacaaggccatgccggcatgcggaacaacacaaaattcacttagaattgagggggtattggataacactctagtgttgagggacaccgaagaacggtgctctataataaatttaagaccggacagggtagtgagactaggctaaactttgacttgggcggaagccccccgggattcaaaccccaaacgggaagctaaggcggtttgccagtggtttgcccttaacagaagggacccggagccaaattggagccttctggaaccgcgttttag

SEQ ID NO: 500038 - DNA, 111 bp, Homo sapiens
agagaactctgttgaagtactcggcaatttacctccgtaacttcgggataaggaggcctttcgtcggcgcaagccgtcgagaggggcacagaccagggggtggtatcaggt

SEQ ID NO: 500039 - DNA, 407 bp, Homo sapiens
  misc_feature (48)..(48): n is a, c, g, or t
  misc_feature (58)..(58): n is a, c, g, or t
  misc_feature (79)..(79): n is a, c, g, or t
  misc_feature (81)..(81): n is a, c, g, or t
  misc_feature (84)..(84): n is a, c, g, or t
  misc_feature (196)..(196): n is a, c, g, or t
  misc_feature (214)..(214): n is a, c, g, or t
  misc_feature (258)..(258): n is a, c, g, or t
  misc_feature (264)..(264): n is a, c, g, or t
gacacctctagggctaggggcataaaagtgtcagtgccatcctccccngcctgtgttngggtctgcccatgcgccagcncngcntgtagctcagcatatcagagagtcaggcaagaacctagtgagccgcgatctctacttaagactcaatataagtggattagtggaaaagataacatttcccaccattacaacngggcctgaagccataatngattcttattacctccctcctttatcaaccatattatagttccngccccnagagccaacctttacgggtcgaagatgcttacctagggggaaaacagactttcacttccaagaggtcagatcccttagctgacttacccggatagagagctgcgatggctgcaagtgcccacggagggttatgccggggtagg

SEQ ID NO: 500040 - DNA, 300 bp, Homo sapiens
ttagtcgggcgcggtggggggcacctgtagtcccagctactcgggaggctgaggcaggagaatggtgtgaacccgggaagcggaggttgaagtgagccgagattgcgccactgcagtccgcagtccggcctgggcgacagagcgagactccgtctcaaaaaaaaaaaaaaaaaaaagatccatgcatggtgcatcagcagcccgtggcctctggccaggcatggcgaggctgaggtgggaggatggtttgagctcaggcacttgaggctgtcgtgagctatgattatgccactgctttcc

SEQ ID NO: 500041 - DNA, 818 bp, Homo sapiens
tctttaaaatgaaacggacctcattgtgttgcccaggctggattgcgtggtgcaatctcagctcactcaaacctctggccacccggggttcaaagcgattctcctggcctcagttcctggagtacgctggggattacagggcacctgccaccggtgcccgggctaattttggtattttaagtgggaagataggtttcaccatcttgccaaggctgggtcttgaacctcttgaccttgtgatccaacccgccttgcggccttcccaaaaaggtgcgtggggaattcacgagcgctatgagccaaccacaaccgcgcgcttcgtgctttgtggtttttctaaacaacaaaagagaaatgtgccaagaagcagggcagggaaggcaagcctcctgtgaaccaattaaaagcggtgatttctggaaattttttttctctttttatttttctggagaaaaagggagctcttggcctcttgtcttccaaagaggctgggaatgtcgcaaagtgggctatgggtctgtcaaagctcaattggcggagccttacgggatacccccggtgggttttcaaggtttgaatttgtgctccctgtgcctttgggcgcccgggtagtagatagtatacgctatagagagatttataacgtgggcgacaccccgggcccgacagaaaggggccccacacgctataaatctttcggcgagaattctcctcagcacggcctcgaacacaccaggccgggttctcgagaactaattgtttggagaaaaacgcgcctggggtctctttaaaaaccttccggtagaactttctacagg

SEQ ID NO: 500042 - DNA, 124 bp, Homo sapiens
  misc_feature (83)..(83): n is a, c, g, or t
gtaccgacgacatggcgactcccaaagtgctgggattacaggttagccaccatccctggctgagccacgatgcctgactgttngtgaactattttaacattagtttgctttttttttttgagat

SEQ ID NO: 500043 - DNA, 529 bp, Homo sapiens
gaagaaaatatatgaacagtggattgtctgtatggtcggagtatggatgacctttccctcatgtgttttctgaattttctacaatgaaatttgtgttgtataacccagaaatatttgtgaaagtgcatgctagcagtagcatggaaggtggattggtgaagggtgataaccctgtggtaggagacccgttaggaagcttttgagagtaaaagtgtttatgaagcacctgctctggtctaggcaccctgccaagtacttaatagtcaccacctcacttaatcctcatagcagctctatgaggtaaatactgtcagtggctccattttagccatgaggaaacagattaagtaatttaccaaggtcatacaaactagtgaaagtgagatttgaacctaggcagttggactcttaaccaccatgtcatattgtgattgaaattggtcagttgggaaacaagtcctcactaaaacaatggtagtagaatgaagagaaccaacgaagagatttgctctgaaacagcttctggagg

SEQ ID NO: 500044 - DNA, 645 bp, Homo sapiens
ggccattatggccggggcaacacttatgacgccttttattttggctcattcacactgaacaagcttaacgtttctcatgaatgcgttgcacaatatcaccccaaattctgtcacatgctggatcgttcgctagccagtgtactggcttggccaccaaaagagtacgcctgatattgatgcacctggaagatgggtgtgctagtttgtggatacactgtaggcattgtcacatggacatatgcttcactacaagcaggtatagaatggaccatgaaccccgaagacgtattcaccgccgctgtaggggaggaatgagtaccatctctaatgtggccattgccatttgaaggtagatcagcttagtgtttttacccctagaagccactgtgctcgcatgagagaatgaatcaccagcagatgtctagtgcgctggcatgccctggtgcaaaaggattggcccccattatggcgcttctgactaatcttgccaagatagacaaactctgatgaaactcagactgagcttgctactcatgttgatttatgcatcacaaccctgggtattggaaattccacataacgggaaaccatttatcacaaagacccttggaaaaactctttatactctaaagtgatacccataac

SEQ ID NO: 500045 - DNA, 249 bp, Homo sapiens
tggggttaatccggccacattaaaggggggggagggggggacctatcctaaggccattttactgttaaaaaaagttccctagccatgaagccctgctgctgatttagacagggttttagggccattatttggaccccttatccttccaagcactttgggaacttaagccgtttttacgtgcccaccaccccctaagggggctctgctacggcctttagctaaagggaagacacattcatccttctccct

SEQ ID NO: 500046 - DNA, 1651 bp, Homo sapiens
  misc_feature (1)..(2): n is a, c, g, or t
  misc_feature (957)..(957): n is a, c, g, or t
nnagctttgcgtgcgcttcctcctccttctgttgttcaacgatgtgtttcttttgttctcgctccggcgtgttgtattttattttccccccgtccgtgatgtttctttgcttgtggggtgtattttagctcgcgtgttgtgtttccctcgtgtcctttattattgtggttgtggttcgtttactttattctatcagcttgcggtgttcctctctgttctgtgtatgcttctgcgttcgtggtgtagtttgcttcggtcttgcttgctcttctgtctttttatttggtgcggtgtctgcttttgttagtttgtgcttatcttctctatatgtgttcttcttgtgtatatattctttttcttcttctgatggtggcttgtcagttgttggtaatttgttttttatattgtatggtgttttcgtgtaggtcagttattatatttttctggctgtctcttccctgtcttgtatattcctctcttcgcttcgcattattgtcttgtggctctgtgttcgctctctcctttcttttttgttctgttgcgtgtgctgttcttttttttctcctctgttttgtctgttgtcgctccggcctgtgttactctcctccggttggtgatatctttatttttttctgtctctcttcttctcttgtgtgtgtttatttcttcttcgttggctcttcttctttgttttgtactcggctggcttcgtcgtgttggttttctcctatctttcttcctctctctttttgtttgcttctttttctctcttatgtgttttcggggggttttcttgtctgccctctcttgttttttttttttttttttttttctccactacattggtgggtgcgtcttctctttctgtggtgtttatgtttctactttttgtctgctctatgatgtgatgtttttctttctttgtggtgtgtttgtgttcttctgcttgtgttcttntttctgtctcgtctccttcgctcttcgcttagtataatgttgtgttgtgagcatcatctgttgttttcttttgtcgactatcattcctcgactagtagtgtccgtctttataaatcagcacagatgtttgttgattactttatataaagtacgtgtctgtatgagaatatatgattcgccctctctgtacacatgtgtgttctctgcggcttataaatgtgtccactggagtttctttttcttggccccgttttctgcttcatcgagtggttatcttgtgtgcgctttgctgggtagtcgccttttgggtttctttgtgcgactggagccttgtagttgacccgcctcttatttgctctgttgttagggtgctgtgtccttgttctgtacttctgtaagtacagaggtgatactattagggtgtttatgttttgtttttttttgttttgttcttgttaagaaaaataacttactttaatttgattgtaagtttatttgattaggttgttttttgaacaaatgaagatgtgtcagctttctcaaccttctgccctaccaaggactgtggacccagactggccttgagccacagtcccatctattcccgtccatcaccctcttccccctgacgggctcgctcgtggtctgtccattctgttactgtgctgtgactggttattgcgcgcgagttggc

SEQ ID NO: 500047 - DNA, 284 bp, Homo sapiens
gcctatggttagccagcaaacatagagacccaagcagctgtgtagagtcatggattttgcagtcccgtccaacgcattaccacggcagcaaatctggtaagtaagcagatagctggcaatcagtatgtatccataagcatcacagaattctgagtggaaattaaggtcggcggtaaggtaaaagcacaggcctcctgtgagtatggctggtggtgcataaggcctctcccccagaaaaggtgtattgagcagtgatatggtacctgtgattgccggttccttta

SEQ ID NO: 500048 - DNA, 660 bp, Homo sapiens
tggttggaagttttgcatttccataatgactaatgatattgagaatctttgcacgtgtttgcttccccttccaccatgattgtaagtttcctgaggcctccccagctgtgctgaactgggagtcaattaaacctctattctttataaattacccagtcctgggtatgtctttgttagcagcatgagaacagactaatacagatagatatacagttcaattaaacagattagagtccagaaatagactcacataaatataaccaactgacttgttgcaaagatgcaaagtaattttacagaggaaaggcagtctttccaacaaatggtgctgggcaagacgggacatgcgtatgaaaacataaatgcccacccatagaaatactaacttcacaattactagactcacgtgtaacatttaatctatgaaaatttctttaccaacattgggaacaataatttcgtgtgacacttgagacttagatacaacatcaacacgcaatattcactacacacggccaccgaatcactaactggactttgttataattttcacaaaatccgtccgaacagaatacaaagacagccacaggctgctacagagctattctgcaaaattacatttctgacaaaggactctagacatgtaatgagctcttaatc

SEQ ID NO: 500049 - DNA, 335 bp, Homo sapiens
  misc_feature (14)..(14): n is a, c, g, or t
  misc_feature (52)..(52): n is a, c, g, or t
  misc_feature (65)..(66): n is a, c, g, or t
  misc_feature (80)..(80): n is a, c, g, or t
  misc_feature (117)..(117): n is a, c, g, or t
  misc_feature (130)..(130): n is a, c, g, or t
  misc_feature (303)..(303): n is a, c, g, or t
acggccaaggcgcntgcgtacgtgccgccgctgcttcttagtgccgcgttcncgcctgggttgtnncggcgccgcccganggaagccactgcaaccaggaccggagtggaggcggcnacatgaagcggcnaggccgctccatagcgcacgtcgggacggtccgggcggggcggggggaaggaaaatgcaacatggcagcagcaatggaaacagaacagctgggtgttgagatatttgaaacttgcggacctgtgaggagaatattgaatcacaggaatcggcctaaaattggagcctttttantgttgagccggtattccttggagtcagcttaa

SEQ ID NO: 500050 - DNA, 214 bp, Homo sapiens
gtgcaagaggaacaaagggactcctgcagcatccggctgacctggcccttgtcatattaatcttccattccttagcctggcttcttcactctgttccggggcctgggtgggtgcttgattgcccacagatgcctgctttgtctatatctaccagtatgagcatactgcggaccctgtgactacctaggcagactggaatccaggacctacagcc

SEQ ID NO: 500051 - DNA, 130 bp, Homo sapiens
  misc_feature (40)..(40): n is a, c, g, or t
  misc_feature (87)..(87): n is a, c, g, or t
tgatctgtgttgtgtggtgatagccccagcaggctgactnttgtccacccaccacagacggcttctgcattccgacctcggtgagtnctcaccccactcagcccacacactctgccttggttccctttca

SEQ ID NO: 500052 - DNA, 741 bp, Homo sapiens
agactcgagcctgctgttcaccggtcctagcatttgctctcgccgatggctctcatctgatgctgacgtgcaacagcagataaagcatatatggctttcattgaacaagaagccaatgaggaaagcagtaagaaatagcatgcaaaggcagaagcaatgagtttcaacagtagagaagaggctcggctctgtgcaatgcccaaaagactaaagtagttatggaatattatgagaagacagagcaaagcagctttgagacagtcacgaacgaaaattcagcatgtccatagtttgactgacatcaagcgagatctcatagtcctcagagcaacgcagatgacctttatcacagacctactaaatgaagcaaaactagtagaactctagcagaggtggtaagagagatactagccaggtaccaagtgctgctggatggactggttcatccagggtttgtaccagttgctggagccccgaattgattgttctgttgcaggaaacagagatttccctctggtaaaggctgctagtgcagaaggcaattcctatgtacaaaattgccagcattgaacgatgtcgatgtccatagtggaccaggagttctacctgcctgaatgacatagctggtggagttgagagtctataatggagatcgtaaaataaggtttgcaataacctggaaagcggctggatctcatagccagagatgatgcagaagtcgggaggctggttgggcaatgc

SEQ ID NO: 500053 - DNA, 345 bp, Homo sapiens
  misc_feature (5)..(5): n is a, c, g, or t
  misc_feature (17)..(17): n is a, c, g, or t
  misc_feature (56)..(56): n is a, c, g, or t
  misc_feature (58)..(58): n is a, c, g, or t
  misc_feature (81)..(81): n is a, c, g, or t
  misc_feature (89)..(89): n is a, c, g, or t
  misc_feature (108)..(108): n is a, c, g, or t
ctgtncgtattttatancttacaggcttacacaggacacagtggtctgtacctgtngncctagctgctcaggaggctgagncaggaggntcacgtgaacccagaaatntggggctacagtgtgctatgccccgggccccttcaccagaataaaaccattggagaggctttcagactgctgtgaggagaaagagatgttcttcctaagctactgggcatagaaagagacggacatgtagaggaggtcttagagaaactggagcttaggagaagaaggccagctgggatggtagtgagtgtctaagtgttttatcatttacaggttctagaatcaagttagtagatt

SEQ ID NO: 500054 - DNA, 987 bp, Homo sapiens
  misc_feature (302)..(302): n is a, c, g, or t
  misc_feature (463)..(463): n is a, c, g, or t
gattagcgtgcactcatactgcgctatacactgagttaagtggcatatgccagcatgagtgtagcacccataatgaagtgacccagctcgaattcgctacgcatatatcgacacgtacaccgcgttctagcacttagttgtagtaactacaacgtattcgcgatcgtactcgagtaaacctgcttcacctcaacaacatgagagactctgagcgtaacctcgatacatcgacgtaatcctcattgtagccaagatagtactcgcgcggaaatgctgacgatctgaagggagacgctcgaatntcacaatggagcgctacgcaatgactagactaggcttgatcgcgcaaacaaaggtcgcatttctgcaccatggaggtatacattgcctaaatttgtaatgtgccatcaagaaagtgatatagactctacggaccaggggagtaagacgtagaagtccatangaacgcaacttccaggtgctgatgtctgactatacgcgactggcgaaattgggatagtagttaggtgcctcgccaggaaaggttcgtcactgctggtgacaatacccttggaagagtaccgtttcactagatgacagaccggttgttgctcgtggatcaggggaatgtcagatcattgatgtggctgcatgcgatctaggcttaatataatgaaagaagtcggtaccaatgaattgtacaggcactggtgttggaccttgttcagaaagtgtgttctatttctcgttccatactagtctactgagcctttcctgtgtcgttcctccatctgtggaagggttttctcggtactgtctaagtatgccctggtgtttgccactggggacctcgtacctccggggttccttcccttaattttctgtgtcttggcgccaatcctttttctttaacttgccacgtcacttgggcgtggggggtgcgccgggtaaaggaacgtcggggtttgaccttcaggggggtcgccc

SEQ ID NO: 500055 - DNA, 364 bp, Homo sapiens
agaaggaaaacaactttttatgtatagcttctaaaaggggaaaaaaaaaaaaaagagaaaccctttgacttccacgttgcccatctcaagacattccactcacagaattggaggtcctgggatcccaggtctggagtttcccaatgttaagtgtaaacagaacgggcacacacacatttacgatgacctgtaattataatccctcttgcgggtcactaccgtcgcttcctatactctacttcctatggtgctgaacttctatttaaaagaaaaaaaaacttttggtaacgactattggcagtttaagaatattcaattaaaccccccgtagttttccaagaaagacacaaacaaacaaaaaagg

SEQ ID NO: 500056 - DNA, 394 bp, Homo sapiens
tctggtcgaagtgtcagagggactctagcttggagatggtcattattgggaggaactcagcgtggagtggtcatgtatcagacgagtgatccatacttgagacgatggtcagaaccaaagtgagtcatgcttggagtgtgctcagaatcagagggactcagtttggattgttcagttaccatagggactcagtccggagtgttcagtgccagagggactcagccctgagtggtcagtaccagagggactcagtccggagtggtcagtaccagagggactcagtctggagtggtcagtaccagagggactcaggttgggtgagctctgtggtgcgacctgcaggggctgctgcttgttccttatcctcccgtgacaggacactttgcatccagag

SEQ ID NO: 500057 - DNA, 549 bp, Homo sapiens
  misc_feature (416)..(416): n is a, c, g, or t
  misc_feature (495)..(495): n is a, c, g, or t
gggccgcccttttttttgtgtttttttttggaagagtgtttggagtttcattcacacaaaacatggacatcatctgtgaggctctgtcccagagagacagggccatccctcatgtctgtaatggggttgtagataaacaaaagttataaactcaaacaaacgtgcaaatttactcgtgtcgtcttttccttaattcaatacagcaacagttcctcgagtgtggtacgtgcgaccacttcgttggaaaaaagtgccttcgaggttcctttcccatcccccaaggcagcagcaaattccttcggtgtcgcctcctacgggccaaggcgagccaaagaattgtgaaagttcttgggcctcgataaagtggccagaatccgcttagagactttccgtggtgtagagcttccacgcgtggncagctttacacataaattctcccaatgtgaggcgcgtggaatactttcagctccagtgttctccgtgggcttagacagnctgtgtgtacattctcagattataatctccagagagggctccctcagtgtgtcc

SEQ ID NO: 500058 - DNA, 471 bp, Homo sapiens
  misc_feature (36)..(36): n is a, c, g, or t
  misc_feature (74)..(74): n is a, c, g, or t
  misc_feature (106)..(106): n is a, c, g, or t
  misc_feature (170)..(170): n is a, c, g, or t
  misc_feature (177)..(178): n is a, c, g, or t
  misc_feature (197)..(198): n is a, c, g, or t
  misc_feature (200)..(201): n is a, c, g, or t
  misc_feature (207)..(208): n is a, c, g, or t
  misc_feature (220)..(220): n is a, c, g, or t
  misc_feature (224)..(224): n is a, c, g, or t
  misc_feature (231)..(232): n is a, c, g, or t
  misc_feature (254)..(254): n is a, c, g, or t
  misc_feature (260)..(260): n is a, c, g, or t
  misc_feature (263)..(263): n is a, c, g, or t
  misc_feature (267)..(268): n is a, c, g, or t
  misc_feature (279)..(279): n is a, c, g, or t
actcgccacccgtatttctaacattacttcagaggnggtagtgggggaatttgcaacaaagtggtgagatgcancaataaccattgcctctttgcaactctgtgancaaaaccagcaattctttcttttatttttaatttattttttattttttttgagaccgagtctcnctctgtnncccaggctggagtgcaatnncnngatctnngctcactgcaanctcngcctccnnggttcaagcgattctcatgccncagccnccnaagnngctgggattanaggcgctccccaccacactcggctaatttttttttttttgtatttttagaagagacagagtttcaccatgttggcgaagctggtctcaaactcctgacctaatgatcggcccacctgggcctcccaaagtgctgggattacaggcatgagccaccacaccttgctgacattaagctttaactcagcctttat

SEQ ID NO: 500059 - DNA, 288 bp, Homo sapiens
aaggatagatcacaatagtcgaccataaataaaagctgcaacacaccaattgcataaatagagctaggacagagggccctctgacaactactgacctgaaaatgacctgagggctctacgacccattaataccctatgagccaacatttagtgcacagcttttggctgtattaatagaggtaggaaatccagagccagagaggtgatataggtgcacttgtaggcagtgctccggacacagctggaggtgcaggctcagaactgggagccacgtctagaggaatgctg

SEQ ID NO: 500060 - DNA, 338 bp, Homo sapiens
  misc_feature (36)..(36): n is a, c, g, or t
  misc_feature (74)..(74): n is a, c, g, or t
  misc_feature (106)..(106): n is a, c, g, or t
  misc_feature (170)..(170): n is a, c, g, or t
  misc_feature (177)..(178): n is a, c, g, or t
  misc_feature (197)..(198): n is a, c, g, or t
  misc_feature (200)..(201): n is a, c, g, or t
  misc_feature (207)..(208): n is a, c, g, or t
  misc_feature (220)..(220): n is a, c, g, or t
  misc_feature (224)..(224): n is a, c, g, or t
  misc_feature (231)..(232): n is a, c, g, or t
  misc_feature (254)..(254): n is a, c, g, or t
  misc_feature (260)..(260): n is a, c, g, or t
  misc_feature (263)..(263): n is a, c, g, or t
  misc_feature (267)..(268): n is a, c, g, or t
  misc_feature (279)..(279): n is a, c, g, or t
actcgccacccgtatttctaacattacttcagaggnggtagtgggggaatttgcaacaaagtggtgagatgcancaataaccattgcctctttgcaactctgtgancaaaaccagcaattctttcttttatttttaatttattttttattttttttgagaccgagtctcnctctgtnncccaggctggagtgcaatnncnngatctnngctcactgcaanctcngcctccnnggttcaagcgattctcatgccncagccnccnaagnngctgggattanaggcgtgagccaccgcacctggccaaataaacaaatcttgatggttaatgttagagata

SEQ ID NO: 500061 - DNA, 177 bp, Homo sapiens
ttcataaaagtcttgaaaggcatgacaatttctaacagtagctagaaatggtaccaactctgggttctatgggctgttaatgcacagaaaattggcatgagactgacaaaagtttccccagacaaggcattattggagtttacacctggacataaagagaggatgtcggcgagggag

SEQ ID NO: 500062 - DNA, 213 bp, Homo sapiens
tcccaaggatgagaaattggttaaacatacacaaatcaataaatgtgactcatcacaaaaacagaactaaagacaaaaaccacgtgattatctcaagagaagcagaaaaggcctttattagtccattctcacattgctataaagaactacccatgactgggtaatttatgaagaaaggagattcactgactcacaattcctcatcctgggagg

SEQ ID NO: 500063 - DNA, 1277 bp, Homo sapiens
tggctgtaacagggttaattggatgatgagtccagggctccggctgaagccctgggggggaggggcacagagcgaaatggggcgtaagggaatgcttgaatggctgctccgtgattgtcggtcggagtttccaaatctaggcagagggcagggtgaggcctcgggcacacagccggggcccagtcacccgtggcccagaagtggatgggcgtggccggtggcccttgaaacaggccattgtgccagagggggctccacaattcacgcgcaaacttcggtactggaaatatcaatggccgtgtttcccaaaactttcaaccccaggtgcaaaggaacttatagggcccaaattcaaatttcaaacagggcaggggggggaaaacgagaattcgggtgggagggcttttggcgaatcttcttcgagaaaaaaagaggaaacagcaccgggaacaaagctctcaaagaaaacccaaagacagacacaagacagagggtattgccaccacagcagaaaaaacaaaaaggggatattagtgggtcgggtaaaatctctcgaaaatcctcccagaggaacgtgggtaaccctcaagaggtcccttttaacaccgtgacaaagggcatctcggaggacaaaaagggcgtggggacattaatatatcacacatatagcgctggtcacaaatcttgtgtggacccaaatatactttggggaccaattccttacagaacaacaaccaaacacgaaaacaacatctgcagagggagcaccaaaatgtgaggggaggtgcggggacaaacaacaaagggggataccactagacaacgggggaccccgagtggggcaaaaacagcgagtgtacacctcggaaccccaacgacaatcccagggcacacacaacaggggggaacaaactcaggcgccggggacccccccaaaaaagaggagaagcgcacaaatcaaacaactgcgccaaaacagcgcccgaggtataaacccccgggacctaaagcgagccccgcggcaagagaaaggcgactccacggccagcaaagagcgaccaagcccaacagaccgccggacgcgaaccaatagagggaaacgacaagcagacacccacacagcagaaacacacacacgagatatcgcgcgagagacacaggcaatgaaccgatcgaacacccaacgaaacaaccacccggcaaccaagacggtcagggatccgcaccgcaagcaaccacccagcgaacgcaccacaaacaaacaacgacagaagaaa

SEQ ID NO: 500064 - DNA, 576 bp, Homo sapiens
gtccagctcggaaccctttgcgacggaatgcgacctgttaaatcttttacagtatttatacatgcacttacttaagagattttataaatgactttccttttcaaaaacatttcgtaatgtcacatatccctattacataagacaatccatatatttagcgaatcctcatataaagtgctcaatacacaactttaataatgtgacctacctgtcaaaaaagcataacatgaacatattttacagaaaccttagacgctcataagatgatgaatatcctaccaaggtactcagcctatactcctcaaaaattataagctaaaggagactatcgcgacgagactaggacctgcatcacgtgcatatggactggatcttgtaccaaatggcatattttagacttatgcactttcggacatttttgagacattcggaccaatatcagtaccgtatgcacatgattaatagccttatatcagtgcgacttcctgatttagataataatgtcatggatccttgaaaaagtccttgttatttaggacatagacactggagcgtttaaggttaacggaatattga

SEQ ID NO: 500065 - DNA, 508 bp, Homo sapiens
caagagaaatgtattctctcacagtcctggagccagaggtccaaaatcaaggtgtctgcagagccacgctccctctggaaggtctaggggagggtccttcctggtctcttccggtttgagtggctgcaggcattccttggcttgtggccacatcattccgacccctgcctctgttgccacatggacagggtgtgtccctttgtgtgccctctcttcttctcatacggatgccagtcattagatagggcctactcaaatctagggtgacctcatcttagcttggtgacatctgctgagaccctatttctgaataaggtcacattgggagcttctgtgtggacatgaatcttgggggagcactgttcaccgcggcatatgctctatgggtgccaacctgaatcccagaaacagctcccgacatcagtgtggtcatcaccccgttttaggaaagggtgacgcagagctcaagccttcagcacaagtgatggctgagcagtgactctggtta

SEQ ID NO: 500066 - DNA, 450 bp, Homo sapiens
tctagaggacccccgcacgctgtcgcgtctgtaatcccagcactttgggaggccgagacgggtggatttctatcagcccaggagtttgaggcaaggctgggcaatataggcaaaaccccatctctacaaaaaatacaaaaaaattggctggccatggtggtgtacacctttagtcccaggctgaggtgggagaatcatctgagcccagggagactgaggctacggtgtaccatgattgcaccacagcacaccagcctgggcaacagagtaagaccccatctcaaaaaaaaaaaaaggtggaaccagctaaaattccccttttaatttatcatcttgggagggtgctaccgaaatagtcctccacttggaaacagggtaaagagtgagattcaagtatatatcgggtcttccctatagagactgttttgaaaggacaaccaattagcccca

SEQ ID NO: 500067 - DNA, 157 bp, Homo sapiens
tcaaggatagtcagtagaataagacttgtgaagatgatcggtgtagagtggaaggttaatggttgatatggctagggtggggcttccaattagttgcataattcgttggccggcagtaatgttagcggttaggcatacgcccggttaagcggggaac

SEQ ID NO: 500068 - DNA, 380 bp, Homo sapiens
  misc_feature (73)..(73): n is a, c, g, or t
  misc_feature (356)..(356): n is a, c, g, or t
  misc_feature (378)..(378): n is a, c, g, or t
tggatgtattcagcccgctgcgtcatctctgaggaaggtcctgctgcacctgttgaagcatcccagtgtcacncaggaagtgaggtgtgacgagagcaaccgtctggacacacaccactacctgtcccagcggagacaggcggtggattacttcattctcatcctgcaggggagggttgaagtggagatcggaaaagagggtcttaagtgtgagaatggggcctacacgttctatggagtgtcggccctaactgtgacatcctcggcacaccagtccccggtgtcctcgctccagcccatccgacatgaactagaggccccacccaggtgacgggacgcattcatctgtgtattgncccctactacaacgaggagggngc

SEQ ID NO: 500069 - DNA, 312 bp, Homo sapiens
tggggcatgatctactggcattgtggtggtatatctaagtgggatgacaaaacgctacgactcagtcaatcatattctgcatttccgtcttactactcaacaatagtgttacagggtttgatgaccgtcatcgaaacccttcatcgaagcccttcatcgaaacccttcaagtcatctttcagctcctttccatatgctgcttgatattgctagggtttgatgactcgaaaccctctcggcatctgtgcctcagtttcctcatttataaaatccctatgatctctgtctcacctactttacagggtttgatga

SEQ ID NO: 500070 - DNA, 372 bp, Homo sapiens
  misc_feature (141)..(141): n is a, c, g, or t
  misc_feature (155)..(155): n is a, c, g, or t
  misc_feature (160)..(161): n is a, c, g, or t
  misc_feature (173)..(174): n is a, c, g, or t
  misc_feature (189)..(189): n is a, c, g, or t
  misc_feature (243)..(243): n is a, c, g, or t
  misc_feature (330)..(330): n is a, c, g, or t
gaaaattaaaggaggacaagaggaaataaacttcttttataggctattaacaacctatttaatttttcagcagatttcttctcactgtgacaccaagagatcccattcacttaatccacaaaatgcttacctcgttaccanctctcgaatacacntctannagtgaaatccanngaacaaaattcacanacatttgcgagcaaaactctatacaagtccacagaaaacacaacctgggacacntcacgcactatattttgatactctatttttacacaatcaatggaacaaaaacataaattgagtagagaatgcagtcgagtatttacncgattccatagactgaaagtcagtgctgacgaggactgtctt

SEQ ID NO: 500071 - DNA, 282 bp, Homo sapiens
  misc_feature (37)..(37): n is a, c, g, or t
  misc_feature (147)..(147): n is a, c, g, or t
  misc_feature (240)..(240): n is a, c, g, or t
  misc_feature (249)..(249): n is a, c, g, or t
cggtcgagcagatcgccacgcaacaccagcagcagtncagcagcataaaggagagcgaaaatgccgaaagctgacttaacgttgaccacggctgacgtaacaggcggctaacccaggcgcagaggcagcgatttcagcgtcatgcgncgaagtacattcagcagcatccagcccagcacaccgcacagcaaagccagtacttaccgcgcccgccagcaccgcccaaagcagcatgttgcnacccattantccggcgagcagcagcacaaccaccacactgac

SEQ ID NO: 500072 - DNA, 323 bp, Homo sapiens
gatctagagtatcccaatgtcacgcgagtataatacggacacggctggcaacaagaaaacacaaaaagaagccacacctcttaccttaatccataattttccatgattctttttctataactcttaaatgccagtgcaaaggtcaacttctgacagtctcaggcactggcttaattctcattgggccaaaaatagaagccatcaaaatgaatttatccactacgggatacatgatggtaaatgagatggtcctcacttttctaggtcgtggtcacttaattttccccaaatcatttcttctcatcatcccccggctgccaggt

SEQ ID NO: 500073 - DNA, 402 bp, Homo sapiens
ggacacgcagaggcattcattgtgaggtgtactcgtatgaggcccatatttgagactcgtggacatttatattatactcgtgtcatgtgttataatttatacactaaaatgtgctggttgactgtgtaccttggttttgaagaaatttattcgtgaaaggaagagacagttggtatttattgggagggctcttgcttgtaaagggctttttttccttgtgaaccatttaagtccattccttactattcacttacttatctgtgttccttcatttcactgtgagactctttttcactttcccttgcatgtcagtttctgtgatgtgtatttattggattctctggtgtctgagctgtacatacatgagaccttgggttttggttacacgggaccttgactggc

SEQ ID NO: 500074 - DNA, 1059 bp, Homo sapiens
agtctatcaccattcgcgtgtggcccggacccagtcaggtaagtgagcatggtgatacctgtgtatcctactgagatccatgggtcagtgaccgtagtgcttggattctcatccagatacaaggacggctcggcgggaagtcgagacgtactgtaacgaatgtcacgtatggaggttcagtaggtcacattactagtgatcatatcagacaggaggtcgaagcgaattcgatagttcagaactgagcagcaccgcaaggacccagggaaagggggaagccaagcgggagaacacagaagaacagacaacaaaaagaagagaccgggagcgacaacacgacaaaaaaagaaaagaacaccacagacagaacagacgcacgacaagacacagaaacaacggggaacacacccaagcaacagggcacagaagagcgagcaacacacgagaaaaaaagcgacaaaggacacaaacaaacaagaggcacacaacaatacccaagaaacgaagacagaaaagggaaacaaccacaaagaaaaagaacaaataaaagagaaggaaaagaaaaaagaaaaaaccagaaacaaaaaagggaaaaggagaaagaagagacaaaagcagagcaagaaaaaagaaacaagaaaaacacaaaaacaagaacaaaaaaaagaaacaaaaaaagaaaaaacaaagacaaaacaaaaagacaaaaaaaaaaaaaaaaagaacccaaacaaaacacaaaaaaaaagagaaaaaaacaaaaaaagaaagaaaaaaaacagaaaccagaagaaaaaagaaaaaagaaaaaaaagaaagagacaaaaaaaaagaaaagacaaaaggagaaaacaaagaaacacaaaaaagaaaagaaataagaaaggacaaaaaaaagaaaaacaagaagagaaaacgaaaggaagaagcacaagaacaagaaaacagacgcgcaaagagaaaacaagagcagacacaaagaacaaaagaagaaaaagaagagacgaacacacacaaacaacagaaaacagaaagaaagaaaaagagaagatggaggca

SEQ ID NO: 500075 - DNA, 758 bp, Homo sapiens
  misc_feature (78)..(78): n is a, c, g, or t
  misc_feature (92)..(92): n is a, c, g, or t
  misc_feature (131)..(131): n is a, c, g, or t
  misc_feature (223)..(223): n is a, c, g, or t
  misc_feature (320)..(320): n is a, c, g, or t
agcgggtttatctcgttggggactaaggcgtcggttggcgcgcacgggttctaggctgcaggcagctcgaggacccgngggcccaacccggntctggctggcatatagcagaggcagcaggccgtgccggnggggcatgttgctgtaaccagtggcccaggggatgttacgagtggacagtgcacctggtagggcgggccccgcagggtgaaccatgctgcantggctgtcgggcatcgggtatactccttcgggggttactgctctggtgaagactatgagacactgcgtcagatagatgtgcacattttcaatgcagngtccttgcgttggacaaagctgcccccggtgaggtctgccatccgtgggcaagcgtcctgctggtaccctacatgcgctactggactactcaatccgtcctctatcggacgactacagtcctccttgaggggcgggcgcgaatgactgccgaaggggtcctagcaagtgtgctctatgcctttgacgtctgcggactgtttaaccaatgacatgcacaagctagataccagcaccatgatctggactcttatctgtacaaagggcaggcctgcccgctggagggacttccactcaggcacaatgctggggaagtcgcatgtctgtctttgggggccgtgccgatcgatttggggccattccattccaatcaatgagatttacgtgaaccgcattcgagtctttgaacaccagaaactgaggcttggctggactgtccc

SEQ ID NO: 500076 - DNA, 750 bp, Homo sapiens
  misc_feature (70)..(70): n is a, c, g, or t
  misc_feature (84)..(84): n is a, c, g, or t
  misc_feature (123)..(123): n is a, c, g, or t
  misc_feature (215)..(215): n is a, c, g, or t
  misc_feature (312)..(312): n is a, c, g, or t
gaaatttcgccccgagggccaaaggaggtgctcaatggttgcttgggcttcgattggtcgaagaacccgngggcccaacccggntctggctggcatatagcagaggcagcaggccgtgccggnggggcatgttgctgtaaccagtggcccaggggatgttacgagtggacagtgcacctggtagggcgggccccgcagggtgaaccatgctgcantggctgtcgggcatcgggtatactccttcgggggttactgctctggtgaagactatgagacactgcgtcagatagatgtgcacattttcaatgcagngtccttgcgttggacaaagctgcccccggtgaggtctgccatccgtgggcaagcgtcctgctggtaccctacatgcgctactggactactcaatccgtcctctatcggacgactacagtcctccttgaggggcgggcgcgaatgactgccgaaggggtcctagcaagtgtgctctatgcctttgacgtctgcggactgtttaaccaatgacatgcacaagctagataccagcaccatgatctggactcttatctgtacaaagggcaggcctgcccgctggagggacttccactcaggcacaatgctggggaagtcgcatgtctgtctttgggggccgtgccgatcgatttggggccattccattccaatcaatgagatttacgtgaaccgcattcgagtctttgaacaccagaaactgaggcttggctggactgtccc

SEQ ID NO: 500077 - DNA, 533 bp, Homo sapiens
ttggaccccaggctcaagtacaggggtgcgaactcggattaccacaggtctctgggctcaagcaattttgcactctcaccctctcaagtaactgggactacaggcatgcgccatcacacccagtcaatattatgtattgtttagtaacatgggtttgaccacgttgcctacgctggtcctgaactacagagcctacgtgagccagccaactaggtctcccgaacagctgaaatgactggtatgagccaccgggcctgtccttgagaattattcaatatggccttggaactatcagcattagggatattcaggaatgactagctgagcgtgagtccatataggagacatatgtgttcaagaacttgtccatttgatcgtcaatgctcaagatattggtatcaacataccctataatatactgagaatgtctatcatgagcacagcggagactctacatgcttctataaaagcatggtactgacgtgtagataatatgactgatgttgaccatacactattcactagactggggc

SEQ ID NO: 500078 - DNA, 134 bp, Homo sapiens
  misc_feature (134)..(134): n is a, c, g, or t
agtcgggagaggattcaaatattaaagacatcttaggtcacggagcatcttcccaaggaggttcttccaggaaaacctgggggggacggtaaaatttgattttggccatttggagttttccagttcctacccan

SEQ ID NO: 500079 - DNA, 447 bp, Homo sapiens
aggaaggaaagaaagaatgaaggaaggaaggaaggaaagaaagaaaaagaaagaaagaaagagaaaaaagaaagaaaagggaaagggaaagaagaaattctggagttgagaaatgcaattgacatactgaagaatgcatcagagttccttaatggtataattgtgtcaagcaggatcaagaaatagtgagcttgaagatgggctatttgaaaatacatagaggtgacaaaaggaaaaaaaaattaaaaagaatgaggcttgcctgcaggatctaaacaacaagtgtcaaaagggaaatcaaagagttctcatccttaaggaggaggtagaaagagagcgatggggacagaagtttctttaaagaaatagtaacagataactttccaaacctagagaaagataacaatattcaagtagaagaaagttataaaataccaagcagatttg

SEQ ID NO: 500080 - DNA, 266 bp, Homo sapiens
  misc_feature (56)..(56): n is a, c, g, or t
  misc_feature (170)..(174): n is a, c, g, or t
  misc_feature (183)..(184): n is a, c, g, or t
  misc_feature (194)..(194): n is a, c, g, or t
  misc_feature (203)..(203): n is a, c, g, or t
  misc_feature (206)..(206): n is a, c, g, or t
  misc_feature (209)..(211): n is a, c, g, or t
  misc_feature (217)..(217): n is a, c, g, or t
  misc_feature (227)..(227): n is a, c, g, or t
  misc_feature (251)..(252): n is a, c, g, or t
  misc_feature (258)..(259): n is a, c, g, or t
  misc_feature (263)..(263): n is a, c, g, or t
  misc_feature (266)..(266): n is a, c, g, or t
gttacatattcctgaaagccagactctaatcacacagaggaattttattgtaagtnacatgcaaagcaaattagttcttcaggaaaataaataaataaatggatcaactaagatatactaaacctcaaaaaaccctgaataaagataaaggtaaaaatgtattaataaannnnnccgcttaanntacttaaganagtattaanatnccnnnctttcncttctctacngtcaaagtttcattccccgggggnngtgggnnggtnggn

SEQ ID NO: 500081 - DNA, 1614 bp, Homo sapiens
ctcttagggcagaactggtgtcttcgtatgacaagtatgaagaatatgataatgccataattaccatgcatgaatcatccaactgactgccctggaaaagaagggcaattcaacagactatcacttaccaaggcttgccaactgtggaacgtaatactaccagagcaagtacacgcttctactatagcaacttccaagcactctgctcagtatacaatgactttagctagcataggtagctagtactaccaacggatctggaattcacaactacgatgaccagtcaaaattaattttcagcccaacggccttaacagcacagccttaaccaccctgcgctggaacacagcccggctaactctctgccgattctccacggccttcatccaagcaaacccaattaccgccaaaccgacaacacttccttgctgccaccagttgaacacttccaatcgcggccacaccgagaaaatcctgtctagctccacttacttaaccaatggcaacaagcaaacaaggacacttataattccacgaggcccattccaatgaccggcaaaaagccaagatttcgacacattacggaaagttggcccgtacttaccttggcaagccgaagaacccatcatataggcaacccaaaaaccttcaccttccgagtaacctcgacacccccctacatgggcacactcccacacgcaccccacgcacattactccccggggcgcaaaacaaacacaaacacagaccgattctatcgccacccacagccatataccaaacatatcgcggcaaacgcaaccttccattcccaaataggcgcgcaaaagaggcaaaaacaaactttagctaagagaacccaactataagggcacccgacttccgttcacacattttccccatatcccgaacttctatacccaacacaaacaaacgcgcacggaccccctaacaactccccatacaaaatcaatatcaccgggtgcgctctatagggccggagccaaaccaaagaaactcacaaaagcgcaacaggaccctgaggcacccaaaccacgcacaaaggccgcccccacctgcgccacggcacccccaactatacgggccacacgacaaacaggcacaacaccccaaaagcacccccccaccttaccctaacccaacaccaaaacacacgcagacggacaacaaccttagggcccaccgacaaccactggcccacacaaacaacgaccatccaaccgcttgggcacccgctactgtcacccccatcgcgacacccacaactacccccattcacccacgacaccccggcaaaacctctcatcccctttggacaaacaaacacttaaacaaggacgccacattatggcgaaacgaccgggcaaaaaacaaccacatctgccaccctcaacataggcgccccaacggcaccacaggcaaagccaacacaacgacccacaacgggcccaaacacgacgcagaccaacaaaaaggacaaacaaacaaacgacacgagccacacgagacaaaacacaaaacgagctatggacccaccgaacaaaagagcaggaacaacagccccaccgcataccccggcccacccacccctcg

SEQ ID NO: 500082 - DNA, 359 bp, Homo sapiens
acgcgggggggtgggtaggggagggggagaggaggggaaagctagacctgcagagtgacagaaagctggtcatagatgtctgacaaacctacaagaaagacttgtgttacgatcagaacataactacctgacaacatattcgcacaacgaaacatacgagacaagcaggaaaagagagaagaaacaagctagaacagaagagacaagagaggcaaagaccaagaagacaagacagcaaacgcgcgcaacgagagcagaaaaagacaacacacagagagaacacaagagcagacaacaagcacacaagagcccgcagggagacaaaagcaaaaaagaaaaaagaaagaggaaagcagaga

SEQ ID NO: 500083 - DNA, 200 bp, Homo sapiens
ttggttatagaacgtaatagggtgcagttagtgaaatagtacagatatgatcaaagggaaagatggacaaattaagcacatagatctttcttgttggatgatacgtagacgtgtgtgagtggtgggttgtggtgtgaggggtgggtgggtggttgggtgggtggtggtgtgtgtaggtggggggggtgggggtgggtggg

SEQ ID NO: 500084 - DNA, 630 bp, Homo sapiens
tcaagtgatcttcccgcttcggcctcccaaagtgttgggattacaggcgtgagccactgtacccagccttcggagctattctcaacaactagctgaaaaaaaaaaaaaaaataaaaaaaaaaaaaaactttgttgggcagcgcttctgggccatgagagaaaacagttttataaacaacttctgtttcgtgggcgccggggcccattgtaaggtaacatgtgatacacctggtggtctactaaggttgtttctccaagaggacatcgtgggtacagtgaaactagtgtgctgtggggctttcttccacaactttaaaaaccgccccgggcgggcaaccacgatggtttgtatgaaaaaaatttcaaaaatgggagggtcaacggaggaggccaataaggggggagcatcataccaaaacgggtagcctaaacagaagctggctatgttatcaaaaatataacctcaccattgtgtgtgggtgaaaacaacagattatgatatatgaatactaacagctagcacaaaatagactagtaattatatggatatagttatcagagtagatgtatagtacacatagcaatgaagattagctgacaaatctgcataaacacagatataagatacag

SEQ ID NO: 500085 - DNA, 636 bp, Homo sapiens
  misc_feature (267)..(267): n is a, c, g, or t
  misc_feature (283)..(283): n is a, c, g, or t
  misc_feature (298)..(298): n is a, c, g, or t
  misc_feature (340)..(340): n is a, c, g, or t
  misc_feature (344)..(344): n is a, c, g, or t
  misc_feature (390)..(390): n is a, c, g, or t
  misc_feature (447)..(447): n is a, c, g, or t
  misc_feature (475)..(475): n is a, c, g, or t
  misc_feature (479)..(479): n is a, c, g, or t
  misc_feature (507)..(507): n is a, c, g, or t
  misc_feature (510)..(510): n is a, c, g, or t
  misc_feature (519)..(519): n is a, c, g, or t
  misc_feature (534)..(534): n is a, c, g, or t
  misc_feature (541)..(541): n is a, c, g, or t
  misc_feature (544)..(544): n is a, c, g, or t
ctcgtgccgacggtggtggtgactgagcggagcccggtgacaggaggtgcacagattggtgttggtattaggagatctgcacatcccacaccggtgcaacagtttgccagctaaattcaaaaaactcctggtgccaggaaaaattcagcacattctctgcacaggaaacctttgcaccaaagagagttatgactatctcaagactctggctggggatgttcatattgtgagaggagacttcgatgagaatctgaattatccagaacnagaaagttgtgactgntggacagttcaaaantggtctgatccatggacaacaagttattccatggggagatantggncagcttagccctgttgcagaggcaatttgatgtggacattcttatntcgggacacacacacaaatttgaagcatttgagcatgaaaataaattctacattaantccaggttctgccactggggcatataangccntggaaacaaacattattccatcatttgngtngatggaatncaggttctacagggncacctantgnattaggtaattggggatgatgtgaaagttgaacgaaccgaatcaaaaaaacctttaacagcccaagggcgcccctgggctcccttctgccac

SEQ ID NO: 500086 - DNA, 500 bp, Homo sapiens
ctcacattttaatatgtatatgactcacttgaggaccagtgttaaaatgccgattctgaagggtaggtctgaggtgggcttgaattctgcatttcttttcttttttttcctcatatttttccagttttatttgtatacatacaccatggaatactactcagccataaaaaatgaaataatgtattttgcagcaacttgcatggagctagaggccactatcctaagtgaagtaactcaggactggaaaaccaaatgctggcatattctcgcttataagtggaagctatgctgtgggtacacaggtccaccagagtggtataatggacactggagactcagaagatcagagggtgggagtggggtgaggaatgagaaattacctattgggtacagtgtacactgtttgggtgatggttacactaaaagcccagacttcactatataattcatccatgtaaccaaaaacaatctgtaccccctaaatctattgaaatggaaaa

SEQ ID NO: 500087 - DNA, 233 bp, Homo sapiens
catggtcaggctaggacctgaactggacagtagcagtgggaatagaacataaggaaggatgtgagataagtaatggaggtagaaactcagggtaggactgtgatgttttgggcaacaaaagtggaatgaggggaagggaagataggacatttggcagtggtcattactgctcttttctccccagaaaaatcctggcctttcttaagctgccagggaaatgccagccagatcca

SEQ ID NO: 500088 - DNA, 334 bp, Homo sapiens
  misc_feature (52)..(52): n is a, c, g, or t
  misc_feature (72)..(72): n is a, c, g, or t
  misc_feature (81)..(81): n is a, c, g, or t
  misc_feature (85)..(85): n is a, c, g, or t
  misc_feature (89)..(89): n is a, c, g, or t
  misc_feature (99)..(99): n is a, c, g, or t
  misc_feature (111)..(111): n is a, c, g, or t
  misc_feature (118)..(118): n is a, c, g, or t
  misc_feature (156)..(157): n is a, c, g, or t
  misc_feature (175)..(175): n is a, c, g, or t
  misc_feature (182)..(182): n is a, c, g, or t
  misc_feature (186)..(186): n is a, c, g, or t
  misc_feature (199)..(199): n is a, c, g, or t
  misc_feature (201)..(201): n is a, c, g, or t
  misc_feature (272)..(272): n is a, c, g, or t
  misc_feature (305)..(305): n is a, c, g, or t
aggctgcaaacatgagttgtacttgttagcttaccccaaaataatacctggnataccggacccaatatctgntgattgatntaanctanatgaatacanaccatttcaganaaagatntacaatagaccacatatccaggtcatgaaaattaaagnnttcaggtcacctagcttngtgactnttgnttttctgaccctngnctcttgaaagcctatttaaactggcctctttctccacaccaaaactgatgaaaaggagactgattatgagntaggatttacactgtgtttctctatattaggcntgagggtgagggtgagagagagagaggga

SEQ ID NO: 500089 - DNA, 146 bp, Homo sapiens
cagtatggcgccttcctggaatgatcgtgggctgacgcggacgatgtttttttgcaaaactgacaacctgaaggctgaacagacaacggatgaattctgacgtgaaccaacgagacactccaaatgacctggtggaagtgaggact

SEQ ID NO: 500090 - DNA, 285 bp, Homo sapiens
ctgcgcccccccccccaaagtccagagcctctaggcattgtgatcttctaattagattttcctctctgcttccttgtgaccacttctgttctcctctgccaatgtttgacccctgggggcctgttccagattgccagagcatctcttccttttctttcacataacctagaactaacccagaccatctgattgggtctagattagttagcctaacaattacaaagtaatgcttcttactatgtccgactagcagtgtctgatgaggatgggacagttggtcgacgc

SEQ ID NO: 500091 - DNA, 308 bp, Homo sapiens
atttttaactggaatcagaactggatgttggggtcacgctttgttgtattgtacctcgtgatgacctaattcaaagttgcccccggaaaaggcagattaggtaatataattttttaatggtggaggtgtgtcggggtagaaaggttgctctagggggcatgttgaacaagtgtatttaaaaattgtaaactcttggaatactgtatttatctgctatttcaatgtaaagtcctttgacgtagtgctggtaactgtacagtaatttggtttactaatgaaagttgtgaataaaactgtgaaactagaaa

SEQ ID NO: 500092 - DNA, 609 bp, Homo sapiens
  misc_feature (609)..(609): n is a, c, g, or t
gcggggacgagcggagtcagaggacggagaaactaggaagaggaggagcagtggtctggtggaattatcaggaataattgattcagacttcctctcacaatgtgaaataaatgcaaggttttggggcattgacacttgagaaggcccattctgcaattggacagctgtgtctttgctggggagtatgaagacacctctagggacctgtgtaataatttgacagcacacattgttgaaccatgctgatacagaaggcaataataaaaacagtgctaaaaatataaattgccatacaatgaagaagctcagcatgaccaagaactcttcctgacagagaagaacggacaggagaagaaaacattaggtggggtggacattggcttgccaaataacggcatattgatttctcctattcgacccaacattgatttgtaaactttctacatgaaaatgaagacgaagaagtggtagcttcagccccagataaatctttggaattggaagagcgaagaggattcaaatgaacgacagttcaaaccttgagttgtgaacaggagaaaccaatgcactttggaaatagaagattctggtcctcttattgatataccn

SEQ ID NO: 500093 - DNA, 395 bp, Homo sapiens
  misc_feature (70)..(70): n is a, c, g, or t
  misc_feature (111)..(111): n is a, c, g, or t
  misc_feature (245)..(245): n is a, c, g, or t
gccctttaaaatctttggttctcaaattcaaatgaatttgctgtttgctcaaaattctaagggctcttcnaaattaagtggagaccaattttgttgtaaaacagtccagtnaaactgtgcaaggaaataaaggtaaaattttgggaggtaataataatgtgaaacataaaaatttaataattactgtccaacacagtggaacagcttgtccacaaaaatagtaattactatttattgctctaagnaagattaaaaaaagacccccaaaaaagggaaacttctttgaaaaataaaacatctgttacattaatgtctaataaaaaaattttaatcccaactgcatttcttctgttcccacaaatgtattaaacattcagtttaactggtaaaaaaaa

SEQ ID NO: 500094 - DNA, 395 bp, Homo sapiens
tttcattgattgttttgcgtctgtacccagaagtgggattgctggaccatctctgcccattttaaaattgggaaatgacatgatctgatttaagctatttaaaaatcacttgggcctgggctcggtggctcacgcgtgtaatcacaacactttgggaagccgagacaggcggatcacctgaggtcagaagtttgagaccagcctggccaacatggtgaaacccggtctctactaaaaatacaaaaattagccgggcacggtggctccagcctgtaataccagctactcaggaggctgaggcaggagagttgcttgaacccaggaagcggaggttgcagtgagctgagattgcctcactgcactccagcctgggcaacagagtgaaacaatgtctc

SEQ ID NO: 500095 - DNA, 129 bp, Homo sapiens
caagatgcaaggagaggacatgtcgtgcaaaggcgcgcagtgcagctatcgtgcactactgtgccgatgcgtgccaaggcaggcattagaattcgtcattcgaacatgtggaggccgcagcagtcaggg

SEQ ID NO: 500096 - DNA, 469 bp, Homo sapiens
  misc_feature (14)..(15): n is a, c, g, or t
  misc_feature (249)..(249): n is a, c, g, or t
  misc_feature (264)..(264): n is a, c, g, or t
  misc_feature (343)..(343): n is a, c, g, or t
  misc_feature (360)..(360): n is a, c, g, or t
  misc_feature (362)..(362): n is a, c, g, or t
  misc_feature (368)..(368): n is a, c, g, or t
  misc_feature (384)..(384): n is a, c, g, or t
  misc_feature (386)..(386): n is a, c, g, or t
  misc_feature (389)..(389): n is a, c, g, or t
  misc_feature (396)..(396): n is a, c, g, or t
  misc_feature (399)..(399): n is a, c, g, or t
  misc_feature (401)..(401): n is a, c, g, or t
  misc_feature (403)..(403): n is a, c, g, or t
  misc_feature (414)..(414): n is a, c, g, or t
  misc_feature (432)..(432): n is a, c, g, or t
  misc_feature (458)..(458): n is a, c, g, or t
ggtggcccccattnncagaatttcttggaggtagcagcagctcctgccccaaagtggtgtcctttggcagcccagccccaggctttgtgacagcctagttagggctgcaaaaccatcctgcccggaccacaaaaggaaagttggcggtcacaaagggctcctttgccaggcagtgggaaaccctgggtttggcctcaggaactgggggtgcagtgggggactgccctagtccttgccaggttgccagcnccctggaaaagcatngggggtagccagcttggaacttgccaggccccaaaggccccgactgcctgttggggcaggaaatgcatggacagtgtgntcaaactgtgggcatgngnttgccngcgggaaaggtccttncntgngtgtacncancnanagcatgtgtgngccccttcccctaccccnacgtgaaaacctcaataaactgcccnaagcagcttta

SEQ ID NO: 500097 - DNA, 129 bp, Homo sapiens
aatgatatatttatatagaggttgaagaaataggataatttaatcaatgtggagtgcttgccagggtgcagtggttcacgcctgtgatcctgacactttgggaggccaaggcaggcagatcacctgagg

SEQ ID NO: 500098 - DNA, 320 bp, Homo sapiens
  misc_feature (233)..(234): n is a, c, g, or t
ggaaaagggaaaataagaacatacagtagggaatagatcttgataaattaccttttaaaacaataaatcttgatttatttaaaattgtaatgctattttctatattttttaaattatctagattatttgttcactaggtgatctgggttagcatttttccatttttaagtagtgttcatgtgaatgtttgtgtggatgtaatgtgtgctgtatacacagtctctaatattttnntttgaacaaatagcaaaatgaaataaattactttatgagattgataaagtcctagagaaacagacccactgtagatgttcccaatg

SEQ ID NO: 500099 - DNA, 757 bp, Homo sapiens
ggggtctgcgaccctctctccccatggcggcaagctccctgcgcctctcccgtcgccctcgtcccacgggtctgcttctggtgggagtggggctggtgcgcttaggggagccaaggagatggacaggagccttcctcacagaggggatgaatgccatgtcccctggcccgctcaccttctcttatccggtgttctgccagtcccagctgctccagtccccacctcgtccccctagagacccgcccgttcaccccagtgcctccccgcgctcgttccttgtgctggctgctggccgccgcatttggaggcggagctgctataccgcccgacccgttggatgatcccgagtggcccttcaggtccgaaggaatgctcttggaggaattacttctgtgctggcgcctggaagtctgatgactcgtgggttggagtggggggctggatgacacggctgcctgggcaggcgggtctggcgtgttagctgggttgagctcttagcaagcgccgtaattcacctgccggctgtgccgggcggccggcttgctcccgtgcccctgcgcgaatgacgtcatagccagaagccatgagcaagcatggggccctgggggacggcctcgggatcccccgatccagtgaggacagacgatgctaccgcgagaccctggtggaggtgaagcgatggaggaggatcctacaggaggcgggaccagatgaagggaagaacaagcgcaaaaaataggagggacacttgagaaaa

SEQ ID NO: 500100 - DNA, 697 bp, Homo sapiens
  misc_feature (44)..(44): n is a, c, g, or t
  misc_feature (46)..(47): n is a, c, g, or t
  misc_feature (123)..(123): n is a, c, g, or t
  misc_feature (165)..(165): n is a, c, g, or t
  misc_feature (231)..(231): n is a, c, g, or t
  misc_feature (296)..(296): n is a, c, g, or t
  misc_feature (367)..(367): n is a, c, g, or t
  misc_feature (395)..(395): n is a, c, g, or t
  misc_feature (412)..(412): n is a, c, g, or t
  misc_feature (517)..(517): n is a, c, g, or t
  misc_feature (576)..(576): n is a, c, g, or t
  misc_feature (672)..(672): n is a, c, g, or t
gctgctgctctcatcacttcatccactaccatcacccacatccnannacccctaccccaatcccaaacctactcctttttcccccatctcccacaccccacctttcatacccaccaaaccccncttcaccctcaaaatccactcctacattaacaccccctcccncaatctcacctccctctccaaccaccacatccaccacaatccccaccacctcaacctccaaaaccnccccatccaacactcccaaaaccaatctctccccaccctcaccatccaacccatcccctttcacnacaatcccatctacttcttccaccacaactccaacaacacctcggaggtctaccagggctcccgcacaaancttccattcatttgattcatcacctttncacagcttaagcagagnaacaccctcaaccatcctatcatcatcatccacaccctcctcatcatcctcttcatcatctttcctatcttcctgctgctggacaaggatgacagcaaggctggnatggaggaagatcacacctacgagggcctggacattgaccagacagccacctatgaggncatagtgacgctgcggacaggggaagtgaagtggtctgtaggtgagcacccaggccaggagtgagagccaggtcgccccatgacctgggtgcaggntccctggcctcagtgactgcttcgg

SEQ ID NO: 500101 - DNA, 616 bp, Homo sapiens
  misc_feature (21)..(21): n is a, c, g, or t
  misc_feature (566)..(566): n is a, c, g, or t
actggggcaagtaagcatgtngaggggtctctgttagtttccaagaactgccataacaaagtatcacaaatttcgtggctaaaaacaacagatgtttattctctcatagttccagaggctagaagtccaaaatcaaggtgttggtagggccacacttcctctgaaatctctagagtagcggtccctaacctttttggcaccagggactgtttcttgcaagacgatttttccatggatgggaagggggatgatttcagggtgaaactgttccacctcacatccgagcattagttggattttcctaaggagcatgcaacctagatccctcgcatgtgcaattcacaatggagttcgcgctcctatgggcatctaatgccgccactgatcggacaggaggcagagtcaggctgtaatgctcgctcgcccactgcagcccggttcctgacaggccacaaaccagttctggtccgaggcccagggactggggactcccgctctagaggaggatctctccttgccacttctaccttctggtagtccaggtgtgtctggacccaacctctgcntccttcatcacgtgccattctcccttctgtgtctctgtcttcacatagca

SEQ ID NO: 500102 - DNA, 84 bp, Homo sapiens
cccagccccaaccagacctctctgtacttctgtgccagcagttcgcccggactagcgggagggacagatacgcagtattttggc

SEQ ID NO: 500103 - DNA, 147 bp, Homo sapiens
taatcgagcgaggaggtagatcgagcgaggaggtgtcacctgcagcacaggaagtgctgtgactgggcagctagcagcataatctttgccccaaaggcaaacgagtaaccagctgaagtccccagcagccagagcatcttcctggcg

SEQ ID NO: 500104 - DNA, 404 bp, Homo sapiens
  misc_feature (269)..(269): n is a, c, g, or t
ccagccaattgccgacactgggtccctgtgtggaatcatctttggctgtctgggatattctgtccatcacatcctgtccctgtcactgaagccttggaagtccaggtgcctgtcagtctgaatggttgtcctgaccagtacccaagcctatttcacggcaaggaaattcccttcaaagcactgcttacccaatgcacctccctccccggctcgagttcattcttcaattaggcccaccagacggtttaatagcggtcgtaattttgaantctgcccatggatcccctccctttggcttcagtgctcatgtgtattttatataaaattcccatttcttgcggataaaaaattgttttccaattgttatgcacgatgtttttggtaatgttgtttccactaaaaaa

SEQ ID NO: 500105 - DNA, 106 bp, Homo sapiens
caaaatcttgctgtgatttctgataggaattgcatccaaatctttggtaagaattgacatctttactgtgttgagtcttccaatctatgaacatcgtatgtctcac

SEQ ID NO: 500106 - DNA, 889 bp, Homo sapiens
cccagctgtgcactctccatccagctgtgcgctctcgtctgggagtccagccatgtctgacgagagagagtgtagccgaggcagctgacctggggaagacgcctcttcgcctgctccgaaaacctgaggcagcgagctgaccccagcatccctgcggcctccgaatggtggcctgcctgccgcctgcctgctcgccgcacactgctgcgctgcctagtgctcacctggctttggaggctacgacaaggtgaagcttgcagatgccggctggcagcgcccccggcccctgggcccgtgccagctgactgctgcgtctgcgtggcctgcgggctcaacttcgcagacctcatggctagtgccagggtgctgtactgaccgtctccctgcctctggcctgtcactccgtggccatggagggccgcggggtgtagtgatcgcagttgggcgagggactcagcgaacggaaggccaggagaccggggtgatggtgttgaagccggtcaggggattgtggcagggaagaggtgactagtgccactcgggtccaagaccttcctgaataccttgagggccattgacctttgaggaagctgctgccttgcttcgtcaagttacacttacccaggccataacattgggtcgctctaatgacgctacgagggagaccgtacaggccctggcccaccaggacgttgttgggtaacgaacagttgggctgcaaggggggagaatgatgggggtaattggggattgcaggggtgccaatatggtgcacggatacaggtgggagaagtgttgaaaaggtagatacggaaacggagagctacgggccacggaagtgagcatatagtcaatttaaggggagaaaatggggataaagaattcccat

SEQ ID NO: 500107 - DNA, 530 bp, Homo sapiens
tggaattccagccatccaaaagtttggtttctatccgggtttctcctatgtctgatcataattggctttggattgtttaaaaccaaaacaaacaaaaaattacaaaaaaaaccccacataacaataaacccaaaacacctcggtcactgattcccccccagggctccaaaaagcgcggagggagaacaaaaaaaacgcttgtgtgtcgccgcgcgcgtgtgtgtgcgtgcgtgtgtcggggtgtgcttggcacacacacctctgagtcctttatccgtgagcaagcgggccgaattcgaggcggcgggctcacggggagagaacacccgggggagggacgtgtggaaaaaaagaatttcaacctccagacaaccgcttccaaaataccgtgggcaagggggtggcccctggggggggaaaacctgtctattaaaaccctttccaggtgtccatagcgggcaaaatacagggcatggcacccggtagcgggatgtggcttggccagggggccgggagatctggtccggagc

SEQ ID NO: 500108 - DNA, 1219 bp, Homo sapiens
ggcgtggagaaggtgcttccgcggctgatcgcggatctggtccgccgcgtgcgcgccctgggtggagcaactgaacaggccgggcgactcccagctctacgcggtggactacgagacctttgactcggtcggttctctggagcgcctgtgctgccggtccgggtcctggggcctgacgtccgtccgtcgcagatgccagccatcgttggctgcctgctcggcccgccctcctcgctcgttctgtgcctgggccgctctggatcatcgctgcatggtccttggcctgtggtcacgcatggtaccgtacgcctgtgcctatcttgtgccgtcgctcgagcgcagggatgctgggccgtagctagcgaacgtgcgctagaatacctttgcgcacctacgggtgacaggcccttggttgccaatccatgacccttccagcagtggaagcacctgaggaatgcgagcgcgcgggcgaggaatcgaatgctacgttccaatggtacgcccattgcatgtggacagaggcatggttgccccaaatgctacggagggaatgggaggggccgtttctaccggctgttccaacgctcgcgcggccgggatagaacagcctggcgctccgtttgccggtacacctggctcttcgctccagggcccattgattaatcgctagaaaactgactaggacaagagctgtgagacggaccaagcacctgagggaagccctattgctgtactggtgccaggagtgatacgcgattgtaaccccttgtggattaccccttgggcaagaacagggaaaagacctaagggagggggccaatgggcgccccccgttctagaattgcccagaaaccaggcgggtgggtctttatgggggcctgtgagcggcacgcggggggacctttttggttgaggcgaaaccggtctttttggcggttacaccccgggttttgctcttcggggcgggagggtcacccttccgggcgacgtggtcctggcagggtctggcatcttaaggggggaggagcgtgggggccattcgcacgtgttgctttcctcttgcgctggtggccccccaccccaagttcgagtggccccggcttggcgaaaagccgagagcactcgtccctctcccccttagtggtcctctggggggatccgggagacgtttgaagggacgtacaggaagaagaggtcccgggagaaaaaacagcgccac

SEQ ID NO: 500109 - DNA, 490 bp, Homo sapiens
gtcatctaacgatccattaaacaaacaaacaaacacaaaactattcaaggtttggatcattgaggcaaaattattttgataacaagatgccccgtgtgaatagaaactgagtaatagaaggctcatggccaagtagtcgtatctactaaggagactgaggcaggaggatcacttgagcctcaggaagtttgaggctgcagtgagctgtgattgtgccactgcatatcgtgctgatgacacaggccggaccctgtctcaagaaccgagatgagaaatttatttgagaaggaatagaagccccgtacttgatcccgttgttagaacacatgcagtaaacacacgctagtgtgatgcccgtgagtctgcctcatctctgagagctcatgagagctcatctgagtgtatcttactgtcattactgtaatatccgtattatacgtctcgactgacctgtccgactgtatataagggtatcgaggtcccgtgctcg

SEQ ID NO: 500110 - DNA, 512 bp, Homo sapiens
  misc_feature (480)..(480): n is a, c, g, or t
ggttgtaaagttgtggccatttcttttctcttccttcttttcttttctttcctttcttttttttttttggggacagagattcgctgtgttggcccgggcttaagtgtgatccttcccaccttcagcctctcaagttagcgtgggagatagctgggactgcaggtgggcgccaccagtggcgggctaattttgggttagcatcaagcgtttctaaagtgctggattaaattctaaagggatactctacgggtttaatcttcagtgagatgataattggattggcaacagctttaaaattagttaatggtggtatggggctatggtgacataccctcagatgcacagggggaatagtaatgggtgttcttcaagggatatgtgaattcttagctaaaaatggctgagatggtaaaggtattaatcccttttctttaacttaatacaaattatcttcagtggaagttatggtaatattacggnggggtaatcttagagtgagatcctctggagac

SEQ ID NO: 500111 - DNA, 231 bp, Homo sapiens
  misc_feature (22)..(22): n is a, c, g, or t
  misc_feature (39)..(39): n is a, c, g, or t
tgatgagcaagttttcactcangtagttccagcaacatnttggtgttagagagactatgccctccttctctctctctctcttgccatgtgacatgtctgttccctctttgtcttctgccatgagtaaaagcttcctgaggcctcaccagaagccaagcagatgctggtgccatgcttgtacagcctgcaaaaccatgagcccaataaacttttctttataaattaaaaaaa

SEQ ID NO: 500112 - DNA, 1377 bp, Homo sapiens
  misc_feature (329)..(329): n is a, c, g, or t
gtgagatcctgagcgctgaaggacatcagtggccggaagcttttctagcgatccattacattgacttcaaacaaatcgtctggatgaatgggtgacgcatgagtcggatggacctaaagaagatcctaggttgcctccagagtataagaggcggccaagatctcctccacgtaaggatagcggacttcctgggtcccgtcctggctctccagagagagaggtggcggactcggggcaggccagggggaaagacttggccaatcgccggtccagatagacagtccggattcaagactgctcgcaaggagtcaggcgagggcctatttccncgtggtgggcagaaggccttgaacctagcgcgcatcgtaccttcctatgcttgcgcgtgctcttgacaaggcctcgaacgcagcgggtaccataccgatacacgcggaaacgggtgggagtgtgcgtattcatcctaggcaaatgtccagtgtgtcccagtcgaacgacgaaggctcgctgagaactctcgtgatttatttcccgcgagagatagagaaggcctgctcgcaggtacgggtgcatgttgggcaagtgtcgcatggcccacgtgaccggggataaggccgataaaaagttcagagactctgtggtaggcgcgcaccttggaattgaagggaactccgcccaagggaccaagctcttgagtggcgacactatcccggtagcacgccacacgcaaaaggggcattttgcacttgtgggaaagtcccgtagagaataggttcatggaattccagaatgaggacacaatcggcaaccaggaaccgagttcacgtatcacgagctcggcggaggaaattgaaaacggaaaccagaattttggacgggtttgcagttatggaagggcttgggggcccgagtacaagccaggcccattcaagaggccccgttgggggctatcggttttcgatacgcgcccgtggataaaatccctcaggaaagggggaacagtcatttcaatcgccaacaagtttttggcccgatgggttccccgtcactctaaccagtgtttggcaggaacgttttctttggacccttccaaaaggtaaactgggagccggttaaggtttcttcccaaaagattggtcctatacaaagacggttcaggtttgtgaaatcaccaaatagttggtttgaaccccgtaaacgaaagaggttcgttcccaaaggggacaaacctggagggaacatcttcaccccgagcgcaacgaggggtgtgactcgcccattcgatccctttccatattggaacgaactttcagcatgggcacgcgttataggtcacacccacaggaacgtttacaatctccgcccgaagaaaaccca

SEQ ID NO: 500113 - DNA, 185 bp, Homo sapiens
  misc_feature (145)..(145): n is a, c, g, or t
ggagtaaatcgtgaaacctctgaaagaatcaggcagtcatccttcagcaaaaagcatccccgatgcaggaagacgaatcgttaaacatcataggtcagctctagccgtctcgagaatgcgtcttcttcgagtggaaaacccgagnatagactgatcagattcttcagcgctaagacaatggacat

SEQ ID NO: 500114 - DNA, 355 bp, Homo sapiens
ggggagtgcgtgtgagaatcgactatctccggtagcgagtgactggaggtgctgacacgagtagctatatccacacccacactaagcatgtgggctatatgagcaagaagctctagacgtatgcggaagcaggactctgtgatactcggatctacacactacagaggccttgactgtctccaaccttacgatatgacagcccagagcgtacatgcacccagctatagagctcctgagaccaacagagcattccacgattctgagatatcatcagatgctgagctcgagactaagttagatcacgaactctctgagctgagcttcagagtgcactgtagcatgtggcatacggccg

SEQ ID NO: 500115 - DNA, 154 bp, Homo sapiens
aggcagtcctcatgtgggcgacgaggccagagcaagagaggcatctcaacctgaaagtaacccactcgagacacggaatcgtcaccaaactgggacagacatggagaaaatctggcaccacaccattctacaaatgagctgcaatgtggcatcc

SEQ ID NO: 500116 - DNA, 106 bp, Homo sapiens
gctccaacagacaagtatgatccagccaaatgtcatagtgctgaagtgagagacctgattcatcttagagcttagagatcatccaagcacatttgggccaattggt

SEQ ID NO: 500117 - DNA, 534 bp, Homo sapiens
  misc_feature (144)..(144): n is a, c, g, or t
  misc_feature (383)..(383): n is a, c, g, or t
ctctcatacaccacacgacgcacgacgatgtgtaatacacgacgcgggacacgacgcacatctcccactatctcgcgagtatcgcagcagcggatatcgtctgcacgagcgcccacacacgtgcacgagacaccacagcgcgcnccgtgtctatatctctctcagcgcgcccgcagagagagatgctcgtctgtgccacgaggctctcgcccacagagagtgtgtgtgtgtgctcagggcgctgtgatatcgtgtgcctagtgtgctcgtggcacaccagacgctgtgtgctcttctcaccacacgagacaccacacgtgcgagcacagagcctctgtgatcacgcgcgcctgtgcgctctctttgtagacacagagtgtganatatcacacacgtcgtgtaagaagaggcgctatagggggcgcccctctcgtgtctcccgctgtgatatacgctcgctgtgtcctcacgagagcggagagccccttcagaggcacagagacgcacatctctcacagtcatctctgcgacgtg

SEQ ID NO: 500118 - DNA, 570 bp, Homo sapiens
  misc_feature (14)..(14): n is a, c, g, or t
  misc_feature (50)..(50): n is a, c, g, or t
  misc_feature (56)..(56): n is a, c, g, or t
  misc_feature (108)..(108): n is a, c, g, or t
  misc_feature (126)..(126): n is a, c, g, or t
aaaaacccttcaanccctttgttcaaaacaaaacctgtcctccgaggccncttgantgggcctccatcctgaaaataatgacaacacatagcctaaggaacctccccngttgccaaattaacctgnccttaacccctttaaacctgttcctggtccatgacctcaggcctgaaggttaaggctgaagccccacccccaagaatgttcccttacatttggtgtggtatgctgatgtgcactgggactctacacagagctgatattgcttgtgatgcccatgaatgtgccactgtgcgtgagaatcctctggggaatgcttgtggaaaatgcagacacctgggccttagtttgagtttctgattcaatgggtctgaggtaggctgagatgctgcatctgttacagttcctccaagaggttcagctgcaggcagctcatggaccaactgagaaacacagatttgcagagcgcttgctgtgggccaagaattgtctaaacgctacataagtcattttacgtatcctttaaagtgcgtcctgttatcatctccattatacagatacaaaaaaaaa

SEQ ID NO: 500119 - DNA, 228 bp, Homo sapiens
ctcacagtcacgcatcacagtcacgcctcacagtcacacctcacagtcacacctcacagtccacacctacacagtcagactcacagtcacagctcacagtaaacagctcaaagtccacacctcacagtacaacagctcacagtcatacctcagagtcaaacctcacagaccaaactaacactcagggttgatacctcaaagacaacaccccatggacaaataactcac

SEQ ID NO: 500120 - DNA, 115 bp, Homo sapiens
ctctgaccgacgatatccgctcctcaatctgcccccatcctagaacgtgctggcagctttctccatccgatctgcaatggttcacgggcgctgaggagagggctgaccgactgct

SEQ ID NO: 500121 - DNA, 894 bp, Homo sapiens
cgggcccaacatgatcctttggtcacggtatccctgaaggtgcatcccacttggagtctgtccggactctttggggcctttagcatttccgaggacaatgaatggaagtgcggcaatgaacggcatctcgtgaaaagggctttgggaaagcttcacggttccttccagtggaagaacgatataggcacaaggattcttgcgaacttggcacccttatgatcgccatctctagaaggaaggctggctccgcctcgtcgtatgacagtgttgaggactgtagggctacacaggcaccagagcactttacatccgagagttctgccatcattggtcctagccgtgcgccaccgttactcgtggacctccctagcctcgcgactcccatgtggcactcccaaagaggagcctcgtgccgctagtgctgctcgaccgtgcgcatccgcagaaaggaatgccatcgtgtgtccgtcgtgtctttccactgagtgtcgagcggtggccataggtctaggtcggactaaactctccatgttctcagctatgctcccagcgtcccttcgccactgggtgtccgtcatcatgtggctggtgtgatcatgatagctgcttgttgccctgcctctccatgttccctatgtgagtagtctgaatgtcatggcaaagccgttagtaatccagtgagctacagcttgcctggcagcatccttgtggtgtagataaattagtcgacagcaactcagcactggggacaggaattgcaaagtacggggacatagatgcagacagttgttgagatttggggatagtcgggcttgtgagcggtgcccatttccagaagaagccgttcagcccttctgagtccccggccatatacccacgtgcgcgagttgaccc

SEQ ID NO: 500122 - DNA, 183 bp, Homo sapiens
gaggatccggctgagcagctgcagggagaagagctctggcgcggcgttgtgcgatgctggagcaaggaacagaatcagaagcaggacagagattgttcttctcagcggaatgggagagccaggaggaagacaacctgggagaagaaaggagggagagcgatgaggaagaaatcgccagctcag

SEQ ID NO: 500123 - DNA, 840 bp, Homo sapiens
  misc_feature (122)..(122): n is a, c, g, or t
gatatccgtagtgcatagagctagctgagatgtaagcgtgtccgcactctcggatacccgcatattcagcttgcaagcatggcaatgatacctctactgacctgcaagaacgactggattgntacgacacttcatgagacaggccttgcaagcagctattttgagccatagagtgtgctgaatgagtacctatatgcacactagaggaacttgcgtaaacctagtaaagtggaagatcctcataggcgccattaattcccccactagataagctacggatgtaatacaagagaaccatttgcattccattgactcgattagaattgccttgaattagggtcccttggggccacagcaaactgcgcatatatcccgctgaacatattcttggtagcccaaggtgcactgcgcgtcaccgtaccacatgtacttgcacatcagaattatggagaaacccaggtccgcaaaccgcattcagcacacactttaactacagaaacagcgcatttacgcgctgatcgcctatccgtaactaccgtcgaatgcgaccacattgcgccctaaattcatttaaattggctacgtggaactcttttcgctcacaattgattgtccgcgtatggatacagcccttttggggataccacgaagaagcttaacacgaatgtacattgcacgccaccgttctcgcattggacaagacctgcgatttcaagggcggacacggcggagcatctccttacagcactttccggttgtacatgggagtcccacacggttaaagacctaaatcgacaacgaagattactggcaaccgcgaccattggccttgaacccagc

SEQ ID NO: 500124 - DNA, 401 bp, Homo sapiens
cacgtattgtgataggtatatgaactggcacctgcccagacaggaaccaggcagtaagattagcacctggaaagtgccgaacttcaggaatgggaagaaagacgagatgccctagagatgaagctcaacacagcacgaaaagatcacttaattggcccaaatgataatgacttgggaaaatatagttgttggtttaaagattgtaaactaatatgctggctttatgtatgatacctaatcagagcattgaccagaaaaattgaaagtgttctgaggtacatagcagaggagctgcagattaccagcatgtatgggcgtatatcgttcctcctgagcagaaggccagagtaggtaggaaacagggctggcccacaggcccggacacgctctcacggaaccac

SEQ ID NO: 500125 - DNA, 364 bp, Homo sapiens
gcgagcgtccttaaatatgcggaatcaccatggacggctgggaccctatacacatatactgaaaactggagggtcttcaaggctctcatcgctgctcagtacagcgagactcaggtccgcgtagctctccgcaccaccccattatccatacttggacaaaccaaccgcacccctaaatatctccgcaaatttcctgccggcaaggtcccagcatcagagggtagatgatggatactgtgtgtatgagagcaacgccattgactactatagtgagcaaagaggagctgcgggcacgtactccagaggcagcagcccaggtggtgcagtgtgtgagctaatgctgattcccgatatagtgccccac

SEQ ID NO: 500126 - DNA, 132 bp, Homo sapiens
tttttccctttggcccttttttggggccccttttgacccagttttttccaaaaagcggggtggggccggttcgggttttccggggttttttttgcccccgggtccgcccccgggtccccccccgggttcgga

SEQ ID NO: 500127 - DNA, 527 bp, Homo sapiens
cagattcgaacagtgcccccatagtgtctcttttcacagctggccagaaccggaaatgattcattctcataaattcagtgtgtctcagaacaatcacaacaacatagggagttgtatgactgatacggcctcttccagaaagttttaatcaaagcagtttaattaaggtatcaaaaatatctttgcttactatcaagaagtgtcaaataggttcagcttgctgccaaaatatggatcatttatgaagcaggttcatattttagaggtgttaataaaatcctcatcggaaaagatccaaagtgcaaggatttgattataaacataatttcctagactgaaagtttttggaaaagatgcatggtctgagtcaggccttctggttatattgtgcagtttcaaaagaactatttaaaactcttgaaaactcatgtaaattaaaatcatagggtgaaaattgtatttgttaaaataccttaataatttaaaatgacctgatttcctggaacatttattattccaaaggtgga

SEQ ID NO: 500128 - DNA, 923 bp, Homo sapiens
  misc_feature (217)..(217): n is a, c, g, or t
  misc_feature (310)..(310): n is a, c, g, or t
gcaacatgagagctgaggaaacatgacagcaaccaagtcgtcgatctcgtcaccattgggatgataagcctgtaggacccccactggatgatctcccatcgttggtgaagattagaccgtggcaatgtgaggcactgtgcatcgcgatgtctgaattgattcgggaatgtaacggatgagtgacgtgaggccttgtccggcacaacccgcgattggnagcctttccgtgcacacagacgagcagcgcgtgagagcagcgcaaacgagtcaatgtcgccggaatcagctgagcttaaagtaagacactggnacatttctgttgagaaaaaccatcaactgatcaggacacgatcatcggaccaatcgataaagaaaggagtgttagattcactcttttttaaaagaaaatggaagacgagccacgttagtctccttgcactagagaaaggcttaagaaagtgagatgtattcatgtcgttctagcggtcgatgtgcactgagatgtggagaatgcacttgtgctatttggggcggacgtgtagtggaggtaagcatgagtggtgttcacgtcgggtttggatagttaattggatttgtgttcatagtggtggctatgtgagcctatggagtttatatgtagagaatgagtcgattgagatgcacctgtggttgcatcaaaggcacacaacacattcagacatgtatccctgtggccactattggttagcgtgtgatgctaatgccagcgtaagaaagagcagggtccaaggggagttttttatacaggctcctgagaactgaggtgttgtggtgaagttgaggggggtaatcccaagggtgggttcaacctttcaaggttgagttgcagttttacttttttcaccaggaccaaggaagggggttgagatgtgaatttgggaaaa

SEQ ID NO: 500129 - DNA, 578 bp, Homo sapiens
tgagtgagagggaaacagactacaatcggtcctaatgaaaagggagaaagatggagatatgaagatgactccaattttagttttaatcaaggtactgatttgtggaggtatctttgacacatcagttgacctctgagtttcagattctatacctgtgaaatgttagaataaaaataacaatatcttacaacatttacttgaatattaaatgaagatcacacatatatatggaatatattttataatgtggaaaaggctaaagctgtatatgaactaactcctatatttcataaataagattttgatgatgatgagatttgagattactattactaatattggttaaaagtttgcatttcataacagaggtaaaaattgtaaaagctattaaaagaaaaaccacaattgttcaggagagatacctactgaccttttttagctctcttaaatggattctttttcaacttccaaaggtggatgtttcaaccaaaagccttttaaccccttcccctagtacacaccggaaaaaccagccggtccctttcttacccctggatggagctctttaaactgggcac

SEQ ID NO: 500130 - DNA, 502 bp, Homo sapiens
cagaacagagacgaaaaggctacctctcctaccccagttaagtgttcaaaggggatgtgagggcctccacgaatgcagggaggcagctgtgtaatcctatgtcagctctcttaggaagccccagtacttatatttggcatgcacttgcccttaaaaacttatgatttgtgagtccaggaacaatttactatttttaaaatattttgctgcttctgttctgggtctgaaatcccttttgtgccagatgccagtactgtctacccaattgctccagggattatatgcacagattcagtccccatagggtattcagatcatctgcttctctgaaggagtaaatgtgttttgttcctaggtccagaggagcttgttttccttgtcctttgttcccaccttcccaagaacattacccagcccataagagacattctcagatgaaactctgttttcttgcctcagtcagctctagccttttttttgtaggaataaattcttttttctc

SEQ ID NO: 500131 - DNA, 726 bp, Homo sapiens
gcccacaaaccccatgtgactggttcgaaggacccagagcataaaggtctctcaggaaaccaatgtccaaaaccctagctggcggtacagtcatgctgtgctccaatcccttatccccaggatttacggcgtgcgtttcatggcgcatacgatgcgaggtctctagagtgagttgcttgtatgtgacgatctagagttatcacattcttgttgcaccaccgctggagtgcaatggtcaccattctcggctcaactggaacctccacctcctggttcaagcgattctcaggcctcagcttcccaagtagttgggattacaggcgcctgccaccacacctggctaattttgtatttttagtagagatggggtttctccatgttggtcaggctggtctcaaactcccgacctcaagtgatctgcccgccttggcctcccaaagtgctgggattacaggcgtgagccaccgcaccggcccacttgctttgctttttaagaaaatgtatgtatcttcaatgggttagggactaatatctgcttccccaacccttcaccgcgtacctctttagtgccagcaccttatacatccaggccaaatggtatcacccttttgtgccttatccctcgagctgtgacacacaaatgtcatcttttcagatagtttgggccaccaccaacaagatcggttgtgctgtgaacacctgccggaagatgactgtctggggaga

SEQ ID NO: 500132 - DNA, 313 bp, Homo sapiens
accttcccagacctgaaggatgattaggcacacgaaacagttgcgactgccagtgcatgacatgactgtccaacatgactgaacacctcgcttctactaataatacaaagcacttgcggctgtcgctgatgggcaggcgtgacctgccgagaatcagtgacacatgggcacgcgagtgtcaataggggcctgttgctttccagtaacaaggctttaagctccgcccgagcctcaatgctaaagcagacacacacatgaactgtcccaaagcagctggttcaggagcaccctgagggagagggaccacctatca

SEQ ID NO: 500133 - DNA, 104 bp, Homo sapiens
atgcgtcgggccgggcgttaacgagaaagtttacgccgacactggcctttattagcgcgtatggcctcggccttcgttccccaaggcgtgcgcttcctgttctc

SEQ ID NO: 500134 - DNA, 267 bp, Homo sapiens
  misc_feature (9)..(9): n is a, c, g, or t
  misc_feature (16)..(16): n is a, c, g, or t
  misc_feature (24)..(24): n is a, c, g, or t
  misc_feature (32)..(32): n is a, c, g, or t
  misc_feature (46)..(46): n is a, c, g, or t
  misc_feature (52)..(52): n is a, c, g, or t
  misc_feature (76)..(76): n is a, c, g, or t
  misc_feature (245)..(245): n is a, c, g, or t
gaattcggnacgagtnagaccggnctcatccngaggtgcgaccggnagttgnacaacccttccagacaaagcagtngagtcgagcctcctgtccagatcaggaggggagatagggctcagaggagggggtgccggaaaacctcggtgttcctctcgaaggagaccaggatttcggggaactttgtgggtcgcatcaagggtaccaagtgccctttcgacctacaattcctaacgtgggacttctnctgaggcgcttgtagcggtgaa

SEQ ID NO: 500135 - DNA, 859 bp, Homo sapiens
  misc_feature (211)..(211): n is a, c, g, or t
gagtgtcctgagaggtcaggatcgctgtcagtactatggccgcatgaactatgggacatagagctatgtgactatcgataacatagtggcatacttcccagcattattagacgaatgcgaatgattatgcaagggtacgctcgagttaggaaaacttagtccaagagagacacgctctggacgtgcacaaacgggcttgataggggatccngattggggcccgaaaatggatatgccttagggaagcatggacatgtgcgtaggctttttgccaagagcatgtcgttatccttttcttgatagtcattccttgtgacaaggcgattcgagagatcggtggatttggcatgcacattgaagtcggtcatgctagtaggaagctcgaatattacgctggagagatcccctcgtaaatatacgggataatgaggcatccactaggaaagatcatatgaccctggaaaggcagtccactaagtggtttcgttaacctctctcaaaatagagatattcttacgtctgctaaagcctacttgttctggttttagtcccgtctacacgatatgattcaggttacggatttctcacttccaaggtatcacctatatactattttgcctgcagtgaaaacctggccaggctatacgttccccaatggaattaatccatatttgggaggtcggcgccacacggcgttacccccaaaaaaagccccattctttttaaatacacattgttcccaattggcgttccttgcgagtccccgttggaggtaccacgctaaaccactttggtgcctttaggtagacagaacctaggggaagatcccccgactgcaacattgactagcctttggatg

SEQ ID NO: 500136 - DNA, 130 bp, Homo sapiens
gtccggtctgctccctcttcgactgtggggcgcgctccgacgatagctgtggtcccctgggccgcttcctgttggcctgtcttagtctattttgctatatttggggggtgtgaagtagggaggcagcagg

SEQ ID NO: 500137 - DNA, 629 bp, Homo sapiens
ggcccctggctactgaggagtcgtcttcatcttcagaagaggaggaagtagccagctcccctgagcccccccgatccagtccaaacggcctcggcgggaactacgggagcaaaggcctcaaggtgtgtggggtgcgtgggtgcctggaggctggagcctgtgtgcctgtgtcactcctggttccctgagtcgtgatgaatacgtggcccacatgaagaaggagcatggcaggtcagtgaaaaagttcccctgtcagcctgtgtgagcgctcccttctgctccgaccccagcctgaggcgccatgtgcagagttaatcactgagggctatcgagagctgagtttacccctgcaggtattgctacatgagggcatagaagcgcatcttcagcagccgcctgatcctagagaaagatgtccaggtccggcacggacttgcaggttggggcaccagtgccccatggctcgaggggaccaccttgagctctggggttccagtgccagagcccagggccaggtcggagacgccgacagtcttctgactcttgcagtgaggaggcctgacagacgaaacgcagcaagtccggcaggtgcggactggatctggatggcatggcctctgctgctaccg

SEQ ID NO: 500138 - DNA, 373 bp, Homo sapiens
cagcctgcccctgagccctgttccgagtcgtccctgcgctttccgcacgcgcgcgctcgaggcggcacgaggaagatcgtatcgtatgtcgtatccagaactccatctttcgacgcttgctgatgcagtaaggctgatgacctgcttcctgctggcactgacgatatatccatataagaatcaaagagaaacggaggaagaccttatactgtcaagggatcgtgatgatacgataaaaagaactagtgaaggcgttagaaaaagttgctgcaaggtactgtaattgagcatccggaatatggagaagtcattcagtacagggtgacaagcaagacatatgcagtcctcgtaagatggactgctaaggacgatc

SEQ ID NO: 500139 - DNA, 465 bp, Homo sapiens
gtgaggaatggaaaagtgtttaaagcacagtgagcaagaaatgagtctgagagcagggaggtgtctctcactgaagcacagtgccttcgcgtttcatctgggaataaggtttgtcgcataagagagtgaagtgtttttgtccccgtggatgtaagaggattgttgtagactttagaattgggacttacctaacaagagtataaattgacttgggttgcaagcactgagcactgttacttctatcacgtctctcttttatttctgggatagtaaaacaggctataagtttctatggttgcccaagggcagagcaaggaatatctggtgtttcttgtgatgataatattttaatttgaaatatccctccctcatacaagtgtatgttaccattttaatataattctttgggtatctttccttctggttttgtgaagatttttgtggcatggattgcttgttccgctg

SEQ ID NO: 500140 - DNA, 236 bp, Homo sapiens
attcaccttgagatccagtgagtttgacaccaggctgcccaacatggtggaaccccaatctctactaaaaatacaaaaatttagccaggcatggtgggcgtgggcctataatcccaagctgctcagggggcgggggtaggagaataggcttgaaaccgggaggtggaggttgcagtgggcccaagtatcaagccattgcactctagcctgggcagcccgggccaaaactccatctc

SEQ ID NO: 500141 - DNA, 264 bp, Homo sapiens
  misc_feature (190)..(190): n is a, c, g, or t
  misc_feature (227)..(227): n is a, c, g, or t
tcatctagaggatctcaagtcagcaacagtacgcggcctttatccccattcttctgggatcaagacaattctcctgcctaccagtatcctgagatagacgggaatcacaggtgcgcgccaccatgcctggctaattatttttgtgtatgtattagtagagatggagtttcagcatgtaggcccagcctgntcgtgaacgtcctggccgtgaaggtgatgtgcccacncttggacgttccaaacgtgctagcgattacatggccg

SEQ ID NO: 500142 - DNA, 741 bp, Homo sapiens
  misc_feature (25)..(25): n is a, c, g, or t
  misc_feature (66)..(66): n is a, c, g, or t
  misc_feature (76)..(76): n is a, c, g, or t
  misc_feature (81)..(83): n is a, c, g, or t
  misc_feature (129)..(129): n is a, c, g, or t
  misc_feature (305)..(305): n is a, c, g, or t
  misc_feature (360)..(361): n is a, c, g, or t
  misc_feature (365)..(366): n is a, c, g, or t
  misc_feature (374)..(374): n is a, c, g, or t
  misc_feature (390)..(390): n is a, c, g, or t
  misc_feature (418)..(418): n is a, c, g, or t
  misc_feature (426)..(426): n is a, c, g, or t
  misc_feature (438)..(439): n is a, c, g, or t
  misc_feature (441)..(441): n is a, c, g, or t
  misc_feature (444)..(444): n is a, c, g, or t
  misc_feature (446)..(446): n is a, c, g, or t
  misc_feature (450)..(450): n is a, c, g, or t
  misc_feature (464)..(464): n is a, c, g, or t
  misc_feature (467)..(468): n is a, c, g, or t
  misc_feature (470)..(470): n is a, c, g, or t
  misc_feature (478)..(479): n is a, c, g, or t
  misc_feature (494)..(494): n is a, c, g, or t
  misc_feature (504)..(504): n is a, c, g, or t
  misc_feature (507)..(508): n is a, c, g, or t
  misc_feature (531)..(531): n is a, c, g, or t
  misc_feature (533)..(533): n is a, c, g, or t
  misc_feature (540)..(540): n is a, c, g, or t
  misc_feature (569)..(569): n is a, c, g, or t
  misc_feature (622)..(622): n is a, c, g, or t
  misc_feature (640)..(640): n is a, c, g, or t
  misc_feature (651)..(651): n is a, c, g, or t
  misc_feature (720)..(720): n is a, c, g, or t
tcggattagggttacagcttatttnccagggatggttcgaggaagggagttggggtggggggtacncctttatggntcttnnnaggttacatgagaactggtgatataggtggggtctcaagtagaagntttgaattagtgtttattaacaaacttaatcctttgttctaaaccaggctctagcttaattcaaagataaaggaggggttaaagattaagaaaaatggaatttttttcccacatcaatgatataccaagagaagttaataggtctaaattgtagatgtagggaaataaaaaggtcnaattataattttttataaaaactaatttttttattacgcttaatttttttatttnnaaanntttgaganaaagttttgttttgtngtttaggttggtgtgttgtgaggatgtnattgggtnaataaaaaattnnangtntnaggnttaagtgaatattncanntnagccttannaatagaaggtattanaggcatgggncannatgcctggctaatttttgtattntntgtaganacggggtttcgttatgttgcccaggctgntctcgaactcctgggctcaagtgatctgcccccctcggcctcccaaagtgccnggattataggtatgagcnacagcacctancccaaactacaaattttaatagaattttaaacccaacccactggccaaaaatcactcggtcacgaattnctaatccacaatcacatcagt

SEQ ID NO: 500143 - DNA, 158 bp, Homo sapiens
ctcatttttgcacacacgccctcctggggcccatgaaaaaggggtttgctttcccttcgccttcccccatgattgtaagtttcctgaggcctcctagccatgcttcctgttaaatttgcaaaactgggagtcaattaaacctctttttttaataatta

SEQ ID NO: 500144 - DNA, 509 bp, Homo sapiens
cgcaagatttcccttaagcaacccatgtaaactcatgccccagaaagggatgtatgtcgctgtcccagagaaggctgtggaaggacctatacaactgtgttttatctccaaagccatatcctctccttccatgaggaaagccgcccttttgtgggtggacatgctggctgtggcaaaacctttgcaatgaaacaaagtctccctaggcctgctgttggcactggtcccgcccagaagaaaatgaagctcaaagtccaaaaatttcgtgaaaaacggggtttggcctctcctctcagtggatatatccccccccaaagggaacaagggccagggttatctttggggccaaacggagagtcccccccctgggtggaagaccaaatgctctcgcccggtgccggacttacccctgggtaagaactgccctgctttgtttaaagggctgccggcccaggggcgggctttctctccgagcctgcttttttttttttaaatttctgatgccgaga

SEQ ID NO: 500145 - DNA, 951 bp, Homo sapiens
ttcagggtagagtcaatcgtgcaggccatgaagtcccagttcgagcgggactctgcagtggtccgggatctgagcagtagctgaggacgaagaagaagcatgctggtcagacaggtgcgggagatggatggcagagctggaggacgatgaggaaagcagtcgctcgatggcatgtggccgcccggaatgaagctggagatggacctgaatgacctggaggctcacgtcgactcggccaacaaagaaccgggacgaagccatcaaacagctgcggaagctgcaggcccagatgcaaggactgcatgcgcgagcctggatgacacccgtgcctctcgtgaggagatcctggcccaggccaaagagaacgagaagaagctgacagagcaatggaggccgagatgatccagttgcaggaggaactggcaggcccgcggagcgttgccaagcgccagtgcctagcaggagccgggatgagctggctcgactgcagatcggccaaacagcatgcggcacaaggaccctggcgtaagaggacgaacgcggggtttggaagggcccgaattagccagcttgcacggaggacgcctggcggagcgaccaggggcaacacggcagcttgatctaagaccggttgacgcaaggccaacctgcagaatcgaccagatcaacagcgaacctgaacttgtagcgcagccaggccccaaaagaacgagcatgcgtcggacgcagctggaacggcctgaaccaggcacgcttaaggtcaagcatgccgggagattgacgggccctgttaacgtccacataaacagggcttctattacgcgcccttgaggccacacaatgtcccgattggcacgtacacttgacacagatgacacgcatcgcagggcgagccttcaacaagtgtagtagaacgaacaaaacctacaggatagatcaacggtagaacaa

SEQ ID NO: 500146 - DNA, 323 bp, Homo sapiens
  misc_feature (180)..(180): n is a, c, g, or t
  misc_feature (184)..(184): n is a, c, g, or t
  misc_feature (188)..(188): n is a, c, g, or t
  misc_feature (239)..(239): n is a, c, g, or t
  misc_feature (261)..(261): n is a, c, g, or t
  misc_feature (270)..(270): n is a, c, g, or t
  misc_feature (276)..(276): n is a, c, g, or t
agtttaccgttgccatgtcaatacccagggagttaccgcccctttccgtggcagtaacccaataattaccaccccttccctagaaatttctgcataaaccgccccttaatctgtatgcaattaaaagtgtgtgtgtgtgagtgtgtgtgtgtgtgtgtgtgtgtgtatgtgtgtgtgtgngtgnatanatatatatatatatatatatatataaaactgcaaaactgccctgagctgcncctctctgcctatgggggagcnctgctctgnaggggnagtcacggagctgtaaccctgcctcttcaataaagctgttttcttct

SEQ ID NO: 500147 - DNA, 669 bp, Homo sapiens
ccagaggattaaccggcagaagacaatgcagctaataattatttaaaacactcaagaaggccgggcacgatggatcatatctgtaatcccagcactttgggaggccaaggcaggcggatcacaaggtcaggagtttgagaccagcctggccaatatggtgaaaccccatctctactaaaaatttaaaaactagccagacatggtggtgggcacctgtagtcccagctacttgggaggctgagactatagggatgcataactacaccaagctaattaaaaaaattttttttgtagagatgaggtctcactatattgcccaagctggtctcaaactcctggcctcaagcagttctgccacattggactcccaaagtgctgagatgtgagccactgcacccgaccttctcctgaactttttgtctttacgtgatagagtctcactctgtcacccatgttggagtgcagtggcacgatttcagctcactgcaacctccgtctcccaggctaaagcgatcttcccatctctgcctcctgagcaagctaggaccacagggcacactaccacgcccaattattattatcattatttttggtatatcggggtagatacgggggttcaccgtgtagcccaggctggtttcgagcatctgagctcaggcgatcaactgt

SEQ ID NO: 500148 - DNA, 950 bp, Homo sapiens
ttttaaaatttctgttaaggatttcttcttggactgggtgtggtgcctcacgcctataatctcagcactctgggaggctaaagtggcggattacttgagctcaggagttgagactagcttgggcaacatgacaaaaccccatctctactaaaaatacaaaaattagccgggcatggtggcatgcacctgtaatcccagctatgtgggaggctgaggcataagaatcacttgaactccagaggcagaggttgcagtgagccaagattgtgccactgcactccagcctgggtgacagagtgaaactctgtttttaaaaaacaaaaaaaaaaaaaaaaattctcttggaacccattattgggtttaacaaggtggtgctggttcaatatctccaagatattttggaaaatattttctctagcttaccattctctgggaactacacgtggtacgctcacatcctggcaggcgggccttaaggagcaagaccgccaaactagatggctatcccctataacgtacggcaacagaatcggagattccactgggcccaagaaggtggtccacccatcggggagaaactggtccacgctggcgcagccttgccaaacagaacggtgagcatcccgggcaaacccggtcggcgatagaagcgacagtcctaatcaaattggcaatcaccacctgggccttccgccaacagggcacccgacagcacagcctcgacgccccttacacacccaggaggccaactccaccgagcgagaaaagacggccagccaaccagggcgaatcctctgcccgaaaaccggacaaggatggcctcaccagtggcgcacgacccccatagcgctggcaacgacgttcccccgccagatggggctacccccgcgcagcgcacgcaacaccagctcaaacacagaccacgcgcccgccaggccactggagacgca

SEQ ID NO: 500149 - DNA, 108 bp, Homo sapiens
gcaggacagcagtgagatagagatgtgtgcagcgatgccgtggattaattttttcacttttggtggagacagggtctctctatgttgcccaggctcatcttgaactct

SEQ ID NO: 500150 - DNA, 955 bp, Homo sapiens
gagatgggtcatgagaagggaattctgtggtatgatcggacatgacagctgagagataacccttctacctaggaactccggagtgataacttaccacagactgaaggcaggagaggagtactaagacatgatgagttcaagacgccttggctgaaatgccacagagggtccgtgattacaagtcgtgtctattctgatacttcttactatgggaatacaatcttatccagaattgatgtaccagcctctgtgagtactttgcctgttcacaacctaacgattcaactgctgaataaagaccattagtgacaatctaacgagctgatgagatttgggcagaaatagtcagtgccacgtagtcaatgactacggacggaaagtgctgattactgttctcttcgcttaaagttttccagggcctttttctgtgcccaggctggagtgcagtggaggcaatcttggcctcaccacaatctctcctcctggatgcaacgcaattctcctgcctgaagctcccgagatacctgtgattactggctgcgcaatatcgcggatattctcgtatttagctagagatggggttaaccgtggtcggcaaggctgctccttgaatctcctgaacctcgctgattacgacctgctcgccctccctacagtgtgggactcacattgctgatccactgtgccggccaacctggtacattctgacatccttctgctcaacctctggcaatctctccgtactctgtgcctacctattcagacaggcgacacaccctcttgaatacaaccggctcgattgcttagacttctccactgccacgatacactatcgacacaacgacataagaacgtacatccgaacaccctctcatgacaacaacaatcgacgcctacatataatattcgcctccttacatctcactccgtttctctcacctctactttatctctc

SEQ ID NO: 500151 - DNA, 141 bp, Homo sapiens
gtatgtgctgtctcgtgtaagatcgcgccatcattggtttatgctaactgtgttggatagtaggcctagtatgaggagcgtcatggagtggaagtgaaatcgacatggctaggcaggcggtcatcaagagggggatcctct

SEQ ID NO: 500152 - DNA, 115 bp, Homo sapiens
agtaccatggagcgtctggccacctcgggaatgtacgacttcactttgtagcgccggtagtacctgattattgtcattgctgcctggggcttcttttgctattgaaacttctaaa

SEQ ID NO: 500153 - DNA, 551 bp, Homo sapiens
  misc_feature (445)..(445): n is a, c, g, or t
  misc_feature (460)..(460): n is a, c, g, or t
  misc_feature (467)..(467): n is a, c, g, or t
  misc_feature (486)..(486): n is a, c, g, or t
  misc_feature (525)..(525): n is a, c, g, or t
cccgtttgttcctgtttcataggctcttataggaattttaaagtcaaaatatgctttgagaaagaaataagatccacacatcatgaaagagagagtcgatgacatttgaaattcttttattattcatttttttttttttttttttttttggagatagtatcttgctctgttgcccaggctggagggcagtggtacaatcatggctcactgcagcctcaatcccttgggctcaagtgatcctcctgcctcagcctcctgagtagctaggagtacagggcacgcaccaccatacctgggctaatttttaaaagttttttataggagacagagtctttgcccatgttgcccatgttggtctcgaacaccgggggcttcaagcgatccacccaccttcatccttccaatcaatttttaaccttatatcacattcaccttcctaaggagntatattttaataagncccttgnaggatgttttgaaaatttnctgctgatttcaatgggggaagaggaacattttagaccnactgggggtttatttaacttcatatt

SEQ ID NO: 500154 - DNA, 1096 bp, Homo sapiens
  misc_feature (574)..(574): n is a, c, g, or t
gggaaggaggtgtgaaaggaggtcggatgggactcgaggctgcctgggctgagtgtgtcgtgggccgtcaaggtcacttaggaaagtggatgtgggaatagtaagcattccgctaatacatgaatgatcccgcaaacttctgagctatatctactgagccggtgagctggattggtgcacgagcaactgggggtggaactgtcagcttccctaaaggcacaggccagcatccaagctggtgctggagacggcgagatgggagagagtcggaaggtcaaactgaaaaaggtccaagatcaatatgcccaagtgttaatgtctccaaatgctaggcgggaacaggtggtgtcagctggtctcaccagaaggcatcacattgtgctgggtccagaaggtgacctgatagaagttcaaaggcgcagccgtggggcgtctcgtggaaggagagggcagacggccgagagcactcttgcaccgagacggcgaaattctccttactggaacaaggtaagaagccacgggcaccgatgcagaagattcgagtcccaggtgactgagaacgaggagttctctnggacctgtccacccccgagcggcggacgcctggaggcttgaaggtgggcgaaagtagtctctgggacacggcgggaacacgcctaggcagggcacatgacgggagaagactgagagtaacaggcccactgggggtggcctgggcccggtcaaacgcagccacaagtggacaacagggacagccgattaggcgagcagcaatgcatgcagcactgcgccaaaggtccctggggggcaatggggggatatcgccttggacctacgcggaacgacaacggtacccacgaatccaggacgcgcatcaccgtcctgtgagcgtagccaaaatccatggacggtggggggcacagcgtaccgcgggtggtcaacgacattgcacccaggcatgtcgcctcgcaagaggtgcgaaatggcatggacgcaaggacaggacccaaacagaaaagagaaaatgaagagtaagccaaggggcgccaaagggtaactggtagaggcacccaataagtacctaagtactcacacc

SEQ ID NO: 500155 - DNA, 285 bp, Homo sapiens
tagtgatagcatgttctagaaagtctgattatatccgagtccactttcttctcgaggaggctgctggcagctggccgtgcccatggtagagcgcgatcctgcacgagtaaagctggccgaccattacaaggcgctgcatatcctggtgcacgagctgcaggactttgcagcggccgaggactactgcctgtgatgctcctagggccgatatccatcaccatcgccagcaactctttcatcatcgctgcttgccatctacctgcgtgctggccctactgcccaaga

SEQ ID NO: 500156 - DNA, 228 bp, Homo sapiens
aaaaaaagaaaaaaaagacaaacaaaccaggtaggtggatttcattaaacaatggaggacgggctcccttgtccccggccagggcctgtgagggaaatgtaaagggcatgttccttttaaacaaagccaagtcatcagggccctccttgtgtttgagacgctagagttcgtcaaggaagcccggtttcctatggcgcccgcctagggaagtgaatcaagaatctcagg

SEQ ID NO: 500157 - DNA, 218 bp, Homo sapiens
tgaacattcgtgtccatgtcctccaagctatatacaccgtaatggcccaccataattacccccatactccttacactattcctcatcacccaatctaaaaatattaagacacaacactaccacgctaccgtccctctacctaaatgcccataaaagataataaaattatatacaacacctcgtgaggaaccaataatgtaacgaagaatcttgttcga

SEQ ID NO: 500158 - DNA, 509 bp, Homo sapiens
  misc_feature (284)..(284): n is a, c, g, or t
  misc_feature (318)..(318): n is a, c, g, or t
  misc_feature (446)..(446): n is a, c, g, or t
  misc_feature (470)..(470): n is a, c, g, or t
  misc_feature (483)..(483): n is a, c, g, or t
  misc_feature (495)..(495): n is a, c, g, or t
aagcccattctctcgtttcccatctttaaaccattcttggtaccaacttgaagctccaaatacctggcaggcaccctctggcctctactggatctgtgggccacaagcatatcgacaactgccagctaaatggtcaggggcctgtgtactggggacaattaggccgtccttcttcctaatgcccctaaaacagggagaagccttaggataccccatctatgatgaaactaaaaggaaaagcaaaagaggcataactataggagattggaaggacagtgaatggnctcctgaaagaataattcaatattatgggccagncacctgggcagaagatggaatgtggggataccgcaccccagtttaaatgcttaaccgcattattagattgcaggcaggactagaatcattaccaatgaaactgaggggcctggatctttttggccagnaagcacaaaaaatgagaatttcanttttcaaataggnttggcctagatncccccagccaggaa

SEQ ID NO: 500159 - DNA, 526 bp, Homo sapiens
  misc_feature (1)..(1): n is a, c, g, or t
  misc_feature (137)..(137): n is a, c, g, or t
  misc_feature (139)..(139): n is a, c, g, or t
  misc_feature (142)..(142): n is a, c, g, or t
  misc_feature (154)..(154): n is a, c, g, or t
  misc_feature (157)..(157): n is a, c, g, or t
  misc_feature (159)..(159): n is a, c, g, or t
  misc_feature (181)..(182): n is a, c, g, or t
  misc_feature (193)..(193): n is a, c, g, or t
  misc_feature (195)..(197): n is a, c, g, or t
  misc_feature (207)..(207): n is a, c, g, or t
  misc_feature (211)..(211): n is a, c, g, or t
  misc_feature (236)..(236): n is a, c, g, or t
  misc_feature (269)..(269): n is a, c, g, or t
  misc_feature (274)..(274): n is a, c, g, or t
  misc_feature (277)..(277): n is a, c, g, or t
  misc_feature (297)..(297): n is a, c, g, or t
  misc_feature (302)..(302): n is a, c, g, or t
  misc_feature (313)..(313): n is a, c, g, or t
  misc_feature (318)..(318): n is a, c, g, or t
  misc_feature (344)..(345): n is a, c, g, or t
  misc_feature (368)..(368): n is a, c, g, or t
  misc_feature (405)..(405): n is a, c, g, or t
  misc_feature (426)..(426): n is a, c, g, or t
  misc_feature (506)..(506): n is a, c, g, or t
ntatagaaaagtttgtaaaaaaccaagctggtacggtccggaatatacccgggataccggagggtggggacggcgaagagttggaagccggcgctccgctccgctccaactcggtttcatgtcccgccaaacgaaananaanttcctgcggcantananaatgtcggaccccaaaactcannccaaaggctanannnaatacaaaanaaangcgcaattcatctcaaaaaaaaacncaaaaaatatcaaaaaaatggtggtctggaaanggtanaanaacttccgcaaaatgcatangaaanatggcctacanacacngcaaaatcttccgccgcctcgaaaanntccccgctttcccccgggcccanatgtttggccggtttgaaaactcaataataaaaaaanggcgaaaaagggcaaaaaacntgcttcgcttcactgtgcacatacatgcgctcaaaaacagaccccagctcaaagagttcttccggggtggggaggtgacncgacccttggaggtgtccag

SEQ ID NO: 500160 - DNA, 173 bp, Homo sapiens
  misc_feature (20)..(21): n is a, c, g, or t
  misc_feature (24)..(25): n is a, c, g, or t
  misc_feature (31)..(31): n is a, c, g, or t
  misc_feature (36)..(37): n is a, c, g, or t
  misc_feature (39)..(40): n is a, c, g, or t
  misc_feature (43)..(43): n is a, c, g, or t
  misc_feature (45)..(45): n is a, c, g, or t
  misc_feature (52)..(53): n is a, c, g, or t
  misc_feature (55)..(55): n is a, c, g, or t
  misc_feature (64)..(64): n is a, c, g, or t
  misc_feature (66)..(66): n is a, c, g, or t
  misc_feature (68)..(68): n is a, c, g, or t
  misc_feature (126)..(126): n is a, c, g, or t
agttaaaatggctgggaccnnaannctggcncttgnnannaancntccccannanattgagcanangnagcacatcaaagcagaacatgcagatatgaagttccatgaatgtgaccagtgtaaggngctcttccccacgccagccttgctgcaggttcatgtcaatgtgccag

SEQ ID NO: 500161 - DNA, 1878 bp, Homo sapiens
  misc_feature (228)..(228): n is a, c, g, or t
cggatgtccgggcgctcgtgcgcgcgactacggggtggttgagccaagtaaccaagggccttcgcagatctacttcagcggttagctcgtgcaggtacttgggccactagaggtactcccgttctggtcggatccagcgcctggtctgaccgccggctcaccagggagtccgcacgactgccctcatacctgctatgacagcactgtacttcgtaacgcacctgagtngcgactcgtgcaggagtgtgcagcgaagaaaccctacacaccaaggattgcgcctgagagtcctggctatcgaacggcgtctcggagtactagccactagaggagtctcctcggtgcctatcacatgaacagctattcacccgtcgttgcgataggttctgtgaccatggaattgtatgtagtcggatgcctggattagatggggcgtaatggagaggacaattttgggcccccatggtactgatacctgacggtcgagatatcgactatatgcattgaagcacgcggcattcgcattgcgtgggaaagagaacccctcgttgttgaaacgcctagggtgtcaaaacctggacggggtagaggagaggggctagcacacttatctgccatttcgaaggggagtcttaccatttggaagaaacccagggaacgtggtttgacattggacctttggggtatgcattgttgggacggcatagaagagtggtctacattggagggaggcttgctagagcaactgtaagggaaatgtttggtggacatatagatcaattggtagtagaatcccatgtttgagcaattaccattggggtacataatgggcgagtgacaccatctgtggggaacgtggatgggaggcaggagaatgaggtgggtaggatccagggaaaaggtctcctgcgctgtgttggaaacatatgcggggttgtgggtatggccatcgaccaagatcttatacgcggcgcgacttattggaagggggacagctgtatgggagagagaggttccaaggttgctcacgtttgtgacatttttggggtgttggaaacacggggaagggtatggaaaccaacacgattctgttacttggataagcgaaatttgggattggaggcaggggaaggagaaagatgtccttttgagcgttggtggtgggaggggagaggaaactcaaaacattacataatgtggggaagttcaaagacaaagagccctcaattatggtggggaaagaacggaagggtttgacatttaaatagataaaaagagtttataacgggccttccggtagagtacattagggtggtactaggcagaatattatatatgagtgggatgatatgttgtaagattaaacccgatggggttataaacacatactgtgcattgggggcatagggggatggaagggtaggagtatcgatattagcgatttatggtctataacggtgggaacgcacacaccgatccggggtatacagaaacggaatggccatcgggaaccagagacccctccaagaagaaaagaagagtagggacccgcaccgacacaaacaccaacaatagaccaagagaacaacaaacagaacctaaccacaaagacaaagaggagacaacaccaagaagaagcgcacgggacggaacaaaaaatccagatcgccgaagacagaatcgcaacaacgtgttccacaacaagagtgcaccataaagaggagaagaaagatagagcgcaacgacaacgaggacgcaagagcaccagcgaccacacagacgagaacaaaagtcgaaagtaaagaacaacgacagacgaaaagcgcatacagtgaacgagaacgtagagacatccaccacgagaggctaaacagagaa

SEQ ID NO: 500162 - DNA, 161 bp, Homo sapiens
agagacagggggtctcactatgttgcccaggttggtctcaaactcctgggctcaagcaatcctccctccttggcccccagaagtgctgggattacaggcatgagccaccgtgccaggctggacccttttctgagtcagtattccccttctgtcgtcttctc

SEQ ID NO: 500163 - DNA, 190 bp, Homo sapiens
  misc_feature (154)..(154): n is a, c, g, or t
tctaggtactctaataggatgtttgaaagaagcttccactctaataggatgaaaaaatgatcatttattgacatcattctcgtttcgtggtgggggctccacaatccactataaagaagattccgctctgaccctaaattgtctactttctttnccactttgctctgacataaattaggggtgtcattct

SEQ ID NO: 500164 - DNA, 926 bp, Homo sapiens
gcttagagcaaagggtgagaggggcagagtggggctaaggtggacgaccacagcactgatgtgacggacccatcagccaggcaactggacctggtgcgatccaggaagactttctggaagaggtgacgtggctgcgtaggtacgaaaggataggacccagagagcaagaggacgataatatctgtaaggatgactggactggggattcgatgagtagtagaagctgggggccctttcttctagagaccgttggggccccttctgtgggcatatgtcaggggttcaacaacgtgttgcgctcgccagcctctacacactctcctcagttctcagctagtcgttgacggaaatcgcaggcgtcgcgtctcagccaggtcggtgttccgtctcgttgacgctgtctgcagagtgggctacactgctttctaggctagggctgtgtggggaagctcttgcctcttaatggaacctcctgcaccctggtgtagctctagtagcgttagtaccgtgtgtcctagaaataggcggttgcgcctctataagtgtggtgcttggccaagtgtactgctgagtattgccccgatgactgctggtagcactgcgtctcctttatcgtacttggctaatggggggactcagtgaagagcatggaggactcgtcctagggtaacgagtatggcaatgtcatccacttcggagttccctgataattgagaaatcgactccaaaggctgcgtccgttgagcgacaagaaaggggctacttgaacggcataccgatcctgagaaagaagtgcactggtcaagatggtggtgaagcccgatctaactaggggcctggcgttgtcgactcgatacccacgacgctggggcctgggatctcgccagtgttaacacgcaagtcccatggcgtctttcaacttcccg

SEQ ID NO: 500165 - DNA, 385 bp, Homo sapiens
caaccacccggaggggggggctttggaaggctatctatgtccggtcaggatacgcacgagtttcctttttgctgatgcccccccacataatgatgagggggaggaggcgtgttggggcccccctgactggaactgccctcctaatacttaatatttgtgcgggacctctcttctttttttccaggggagatggcctttccattttttacggcccgcctcactgactggattctacaaaatggctcagccgataccttcacttcaaacttaactctcatgttcattctaaccatagccagttctgggggcttgaaaacggggcaccctgcaaattagggagattgcaagttggggctgctgcccgaaatgcacttatttggggata

SEQ ID NO: 500166 - DNA, 248 bp, Homo sapiens
cgagtcagttcagagacgagcagaaaaaaaacagcaatgccagtaaagctacagagatcatcggtggagaaaaatacacatcacttagaacagggttatactggacacacagaaggctcaaaggcaaagttggttaaactgaatctctgatgctggaaccggcataaaccaaacaggtattaaaggtttctttggcatttgattgttatttaacttttttttctgttttttttattttatattggggt

SEQ ID NO: 500167 - DNA, 694 bp, Homo sapiens
ccgtaaacctttctttttggggattgaaaagggggggtctcggaaaattggggagtgtttctcagtcctccccccccccttcccgtcccggaggaagttgggaagctgaacttttgcaaaaccttgtgctgcgtttcctcccgtgaaaacgaccactttggagagaatgaggggtagaagggggggggcccatttggggcatggaaaggagaattggttttccctctggagaaaaaactaaattagccccgggggggcccggacctccggttttttgccgggggttgaaatagtttaggggtgggggggaaataaaattttaatttcctccgggccaaaaggccggctttttacccccccggttattaagggggggtgttccccgtttttttgtttaaacaggggggaaaaccccccaggggggggaaaattttccttttttccccccccaaaaaaaccccccccccttttggtttttttgggggggcccccttttaaaaagcgaaccaactggggggtttccgggactttggtttccaaacaaaaaaggcaaaagggtgggaaccttttggggcccccccccccaaccccggggggccaaatttttttcggggtggaatatgctttaaggaaaaatccgggcccaggggaacttgggggaaaaaaatttttttattttttttttttcccttta

SEQ ID NO: 500168 - DNA, 425 bp, Homo sapiens
  misc_feature (249)..(249): n is a, c, g, or t
gacaagaagcctaagaagtccacctggaggtttcatttggaccttactcatccagtagaagatggaatttttgactctggaaattttgaacagtttctacgggagaaggttaaagtcaatggaaaaactggaaatcttggcaatgttgttcacattgaacgcctgaagaataaaatcacagttgtttctgagaaacagttctccaaaaggtatttgaaatatcttaccaagaaataccttaagaagaanaatctcccgtgattggctacgtgtgggtccgcatctgaccaaggaagacttacgaacttccgtaatttcccagattaagtccaagatggaagatgggttccagaagtcctgaaggacctaaattgggcctccggcttggtaataccaatggaaaggtatttctaaaaggaaatttt

SEQ ID NO: 500169 - DNA, 1004 bp, Homo sapiens
agcgggctagtaaaataaacagctaaagctttgcagtcccccaagaagaccacgaagtcctgggagtaatacaaaggttcctgaaattgaggtcaccgtggaagggcctaagtaacaacgaagtcctcaagatcctcagctgttctgaatccgcccagatcgccagagtaacggttctaagcgttcggcttcaagcgcacgagggagagagtgttccgtttgaggcctggaatgccggaagaatcacggacctaaagacagaaagttgaacaagtctcgttcaactgagaagactgtggggaagctcttggccttaaagcaaggctgtgaaggtgccgatcgcgtaatttgagtctttcccggaagactgttagtgtggaaggcttaccgtgagggtgtgccatgtccgaagaccatcgactttggcagttccgaggctggagaagatacgtcagaagacgagaaggcaaaagttaagttcatcattaaaaagcccgaaatgtttgagacggcgattaaggagagcacgtcctctaagagccctcccagaagaagtaaagttcatcgaccaaatgttaatactacgtgcatcaggtgttgaagaccttaacatcattcaggtgacaatgtccagatgatgataatgagaagatctcgtaacagttgaaagagctagagagtaagagaacaagtgaatgacctctttagtcggaaattggtgaagtatggtatggggttgtcctgtgaaacgttccctacaggaccagtcacacattaaccctgggtgtgctggtggtagatggtatgcccccggggggggtccaacggaaggccccaaggtaccaggtaaaacagctgcaagtagaaagaccagagaatccgcagagtttacaaatgcagggcagtagaaccgtaccaggactgtgaaaaaacagggtgacacaaggagatcaaaggccacggaaacagaacagggaacagcaagggaagacaaccaaccaact

SEQ ID NO: 500170 - DNA, 212 bp, Homo sapiens
cttattctgcaagacacgggatctatatcaaccgcctaagaattatctcccattccgattaaatcaccttccacccttatctacacaagtcaaagtacgccctcggtctttacttctcttccttctctcctttatgacattaacactattctcaccagacctcctaggcgacccagacaatttatacccgtagtccaacccctttaaacacc

SEQ ID NO: 500171 - DNA, 400 bp, Homo sapiens
tgggcggggggggggggggggccctttacaaaaaaaggggggggggggaaaaaaaaaaaaaaattgttttttttaaaaaaaaagggggggcaaaaaaaaaaaaaaaaaaaaaaaaaaacccccccccccgaaagaaaaagggggggggttttttttttaaaaaaaatttttttattaaaacccccccccccccagagaaaggggggggcctccccccccctttttccccagggggggggttttttaaaaaaaaaaaaaccccgggaaaatcagaggaggaagtttctcaaaaaccccacgttgttttttgggaaaaaaaggccccccccggggtcgggttaaattttaaacccaaaggcagagccggaattttccaagcaaggtccataaaggtaaaaga

SEQ ID NO: 500172 - DNA, 722 bp, Homo sapiens
attgggtgaacaatggctagggggaagtaacctgtaaaagtaggctatacatttattggtagtttcaaacctcctcgcgggcgttcttgaacatgtcatggacttgcgttatgcagcagaatgaacggggtcaacgtagtccagatgacagcatgggcagtcaggaagcctcaaaactgattcatctctgcctgcaggtgccatgatagcagtgatagctcaactgctgagcacacgtactatgcagtagatgtcgatcatcagtaacatgcattcgtgccatctgtagtctgggtgacactgtgacatatgcatacctgtcagcggcgttgaggctcatggacattgaagacgatggtaacaatgctgaggctgacgcagcagcctcaaatgataagtgaatgccggcggtatctgcacatgtctggattccggctctgctctccgtagctggtctctggctctatgggcggggtgcagtttttatactgggatactcagtcttctggctccctcgtgcataaagcggagcatccttctctctgctgatggcagctttacatactgaacactcctgccgttctgctcgtgtcttcagccactcatgaagtcatgagcgtcagtacagctgatcacacacgctgtccacagctttgcgagcagtctgcatccatatatcacatcagaaggtcgcgagcgctacggtacgctctcgatttggt

SEQ ID NO: 500173 - DNA, 150 bp, Homo sapiens
acttgtctactgcattgtgcttcttaccataggtgctcaggctatagtggctatccggatgacgtaggcatacatgtcattcgctcatcaccgctggtgatcaagccaagtcattgtcactgcaggcatgcagctatgcttgctacgaca

SEQ ID NO: 500174 - DNA, 150 bp, Homo sapiens
ggaatgaacccgctagtcaggtggaaatgttgtttatctggcatctagtaaagcttaaattgtatcaaactacagcaggccatgagatgaacccttttcatcttcccagtatctcaaacacactagagatcttcccccccgtgaagattg

SEQ ID NO: 500175 - DNA, 286 bp, Homo sapiens
tcgatcggccggcccagattctgtggagtattcctttttccttccccctcctccactcctacgcccactcccatgcttgggagaatggggctgggacatgcactgagtgttgcacttttactttaggtagggaggcagtgttgaggtgagccatggaggtctagacactggagccttagtccagactggctacaactacctaactccccgttctagcttccctaaaggtcgatgtccagcacacaagttatctacactttccacgcactagttctctacaatttca

SEQ ID NO: 500176 - DNA, 357 bp, Homo sapiens
  misc_feature (7)..(7): n is a, c, g, or t
  misc_feature (25)..(25): n is a, c, g, or t
  misc_feature (33)..(33): n is a, c, g, or t
  misc_feature (83)..(83): n is a, c, g, or t
  misc_feature (122)..(122): n is a, c, g, or t
  misc_feature (140)..(140): n is a, c, g, or t
  misc_feature (187)..(187): n is a, c, g, or t
  misc_feature (210)..(210): n is a, c, g, or t
  misc_feature (339)..(339): n is a, c, g, or t
  misc_feature (343)..(343): n is a, c, g, or t
gggccancccgggctttctccggancagagcancgctgctggcctggcagcccaggacttctccgtgtacgtgcatccccagntaccgccggggcgggcgggccgccagagcagctttttanaatccagagacagaaaanaaaatctagatgcaacagcgaaacaaagaacccatttccttcctggnacccgtttctgtcccctcctttncctgtccgcctgcccggcatcatcagcccttctggggcgtgtacctctcactgcctgccccaggaccagaggcctgtcccccttccctccccaccggcccgggggagacctcttcacacccaaagatanattntacaagatgaaaaa

SEQ ID NO: 500177 - DNA, 1429 bp, Homo sapiens
  misc_feature (211)..(211): n is a, c, g, or t
  misc_feature (1429)..(1429): n is a, c, g, or t
taaagatgggagtctcactctgtggcccagctgggatgtggcagggggttggatctcgggctcaccacaatctctggcctcccaggttcaacgcagattctcctaccttcagcctcccgagtagctggggattacagggctattgtggccaataccgcccaggctaattcttgtggatatttttaagagataaaagacgggggatttcacncacgtgttggcgccaaggcggtggctcatgtagaacccttctgtagaccctcaacatgtgactccactcacccctctcaggcccccaccaacacggtgccgtggctcaacatgtgcactgtgagggcctcacctgtgcccacctgctggcgctcgtggcgctcaccggcttccacccctctgctctcaccacttaacacgcatctctgtgaccactctcttaacctgcgcacaccacgccttcctcgtgcgcgctcacacatacctccctccctctggcgggatgcgaataagcaacgggcgcgcgcgacacagagcgcaacccacccccggcgcacaccaccccgccggccactcacacccccctcccacccccacggcgacccacccacaccacaccccacccccacgcgaccccaccccactacacacccccccactgcaccccacaccgcgcccacccaccaccctgaccccgccaccaccacgcggcgccaatccgagcaccgcaaccccggccacaacacgccaactccaccccatcacacacacccaccacacaccacaccaaccaggcccacaacacaacacacacccccacaccacgcgagaccgcaccacaacacccagtgagacagccaccacaacaggcacgccccccaaaacacccaccccccacgaccccccccgcggcaaaacccaccaccgccgccaccccccggcggcacccaacccaacaacacacacaccgccggagcaacacacacacccccccacaccacccaacacccaccagcacaaacacacacggcccccatacccccccccaacccccctggcacacaacctacccgcgccaaccaccaccccaccccaccaacaccggcaccactcccacccacctcgcggaccaccgcgcgcccccccacccaccccccacgccaacccccccccacgctacacccaaccgcgcccacccgccccatcacaccccagcacacaacccacaccccccaccggcgggcccacaaacccccccgcaccacccccgcgccccccggacccccacccccctccccccccacccacccaccgccccccccccccaccgcgccacacaccaccccccacacaacaccaccacccccccccccgccaaccccccaccccccacccccccctcccccctccccgcgaacacgccccacgccatcagccn

SEQ ID NO: 500178 - DNA, 239 bp, Homo sapiens
cggcgatttagaggacccctaaattacgcagtctcaatgtattcttgtagtacttcaaaaatggcctaatacagatggatagttgcaaatattatctcacattctatgggtagtctcttcactatgttatttcctttgcaatgcagaagatttttaacttgatgtgatcccatttgtccactttggcttcggttgcctgtttgtcaggtattacacaagaaatcttggcccactccaat

SEQ ID NO: 500179 - DNA, 424 bp, Homo sapiens
tgctaacgggtgattattagagcgaaggaatggaccacgagacagaaataaacttgataaatgattactcttatggcaatctagacatgagatcaagtaggccagcatttagacttgtgagaaaagtccatctaggtatggttgcattactcgtattcttttctgcagatagataatgagtgtaaccgaaggcaattgtgcttcttttgataagaagctattcttggtcatatcaggaaattccagagaaagtccctcctatggcaagtttacttagcgctggtgtacttggtgacggccttggtgccctcggacacggcgtgcttggccaactccaccgggcagcagcaggcgcacggccgtctggatctccctggacggtgatggtcgagcgcttgttgtaatgcgccaggcgggaagacct

SEQ ID NO: 500180 - DNA, 485 bp, Homo sapiens
  misc_feature (8)..(8): n is a, c, g, or t
  misc_feature (42)..(42): n is a, c, g, or t
  misc_feature (58)..(58): n is a, c, g, or t
  misc_feature (122)..(122): n is a, c, g, or t
  misc_feature (265)..(265): n is a, c, g, or t
  misc_feature (291)..(291): n is a, c, g, or t
  misc_feature (407)..(407): n is a, c, g, or t
  misc_feature (445)..(445): n is a, c, g, or t
  misc_feature (456)..(456): n is a, c, g, or t
  misc_feature (474)..(475): n is a, c, g, or t
ttttaaancccatatacgggttcaaactccccttcccccctnccccccaccaaaaaanataaagcggggcacgccggtgccttacctgtaaaccctagcctaccctaagaggctgacacganaggtctgtcccgggtaacagagcaagacactgtcctaaaaacaaaaaccttttgttcgattattaaagactgaagaaagggcccaggcgcaatgggtcatgcctgtaacctcagcactttgggaagccgaggcaggaggatcncttgagcccaggagttcaagaccagncctggcaacacagtgagaccccatctctctacaaacatttaaatattagtcatgcatggtggtgcatatctgtaatctcagctacttgggaggctgaggtggaaagatcacttaancctgggaggtcgaggctgcagtagccatggttgtgtcnccatattctancctgggcaacagagcaanntccttgtctc

SEQ ID NO: 500181 - DNA, 825 bp, Homo sapiens
  misc_feature (15)..(15): n is a, c, g, or t
  misc_feature (25)..(25): n is a, c, g, or t
tcgtttagttactancggatccccncttttgtcaaacaatcatgtctatctgaatggagctctcaagaacatgccattgactaggaagactggactggaaactcattttaaacacacccatgacaaactctccacatctgataaccatcgttaacgcaaacaaacgccccatgaacggcccaacgactgaacacctacctgaatcacaatacataacacaacaatacaatttttttgacaaactacccagacaacaaaccgcctgaagacatacatcaccacacacaccacacagaaactaaccacctccgcccaccgttcccttatcccccacccctacgccatctcacaataccaaaaacacactcccactacacacccaccaaccacctcctacaacactaacactaaagcccccagaatccaccaaccccagaaccaacaccgaccaaccaccccaaaaatcaccacctcttcctccatgaataagcccagacccaccgctacaacacaacccgacctactaacaacaaaaatacaacactcaataccacacagataacccacgaacctcaacttcagcacaatccaccaccctctaccatagacacaaaccgccatcaccgccagccgccaacaacgacaaataccccacaaaacacacaaccaccgaacaacaaactaccacaaaccacccaaccaaatcccttcaaaagcaccctacaacacacaaacaacgcacacaacaaaaacccaacacgccccacacaagctaacatagccagatagaaaacaaacaccctaacaaaaccagccctcactccg

SEQ ID NO: 500182 - DNA, 344 bp, Homo sapiens
  misc_feature (126)..(126): n is a, c, g, or t
  misc_feature (222)..(222): n is a, c, g, or t
tggccaaatagtccaggtttgacaagcccacaggtaatgagtctctagaaagatgaagttattgagaagctagtttcaaattagctccaattttatttacatgttaacaatacacaattttatctnctatccttttcattcaaaggaaaattaaaaccatactctgttagtgtgaacttctgtttctgaactttccagttttgttttttttttttggttacnggatctcattctgtcacccaggctagagtccaatggtgtagatctaggctcactgaaacctccgcctcctggctcaaaggaattctcccacctcagtctcccaagtaactggcactacaggc

SEQ ID NO: 500183 - DNA, 148 bp, Homo sapiens
tctagaggatcccacgtagctccctcggacagctgtaaaggaagagtctctggctctttagaaatactgatcccattggagataccacgctgcatgtgtccttagtagtcatgtctccttaggctcctcttggacattcttgagcatg

SEQ ID NO: 500184 - DNA, 108 bp, Homo sapiens
ttgatctagaggatccctgctgcttgactatttgtggagcactggatcacttgcggcgtcatcgcgctggcacccacgtcaaacatgtggtagttgactttgtcacct

SEQ ID NO: 500185 - DNA, 130 bp, Homo sapiens
tcgcgggacgaagaaggaggagctgctgaaacagcttggacgacctgaaggtggagctgtcccaggtgcgcgtgcactaagtgacagggcggtcggggcctctcaagctctctagagatccgagatcgtc

SEQ ID NO: 500186 - DNA, 1805 bp, Homo sapiens
tttctgctgctgtttgtgtatatttgtttgtgttgtcgtttttgtgtttgtcgttgtctgtgtttttgatgtgcttggaggcgatgagtggagtggaggggagaggggggaggagaaaggggaaggagaggagggcaggagaagttggtactggtgctagtaggtgtgattgtgatgttgtgttcagtcatttgttcatagatgtgcgaattatgatccggttgggattgatgaggaggaggctccttgttaatcagatgtgcggtgttccgcgcgctcactattcattgtgctgctcaattgttgcgcgcgtgttgggggatgatatatcgccacaacgagtgggtggtgtttttggcacgcagcacatttattattagttcggtgctgccagccgctcgtcgtggtgcgtcgtgtatcatctcctcgtgttttatttgtcctcccgctggggatgattgtggcttcgccggggggacgctccctggtgtgttgtttctcctccggcgccacgacggtctgtggttgtttgttaatatcgccgggagcacaccaccttccttcctccttcttgggtgagggttgattctcctccaccatgcctggggttttttttcttgtcgggtcctctgataattgttggtcgccgcgcgccccagccagtctcctcttgtttgtggtgaaagagtggggggccaccgcccgcgtctgttttgttgaggaggaagcgcaccaggcaggaggccagccaggttgtttgtattcgtcgatgggtggggtgcgctcctttgtgggtccccctgctcttacaaagacagctggggggagggaggacacaaacacacaccgcggcgcgggtgtgtgggtggttgttgcgcgcacgacagacacaccagcgctcgtggtggagcagaagagatgtatgcagctctgtagtgtggggatcctcgctctctcgtctcaccaccgggggacgggcagcactccttctttttgtgggggtcagcggcgcccgctgcctcatcacgctctgtttgtgtggatggaagacacgactctctcacaagaaactgttgtttttcgtcccacatatcgccctcagcgcgctctcccgcgcacgaccgacgcgcttctgtcttctagaaaagagagagagagagagatgagtcttttgggagacacccgcgagaggagactccacactccgtctgttgtctcgctctgagacgactgtgttgagaccccctccgtgggagagaagagaagcgtgtgtgccacccgaccgcccgcttctgtggtgatatatctcgccccgcacttctcctctctctctctctgagggagcgcgcggagctctccgcccgcccacactctcacaggggagagcctttctctgtttgaagaggtctcacacgcctgtgaggcgccacaccccacaggtgggtctctcctccacacccccccgtgtgttaggcgccgctgagagaggcgtcttttggccggggctctcctgaggacaccctgggcggtgtatgtgggcgccacggtggcgggcgtctccgctgcccccctgccccttcgctctggcgccccgaagatcttgtgagaaagtctctggggagccccgtcccccactttgtggagggggcacacatgttctccgtctggtgctccccaaataccccctttttttttgggggtaaagaaaagggcccgcaaaaaacacaaaaaattgtcttttttgttataaaagataaagaaaaaaatgggtttttgattaaatagggcccccgcttttccccaca

SEQ ID NO: 500187 - DNA, 357 bp, Homo sapiens
gctgaggtgggtagatcacctgaggtcaggagttttagaccagcctgggcaacatggtgaaaccccatctctacaaaaatacaaaaataagctgggcatgatggcgggtgcctgtaatcccagctactcgggaggctgaggtgggagaattgcttgaacctgggaagcggaggttgcagtgagccaagattgcaccattacactccagcctgggcaacggagcaagactccacctcaaaaaaaaaaaaaaaaaaaaaggacggcctttttccccggttttaataaaggggaaacccccgcccaaaaggggtaaattgcctgggggtacccttttaagtggaaggaacggtgggattt

SEQ ID NO: 500188 - DNA, 404 bp, Homo sapiens
tatttaacgggctggtttaatttaaatgggctggatctatgtaatcacagaggccagtattgtacagccaatggcccgaatgccaaaaaaggtcacagggatgcggagaatgaggatttggcgcgggtggctcaaaaaatacggtgaatctaaaaagatcgatcgccacttgtatcacagccggtccctgaaggtgaaggggaagggtgtcaacaacaaggggaatctcagggaccacattccacaagcggacggcagacacggcccgcaaaaagctccgggctgaccaggctgaggcccgcaggctctaacaccagggaagcacgcaagcgccgcgaaaagcgcctccgggccaagaaggaggagatcatcacgacttcacccagggaggtgccgacggtggg

SEQ ID NO: 500189 - DNA, 226 bp, Homo sapiens
taatataccaagcactggaacattaaaagatagctttttttgtcttttctttttttgttttgagacagtattgttctgtcatccaggctggagtgcagtggcgtgatttcagcttactgtaacctccgtctccagggtttaagcaattctcatacctcagcctcccaagtagctaggattacaggagcatcccagcacgtattttcagtagagacagggtttcacc

SEQ ID NO: 500190 - DNA, 804 bp, Homo sapiens
ggagacgagggtgatcggaacctcagagacgcccatcatcatcgtgggcaacaagcgggacctgcagcgcggacgcgtgatcccgcgctggaacgtgtcgcggacctggtacgcaagacctggaagtgcggtgtacgtggactgctcggccaatgtacagacgtggctacatcgctgcgtgctcttcagtgagcgtgcatcatgagcgtcggctgcgcccgttgcaatgcacgtgcacgctgccctgcgcttccagggcgcgctgcgccgtgaccgttgcgccttcatgtgacgcctgggcgcccctcgggttgcccggttggccgatgcggagggctggtgccgttactgcgcggacttggcgcgggcagcgcggcgggaaatgacctgtgacgtgtccccgggctgagggcccctgcagccaggcagcctcccgggtggacgaagcactatcggcgagagggaggccctcggaaatggcccaggccttgccccttggtcccgcggtggctccctgggggacaggccggcttccagcggctgtattaggttgcagtgtgcccggggccggacccgcgggggtttgcccaaccacgccgtatggcggcgatgggcggcttcgagcgtggcatggagcgttgggggttggcgcagttgccggccttgtgccgggcccccccagttgttctcctcccagacgtggggtctggcttgggccggggtcttcctttcgcggtgttcggccccacccaagcgtggggggcgccttccttgtttcacctacctccgagccccttgcagtgc

SEQ ID NO: 500191 - DNA, 415 bp, Homo sapiens
  misc_feature (328)..(329): n is a, c, g, or t
ccaagagacaacgcaggtaactctccaaataaaaccacttgagaaaagccatctactccaatgcttccagcaatcgtctcggaaaaaaaaacaagtctacggtctgcatctcttggaatctgcagctgctgaactgcagagtgggtgcacgtggggaggagtctgcgggcctcaggatggggacttcaagccaggcttgttaaagtgcccgagtgagcgccccgcgggaatccaaaggggagcgactgggttgtttcccctgggtagttttgttggatgggttggtttccttgcccgtcgcttcttacctcctgggatagcgcaaggnncccccgaggcggcgaagctaaacacaaggcaagccgggttggttttttccagaaactccccaagaacgccggttgtcctcgctttc

SEQ ID NO: 500192 - DNA, 290 bp, Homo sapiens
aaaaacagacatctggtgacacttaaataacatattagtttcatcccttctatcacaagaaatatacaaattctaatgtgaaagacaacagtgactggaagttttttcccagcaggctacctagaacatccctaaatgttgtaacttatatccgtccacccagaatcacacataatcacttatgctgtaatacctgccatatccatttatttgcattagaaaaacaattcacattcctctctgaaaactgataagctttataaagtggagttgagaaatctagacaaaag

SEQ ID NO: 500193 - DNA, 287 bp, Homo sapiens
aaagctcagcaggcaagagagaacatgaaaagaaaggaagagtaagtactgccagtcttctgtaaagtcagatcattcagtctaactgaaaacctcagatatttggactcataaatatgggacctcggaaacagtatgaagcttaggaattgactaattattagatattccatatttatttcttccctacctaaattatattaccaccacgggcctcagtttgagaggtacagcttcttaatataaagtcatttcagaccagattaaattaggattatcagcaggga

SEQ ID NO: 500194 - DNA, 212 bp, Homo sapiens
agcacggggtgcctgtccttgccctggcatgtacttacctgtgtgactggaggtgacgatgtcgtaccctatgcggcctacagtttctcatatacaacaatgacagagcaagactatgataccttaagttcctcaagttttgtgacattttgtgaattatttctatgagccctctgctgatgtagatgtgctattattatacgagcgcttcc

SEQ ID NO: 500195 - DNA, 218 bp, Homo sapiens
  misc_feature (21)..(21): n is a, c, g, or t
ttctatataattttacgttgnagtgctaataaagacgtgtctttctgccgcatctctgtttatttccacatacaacatttgtttaaaagacattggtatcagctgggcatggtggcgcttgcctgtggtcccagctactccggaggcttaggtgggatgatcatttgagcctgggaggcagaggttgcactgtgctgaaatagttccactgcactcca

SEQ ID NO: 500196 - DNA, 226 bp, Homo sapiens
cctttttaaaaaaaccccctttgcccttttgctagattgtaaaaaatttttttagaaggcctaaaacatgtttttccttcaaaagctaaacttttcccagccttttggatttttgggttggcagggggggatttttaaaccggaatttggtttaaaaaaaatttgggggtaaaaaatgtgaaaaaaactttggggtttccccttttaaaataaagggttgttagta

SEQ ID NO: 500197 - DNA, 164 bp, Homo sapiens
tgtttgtggggatccatatggaaagtcagttctcgatgtgggcttctagcttggccaaagttataataaggataagcctttggtttggatgggcataacacgctattataagggttaaatgggcctcatccgggcagtcagcactaatggttctgtgaccatac

SEQ ID NO: 500198 - DNA, 320 bp, Homo sapiens
  misc_feature (89)..(89): n is a, c, g, or t
tgaaggaagaaccgttccaaaatttttcctttttcccaggaagccctgggcccccaaaaagggagacagttttgtttaaaaatttaaantggccccccagttgcccggcccggttatgcccgtccggaaggtttataaaaaggaaaaagctcgagttttccttgaggaaaaaaaaaatttcaaaccctttgttagtttccgtatggcccgggccaacgcccggttttttggcataggggcaaaaaaagccaaggaacccccagaacaggatttttaaaaaaaaaaataaagccctcttgggggtttggaatcagtgggca

SEQ ID NO: 500199 - DNA, 282 bp, Homo sapiens
cccccccccccttttttttttccccaagacggggggtaccccccccctccccctgggggggggggggggccggcctttttcccggtgggggccccctttgggggtttttccccccccggggggggattttttttttaaaaaaaattaacccccccggccggggtttttggggggattttttaaatttttttttttttttttggcccgcccccaaatggttttttggggttttttttttccccggggtttttccccatttattttggggcccccttttcccca

SEQ ID NO: 500200 - DNA, 132 bp, Homo sapiens
  misc_feature (82)..(82): n is a, c, g, or t
  misc_feature (119)..(120): n is a, c, g, or t
catcatggacgaggactactacgggagcgcggccgatgtggggcgacgaggctgagcggcggccagcaggatggatgattcntgtgagaacggagagcgaatgaatgcgggaggcttcnnagcaagcaaatg

SEQ ID NO: 500201 - DNA, 785 bp, Homo sapiens
  misc_feature (785)..(785): n is a, c, g, or t
ggacgcgtgggtcgacccacgcgtccggacccacgcgtccggacccacgcgtccgagctgcttgggaggctgaggcgggagaatggtgtgggcctgggaggcagagcttgcacgtgagccgagatcatgccactgcactccagcctgggcaacagagtaagactccgtctcaaacagaaaacaaaaaaaatccagggcaagcgccggagcggctcactcgcggcagcgcgcgacctcggcgctcgctcgggacaagaacccttccgcatcggaaacgccgggcccagagccaccatcccacaccctcccgacatacccgggcaaaactcagtcaaaggccataaaagcacaacgcaaggcagcctcctcggggcacggcagagagaccctacgggacccatcactatcacaactccactaaacaagcgggacacaacgggggagaaccactggcaccaggaaccccacaacccagcaacacttaccaacccaataacaaaacaaaatacaacaccagggcgacacaccacacaacaaccgagcgagcagtggctaacccgcacccccccaagacccgcggccgcgcaactacagggggcccgggcgcccacaactagcgcgaccacaaactaacccagcgcgagaccgcgccgcaacagccgacacccccaccaaaacaacagcaacacagcgaggaagacaacaacaaggggagcaaagacaggacaaacaccccaccgacacgacacacagcgaacacccgccagagacgagccaaatacccn

SEQ ID NO: 500202 - DNA, 182 bp, Homo sapiens
caggaggatcgattgagcccaggaatttgaggttacaaagtttacaaagctatgattttgctgctgcactccagcctgggtgacaaagtgagaccttatctctattaaaacacaaaaaaagcaataaggtccataatcaatttatcacttatggtaatggtaagagatcagggggatcctct

SEQ ID NO: 500203 - DNA, 313 bp, Homo sapiens
ctcacattcagcatctgctttaccgttatcgtctcgtgctccagtgacattcgtacagctcgtccagtgtgtcagccagtgcattgttaataagtataacaatcagagcaatgacctcagcatacgtgagtgttggtatacatgcttgtgctcttgagactatcggctaatattagacagcatcctcgtaagaagcctttgcatgatggcccctgagtgttagagtgtccgtagtcacacgagtcgcagttggtgctcataataagtaagtatctctaacgtttcactcagtacttagtacaggcaagttcat

SEQ ID NO: 500204 - DNA, 293 bp, Homo sapiens
  misc_feature (6)..(6): n is a, c, g, or t
  misc_feature (27)..(27): n is a, c, g, or t
  misc_feature (49)..(49): n is a, c, g, or t
  misc_feature (82)..(82): n is a, c, g, or t
  misc_feature (92)..(92): n is a, c, g, or t
  misc_feature (104)..(104): n is a, c, g, or t
tggttntccaacggggggctgcagcancctttccttacatcccccaccnagccaggcacccagggtctgaatttctccacancatgggcaanacctgttactanctgatttttttcataatggccaccgtgataattcattgtggtatttatttgcatttctctaatgactagttatgatgagcatccttcatgtgcttgttgggcatttgctgtcttctctgagaaatgtccattcaagtcctttgcccatttttgaattgggttgttgattaacaaagttattaggatatt

SEQ ID NO: 500205 - DNA, 285 bp, Homo sapiens
atcccagtcagttacacaaaaagagcagtggttcatttctagatgttggatcttcagataaattctgccattttcatttcagcttcctgaaagtcagggtcggcttgtgaaacagttgttaaacaacatgctaagtgtgaaatgtcaaccctcactctaaactttccctgttcagcagcatcagcatgcaagcacttcattgggttttatagtggatttctgatttaagatagtccattgaagacagggcagtttgaaagttgttgtgtaacaagattgggtacg

SEQ ID NO: 500206 - DNA, 179 bp, Homo sapiens
tgggcccaaacttacgcgatagcgtagaggtgtttgtagtattctctgatggtagtttgtatttctgtgatgttagggtgttgattttagatctttcctgctttctcttgtgggcatttagtgctataaatttccctctacacactgctttaattttggaatggagtatcgcgtcagtt

SEQ ID NO: 500207 - DNA, 631 bp, Homo sapiens
ctacaccctgagggcgtgctggtgctagagccacagccctggacgtcgagtggcaagagaaagactcttacagaaacgatctacaggaactactaccgaatccacttgaggccagagcagttcagtgcctacctgacatccccagacgtgggcttgtccagctatgagcttgaggccacaccgcacaacacctctaaaggcttccagcgttctgtgtacctgttccacaaggcccgaaccgccagacactaagtggaccgctaaacagaaagtgtgaagaggctggcctcgctgatcataaggacctgggggaagaggaaagtgttccaaggactttccttgctgacttcacagcctcctccctatgcctatggcacctgcgcagcaaggctggctgtgctggagtcaccatgatcttgctatgccccagactaccaggctcggatggatggactgtgtgctgacctctgatctcttatggcatgtgaggtgagaggatatctgctctagccctttactccgattctcccaaggagagagagttccatttctactaggacattgtacctaggtctggtgcctagctgcgtttcagtggaccatggatagagggactgagggtaagcggggt

SEQ ID NO: 500208 - DNA, 396 bp, Homo sapiens
aattgactggccgagtggataggcgtctgtgagacggtatgagggagtgagtaggagtacactctcggtgggatctggcccagcatggcagttcatagtccgtgattgcttatcttactgcaagtgtctttgaccctccttatcacctggttcctctgttgggcccaaaggtcgggagtaggagacagtatcccaggctgacaagggctggccctttaccttgggcaccttgttaatttggagccgggtgcccattcccgcacctttgccctcccaggggttggtagtgtgggaagcccatctcagttcctgtgacttcatgtctcaaaccaaggatgagcgtctggtctctgctatgatggtggtatccgaggcctttccctgcccagtctggtg

SEQ ID NO: 500209 - DNA, 878 bp, Homo sapiens
  misc_feature (563)..(563): n is a, c, g, or t
ggcacgagggagagagagagaaatagagagagagacagagagaggagagagagagagagagagagagagagagagacagacagagagacaggagacagacacagagagacggagagacagagagagagagagagaaagagagagagagagagagagagagacaggagaaaaaaaaactccggtgtgggctcccattcctttaaaagggtcgccacccactcgaatgtgccaacgcgttgatacttcataagaggacttctccccaagaggggaggggagtcgtctgtgcgctcttctccacaagagcagcatagtacgaccacggtgtggacaagcgaaagagctggtcggctagtataatcgttctatcgctgtactacggcgccggcgcactatcaggagacatctcatcgtgtatcttatcaggaggaaaagcatgtttaatcgtcagcgccgggctgctgtcacgaggctctcggtgctgtgccgaaagccgccccgactagtgctgcagtacgctgtctcttttcctcctcctctcattatttttgtgagagacaacngactgtttgatcatcccccgggggagggggtgtgccagctgctgtctgtgaggagtattactgcatactcaccgatgtcgtatgacatagtggtggttgagtgctcgccgtgtgttgtgcgtgtcagctggtggtttgtcatcatagaaaacgcgattaacacaatgactaatggaggactggcgagacgacagcaggccaagaatgatgtctttaagcagatcactgcagaggaagcactccgtgagaagagggagagaaagcagggagaagagggaaggcaattgaggttgggatccctcatataaaaacaga

SEQ ID NO: 500210 - DNA, 214 bp, Homo sapiens
ccgaattactcctataccacagccacagccatgccagatctgagccacgtctgtgacctacaccacagctcacggcaacgccagatccttaacccactgagggaggccacggatggaacccgcaacctcatggttcctagtcagatttgtttctgctgcgccacaatgggaactcccctccttccttattttttaacactgccttcaatcctgc

SEQ ID NO: 500211 - DNA, 141 bp, Homo sapiens
ccagctggtaccccgcctacctggtcgcctttaaattccagctgttccgcaacctcgcattgtggcagcaggcgttaatggttatggttctttcactggcagtagatgtcattgttttttgggctgaattcctggtcatag

SEQ ID NO: 500212 - DNA, 100 bp, Homo sapiens
agcgaagacaatgcgcctacatcatccacaaccgcgtacttttcgcggaaggaactaccctaggatcaaccgtccacaaccttctaaccgggaaccaaac

SEQ ID NO: 500213 - DNA, 116 bp, Homo sapiens
ctgctttgcttgtgggaaaagcatctgtacaaatccctaatgcactgacgattctacagaacacttgactctgctcctcaaaactgcacaaggtaacccaaaacaaagaaagtact

SEQ ID NO: 500214 - DNA, 369 bp, Homo sapiens
  misc_feature (218)..(218): n is a, c, g, or t
  misc_feature (223)..(223): n is a, c, g, or t
gtgctctagatgatcccggctatcacataatctctgcttttaggagcatgcagtgaatgaaagtaggctggagaaaggaaggtgatagcacaacaagaagcaagctagtacggagtggtgtgtccgggacttcacccggtggcactaacaggctatttatttaataaactttgctttgcttgtgtctttctttcctctctgttttttggaattatttngtttngtggaatattcaagacacaattctttatgatggaaaatgaatgtgttagccttcagtcaatgtccaggggttcttgttggagccttagaatgaccactaaaggaacgcaaagaaaagtgtctttgcaggagaagataatgtgatag

SEQ ID NO: 500215 - DNA, 469 bp, Homo sapiens
agctcggacccgcggttatgtcttacggaactaggaaagaggggctggtcttcctgagttgaaagcccacattgtcaagtttaattttaggtgtttgtgggagggtagaccagagggaaggggacacagcagggaccctgctcagggagacagtgcttggcgttttgagagtgggcgggtcaggactaaaagtgcagttaaggaggacagtgtaatgggcaggagggtgagtgagggagacagcgtaagacataaccgcggccgcggttatgtcttacggatctcaactaaacttattgtggtaatcatatcacaatatgcacaggcatacttcagagacactgcaggttcagtttcagattactgcaataaagtaaatatcacaataaagtaagtaacatgattttttggtttcccagtgcagataaaagttatgtttacactccgtagccgtaagacataaccgcgg

SEQ ID NO: 500216 - DNA, 423 bp, Homo sapiens
agattccaagcaagcatagaagatctggtcatcagttcttccatatgtaattgaagtcatcatcaaggttcctgatcggccattctggctgtacataagcttcacatgcctctagtcctgtgtgacaggacactgaacaggtctgggtcagcgttaaagcatgcggcagcaaggatgggcttgtcaggcgaggttctgatcaccgtcacaagctgcgcaagcacatgcagtatagcagcctttcctgatgagagatagaaaagagtcacgattggcagcttcctgtcacaacaagtcaaaggtcttgaggacaggagcatacaaagcacacgaagccaaatgtcgttcaggcagggtgaagtactacacacacatgccatcgtagcacataatcagtgcatagtgcaagtgagcagttggccg

SEQ ID NO: 500217 - DNA, 104 bp, Homo sapiens
caagcaagtgctgtgaaataacatcatcttagtcccttggtgtgtggggtttgttttttttttttatattttgagaataaaacttcatataaaaaaataaaaaa

SEQ ID NO: 500218 - DNA, 898 bp, Homo sapiens
  misc_feature (523)..(523): n is a, c, g, or t
  misc_feature (620)..(620): n is a, c, g, or t
  misc_feature (623)..(623): n is a, c, g, or t
  misc_feature (648)..(648): n is a, c, g, or t
  misc_feature (655)..(655): n is a, c, g, or t
gaaatatattatttcctttattcctttcagcaatccatgagatagctattataatcctcatttcctacatatggaaacagggccaaagaagtcaagtcaaataatctaatccagatttagagagttggagattggtagagacagactagaaatcaagatttatctaaatcaaaatctatgctcttaaccatcattttgttagtctgaatcggtgcaacctaactcaataacataacccaaggttttatactgaactgtgtttggtatgattgtgagatgtcaagaccgtcttcccacaggcacacagaatgagaaatcctggctatattgctgttaccatcatgctttctatagaattggcttttattatgtttctttgctcctttataaattctcaatgatgtgactacatttttacattattaaagcaaatagattggcccataactagggaaatgaatagagatggaaaagtaaatgcttggcattccttaagccctgggtaagtgtttatgctcaatanaatgtaaataatattactgaaagaggctgtttatatgggagtaatggtcagtgacaacactggagagaccaggtagggaccggttgtgaccatatcntcntttatgttcttgatgacagcatatntgattgntctcaggttaatctttgtgcggaattcctgacctaacctcttttcactgggacactttggccagtgtcctttctccctggatcttttacacctgcgttacctcggaggccagcttcttggggattcttcgcatcctttctggtctgggtcctccacgtgggtgcccccgtgtgggccacgcttgaatgctttggggtccggggcacggctcgaccccgggggggggaaccccggagttgaatg

SEQ ID NO: 500219 - DNA, 859 bp, Homo sapiens
agcggattgaataagcgacccggcctcctagggggtcgtcgtggtccagacagtttagcagaacagcctccgcggctccggggagaagcaagtatgttaaggatacctgtccacgacaggccttagtaggcctttctacgctctcctaacacggactgtgttcgaacacactgccacagcagcaagcacaccttgacttgaacgtatttgttgacctggtcagtctgtcatggtggaaccgggaacgacgtcctccaagcttgtgcagacaggttggcatgcagatccctcgattctgttatcatgaacaggttgtcctgttgctggcaacactgcaggatgtgccttgttgaacattgagaaagcccctaacggttgctacgctgcttgtgccatgccagtcaatgacacgggttggcaatatcctaacacacactccgaacacatccacacaagccagggcaggtgtgcatggcagttcttattcagccaaatccacacatgcgactgtcctcatcttgtgaccagggcaggtgcaatggtgatctgcagcgaaccagtcccatgcatgtccggcacacatgcataggcagccgcatcttctcacaacgggcgacagccgtgcctgtgggaccgcacccagacaccataggggccccacacggctaccagaccacctcatactcaaccacacggcttgctacttacacgtggttaccctcgccttgcaatttcacgcgtctatgcaaacgtgacgcacctgccccgggcagtacgacatcaaacacgcgcgacaacccaatacagccagcagggcacccggacatcctgccaccgctggggcaccctcccagcttgc

SEQ ID NO: 500220 - DNA, 355 bp, Homo sapiens
ggggggttttcaaatttttttaaaaagggggttgggtccccaaaaggggaaagtgaaatttgcttttgggcccggggggggacgcccccagcttcctttggggggggaaaaagttggccttttgggtgacattccaaaaaaagggccaaatttgcccccccccttttgccccgggggggggggccccccaaaggggttttggaagggttccccctgcaaaaccctttgggcccccaaaaattaaaagcctttttgatccagggggggtagggcccaaattttgaggccttttaaaacccctgaggccggggggccaaaaaaaggtttcctttttaaaaaaaaccttaaattttta

SEQ ID NO: 500221 - DNA, 134 bp, Homo sapiens
ttctagaggttcccgtagcatttcagcaggacagttatcaatataacaaccccctgcgataacccaattaccaaacgccccgtcttcgtctgatccgtcactaattcacatgcagatccgtacttcgtccgtat

SEQ ID NO: 500222 - DNA, 425 bp, Homo sapiens
caccacttgggatgaggcaggtatcactagaggtcaagagttcaagaccagcctggccgccatgttggtgaaactccatctctattaaaaatacaaaaattagccaggcatggtggtggatacctgtaattccagctacttgggaggctgacacaggagaattgcttgaacccaggaggcggaggttgcagtgaggcaagatcacaccactgcactccaccctgagcaatagagtgagactccatctcaaaaaaaaaaaaaattacctgtggtggtttgcacttatagctactcgggaggctgagttgggaggatcacttgagcccaggagtctgaggctacagtgagccatgatcacacccatgtactccagcctgggcaacagagcaagaccttgtactcaaaccaataaatatataaagtca

SEQ ID NO: 500223 - DNA, 310 bp, Homo sapiens
gttgactcggttcacctagacaaagagaaacagactgaaccaagacactcagtgccacctcaggccccgggtcacgccaggattccggacccgtcagctttgaggttgatgatgacccagacgttgacgtggccctcgtgttggaacaatcttgtccatcccctacaaatcgaaggtaaggagtccctaaatggacggagccaaaccaagttggacaaaggagccgacccgtgagtccgttgttctcaggtcgcacaccatgtccggagctgacctgagtggcctacgacgctgtcggtgacatcgagcc

SEQ ID NO: 500224 - DNA, 183 bp, Homo sapiens
accgtccgctaatgaactgcagtacacggagcatagcttcctcacaggagccaggacatgtaaggagcttgcttggctcagaccgcatgccttccagtacttggccaggctcatcacacacacccagcagtcccgaaaatcacactgtgccacaggcgtgctgacagtctgagtacggacccc

SEQ ID NO: 500225 - DNA, 726 bp, Homo sapiens
  misc_feature (120)..(120): n is a, c, g, or t
tagctaattgggtaatacctcaacttcaatgaaattgaggaaaattgggatttaagaagcttgtcttatgtgagaattaaaccccggtctttctattcctgatgcccttaaaacagctangtaacaaaacaagttcaaagaggaatgtttgaaagaaaagacttgaatttcaaattggcaagacagaattgttcactaacgctggccttgtgatttgaaatggccaggtgagaagatggtggctacccttatttaacaattctatcagcaactcagttttggttcttggtagtgatatacgttaagattttagcaggaaaatttagtcattgagcaatttgttcttttggtcacttgctccttttaaagacaatgactgggccagactagaaattcttgaaataaagccaatgccagagaaacggagaagatcgactttcaggaaaaaaaaaaaaaaaaaaaaaaagggctggtcctttgatttagagctgtctgaggacatcccgaaagctggcacacctaactttccaaaatttcctagaaattggggaagcaggacaggtaattttgggagacacagaggactagggttggggggagtagacaactatgacaaagcagccacccttaccttgttctttttattttcttattttttaataaccataattaggttatcgtgaagatactacattttcaagaggaggttattggcatggggatcct

SEQ ID NO: 500226 - DNA, 116 bp, Homo sapiens
gcctcgaggacccgctgactatttgtgttggggttttttgggtctaaggtacttctcttattctttaaatggtccttgtaaatttttaaattctgctaactttagcttggtaatca

SEQ ID NO: 500227 - DNA, 627 bp, Homo sapiens
  misc_feature (311)..(311): n is a, c, g, or t
gggggcttcatgaagcctgggaaggcccgttggttggtgctggacaagaccaagcaccagctgcgctactccgaccaccgtgtggacacagagtgcaagggtgtcatcgacttggcgaaggtggaggctgtggcacctggcacgcccactatgggtgcccctaagaccgtggacgagaaggccttctttgacgtgaagacaacgcgtcgcgtttacaacttctgtgcccaggacgtgccctcggcccagcagtgggtggaccggatccagagatgcctgttggaagccttagccttccaaccctggccggntggtttggtttcggttgttacccacccataaggggtggcaaggccggcccggcccatgttaacagcccgggccttggacagaattaaggcccagagccccaggcaatggtgtgtaaagcccccgtccccgccccgccccggccggccggccctaaattattttggcgtcacagctgagcaccgtgccgggaggtggccaaggtacagcccgcaatgggcctgtaaatagtccggccccgtcagcgtgtgctggtccagccagcggctgcaggcgagtttctagaaccagagtctatataaagagagaactaacgcc

SEQ ID NO: 500228 - DNA, 2076 bp, Homo sapiens
  misc_feature (400)..(400): n is a, c, g, or t
  misc_feature (1147)..(1147): n is a, c, g, or t
  misc_feature (2076)..(2076): n is a, c, g, or t
atatgaccactgattatgtcagcatgtagcgctggatgacagcgggcgaggagacccgcgagaggagctgtgcagtactgtagaaatggggattccagcggagacaacgggtggtaccggcatcgagtgggcgaggtgagccagcaggccccagggatccgcagaatgagagagaacgtcgcgaccgccggccgcagggactcgagaaccggcatcgcggaaagacagaggagggagtactcagcgcatacggatgataccgcggggcgtgtccaaagtgtactacagtaaatgcagtgactatgtgctggctgtgatgcgccgtattcgtacttcttctttcaatccaagcgcggtccctttcaaaattggacactaactggagacactttattccganctcgggtgactcccaagggtgatcgcgtaatacttgcgaggagcaggtggaagtcgatcccaaagacggattctccaatagcctggagccggcggaagtaacacgccatgcatatccccgatggtgtactgcctacggacgcaggtcattttccaatgtgcttttctacaccgcgtcgagtcttgggctttcacggataactcggcgggagcaccttaactgatttcttgggccatatacccttggtgcgcctatacgttcgcctaggatcccacgcattggaacacgcacaaattcgaacattagctttgggaacgcagggccttgccccaatgtccacatggaaggacagcgttaacccacgtgctacatctccctggtggggaaaaccgcgcctcttttgcaaaactcacgcattcccttacctatattgcgctggcatacagcgggcgcgttaaaagcgagtggccaaggggcgcacccatctgagaagccactttctggctccccagggcgcgcaccagaggcacgcaatggggcagcgcgcacgttgtagccgggacaggttcggagaacgattgctctaggctcgccaattaacggacttgcttggagtacccgcctgcgtatacttggacctcaaaatacgcacgccttcacactccccaagcgctagcggcacatcttggcgcacacatctcgaccattcctcgggccacctcgtgcgctggacccgtgacacggaantgcgcgacgttcgacacgaacaacgatgcttcgtatgtattcgcccttctatacctacaagatcttctgacatgctcacgctggaactttaccctttgactcatccgactacgcgggccacacgggctcgggcgacacagaagtaccccttcgagcacgacacttacccccaacgatccaacagcgacgtaacatgaactacactgaaactctctggtaagcgtcaccaccggagaggtcaagcaagcgggcgctcccagaccacgcacatgacgagtagaacaggcccacgtaacgacacacacgccatacacgagacacactcgcagacacgagacgcgtcgagcgccacaccagcaggcaaacacgcagcaggggcgggcactaacaaccacacgcaggaggggcgacagcacagcacacagtaaaacacagaacagcagcagcttgcagagagctcaaaccacactgacaccaaaccaaacgacacacagccgagcagttacagaggaccgaggaagaccactccagaggcggcacacaaatgctggtcagctcgcataacacccgcaccgcataagagagcacaacggtacagtatgcaatatctagcagtcacaataccactaacagtcacggaacacagaacagtagaagagtaccacccaacacaacactactccaatagaaactcacaccaaatagcacataacctacacacatagcagcagacacataatgacaactaaataccaaatctcacaagccacgcataacacagacgacaccaacctcacacacacaatcaggacgcagacacagcagccgccagaagtcccggcgacatacctataagtatcacagtccaaacccacaacatcaccaccaagaatgccaacacaccaaatgaggtcctagcacatcacaan

SEQ ID NO: 500229 - DNA, 102 bp, Homo sapiens
gcggagttaaaaaagatctgaagttgagccaactcctttactcagttcctatatgtgttttgtgtcttgctgagaattgaggaagagtgtaattcaatgcag

SEQ ID NO: 500230 - DNA, 268 bp, Homo sapiens
cgagtgtattcgggggagaagcttcgagaacaagttgaagagcgcctgtccttctatgagacttgagagataccaccgaaagaatcttgatgtcatgaaggaagcaattgttcaggcagaggaagccgctcctgagattactaggaagctgtgagaaacaggagaaagaaacgctttaaagaaggaaaagaaacggctcgctgcacttgccctcgcgtctatcagaaaacagcagtagtactccaaaggggtgtgaagagatgagtga

SEQ ID NO: 500231 - DNA, 1521 bp, Homo sapiens
  misc_feature (1)..(1): n is a, c, g, or t
  misc_feature (712)..(712): n is a, c, g, or t
  misc_feature (1082)..(1082): n is a, c, g, or t
  misc_feature (1084)..(1084): n is a, c, g, or t
  misc_feature (1096)..(1096): n is a, c, g, or t
  misc_feature (1105)..(1105): n is a, c, g, or t
nctcacgacagcgctgatgctctgtgggcttttgggctacgatagtacctttttcaagatgcggtcgttgctgcgtcgtttctccggtgttgttcagcacccccgcgctccggcttctggcccaaggtatttctgctgctcgtggtcctttattgtgcgtctgcacagtattctttctctttgtcgcccctgggggcttattccccgcgtgtctctcccccagaagttggtccggggttatgctctgccccggtgttcctcccccgcgcggggatatggtggcaacgtcccccaaggtgttccccgtcgcaagattgctgcttaaatggtgtttcttggggggttttcctacaccccgctccccggcacgatttgtagaggttgggcacttgtcccttggaagaaattgggagaaacgaagaaatttggaaaaaaaagtggggaccacaatccaagacacgtggtgcggtgtcagaacccaggaacactgggtccgttgtccaaatacttccgttgtgaacggacccccctgggtatgttctcccccccccccccctgggtgaaagaagtggaggttatagcccctgccgcgtggttgggaagcgcacaacggtggaacattttggtccacccacgccccccccagaatatggtttaaagttgggaattcgcaggaacacatgtattagcacggcacttcactgtgaaggtntttgagaagaatcgtccccccacatttttgggaaatttgtgagatgagacattccccacaattcgtgccgttgccttgtcgttgtgtttaaatagttgtggaataatggcttgtaatagccacgcgtgaagcacccctgttatatgggcacgcacaccaaaatgttatggcggtctatatataataaaatgggtgaacacacatggagacactcgagtctttgctttcaataaaatgtctacactctttgagagctgcctcgtgtctctccacttgtgtttgaatgtgattctcggagggccacagggtgttggctctccaccacaggtgaaggctctctatagccacagggcgtcggcgacacactctnanagagaggtgtgnggggagacncacagagagagattgttctctctctaatgtccacacacactctcacacacacttctctgggttcacgagaagtgtgtataactctcttcacatagtctctcttgcgcacactcccacagagctctgtgttatagagattagattataggcggtgccactatagagttaaactctcccactttaacacaaactctctgtgctctagaaatttgtggggagaaaatttatgaaaataataattgaccacggagttattggaaaatttgttaataaatgagatgaaacacttttgtcacataataagaattcactatttacttcttaataacacatttgagataaaagtaaaggcactggttgtggttaatttggtttatttttgttcccccagttataataaatcataaaacttgtta

SEQ ID NO: 500232 - DNA, 910 bp, Homo sapiens
  misc_feature (344)..(344): n is a, c, g, or t
  misc_feature (590)..(590): n is a, c, g, or t
  misc_feature (616)..(616): n is a, c, g, or t
  misc_feature (618)..(618): n is a, c, g, or t
  misc_feature (626)..(626): n is a, c, g, or t
  misc_feature (638)..(638): n is a, c, g, or t
  misc_feature (640)..(640): n is a, c, g, or t
  misc_feature (649)..(649): n is a, c, g, or t
  misc_feature (651)..(651): n is a, c, g, or t
  misc_feature (657)..(657): n is a, c, g, or t
  misc_feature (666)..(666): n is a, c, g, or t
  misc_feature (672)..(672): n is a, c, g, or t
  misc_feature (674)..(674): n is a, c, g, or t
  misc_feature (680)..(680): n is a, c, g, or t
  misc_feature (682)..(683): n is a, c, g, or t
  misc_feature (698)..(698): n is a, c, g, or t
  misc_feature (701)..(701): n is a, c, g, or t
  misc_feature (706)..(706): n is a, c, g, or t
  misc_feature (710)..(710): n is a, c, g, or t
  misc_feature (718)..(718): n is a, c, g, or t
  misc_feature (741)..(741): n is a, c, g, or t
gggccctgttggttcttccgcgctggagtatccagataggcgacacgccggcgggcggtgaggcgggaatggctgctgtactgcagcgcgtcgagcggtgtccaatcgagtcgtgcgtgtgtgggctgtaacccgggtcccatgaccctccaaggcaccaacacctacctagtggggaccggccccaggagaatcctcattgacactggagaaccagcaattccagaatacatcagctgtttaaagcaggctctaacttgaatttaacacagcaatccaggaaattgtacgtgactcactgggccccgagatcattctggaggcataggagatattgtgtaaangcttcaataatgacactacctatgtgcattaaaaaaatctcccaggggaattcctcagagagaagaaattataggaaatggagagcaacaatatgtttatctgaaagattggagatgtgattaagactgagggagccatctctaagagttctatatacccctggcacactgatgatcacagtggtctactcttagaagaggaaaatgctatcttttctggagatggatcctaggggaaggaacaanggtatttgaagacctctatgattatntnactcttanacgagttttganantcaaggtgntnttatanttccaggantggcangnattcananngtgagtaaaatcaanaanacttntcanagaatttngagagcggaatttacttattcgngggacttggaactatcaggatggttggaaaatattaaagagattctgggaattacgagggggacaaatctttctttggagaaaaaaacaaaacattggggcgcgcgagttaaatttggggcccagtagagaatggtagactggatggtcaaaagggggcgcaaggttga

SEQ ID NO: 500233 - DNA, 221 bp, Homo sapiens
ctgatcttagtaatcagccacttttctgactgctgtcatgaagtcttcctgtactacaagaatcatgatcagcacgaattgcgaactatacctgcttcagtgacaaaccatttctcagatctgctccattaaatgccatccagaaagcttcacaattggcttcataactctatatcaccaatgctgttgtaagtgggacctgcgatggattttcagttatg

SEQ ID NO: 500234 - DNA, 1695 bp, Homo sapiens
tgggaacaaaaaaaaaaatctaatgggggaaatttcaaaaaggggggcaccactttgaaccccccctatagatgtggcgggcgcccccccttgttgcccaataggcgccacatcgtgggggtttgtctctgggcccccacatccctctttgggtagttagcccctgtttttcaccccccctctttgttttcaatttctcctccccctttgagactcttgtggagaaaccccctctctttcttgtgaaatagtgtgggtgtctcttctcgtgggcgcgcgccaagaaatatcttgagaatctgtggcgccctggccacggaggcgctctccaaacccatcttgtcgctcctctgtagtactcgacggcaatctagagggcgcgagatatgtgagcacatatatatataccttgtggccacaatgtggtaacacccgttggcacacagagtgtcgcccggtgaggagtttctctcacaaaagggccactcctcgaatatgtccccagtgtgtgtgcgagcacccctgtgtgtactcccccccccaccacaacagagagacacaaacctatcttctttgtttgtggaatcgcggcgcatatataccagcgtgtgaaaacgagtgtgtgtgtgtagcccaccccgcacccacgcgcgtgaatatatttgtggtgaacaacaccacaatcttcttgtgtgaccacacacaaactgtgttttttataccacccccatcgtgatcttctcatatataatagtggaggagaacacacaaaaaatttctgcgggcagaacaccactctcaccacgaagaggaggatcctctacaagaagaagaggaaacacacacgacgctggtgtagcctacccatattaacatcctacccatgccgttgttgagtcacccccccccgatggtgttggtttgctcccacacacaaacgaggggcggaagaaaaaccatcacttctacccaccaattgtggtgggcccccctaatttattcaccccacaccccccacaagttgtccatccaacaaacagacgtgccgcaacactctcttctgtggggcactactcgaagggggaggaaaccccccactaccgtgaggactacaaaaacacgcgagaacacaaactctaggacggagaccgacacacgcagcgcagtgttgttgtaccttcttaaaccaaaacaccgccggggcgactaaacaccacaacgcggcgcgagcgggctcggtagacggcccccccctaatgtgtgtgacaacaccccaaggaggactatcctctcacaggaagtaggaaaccagccacatatactgaatagaagcaagcaaacactatcactacgaagagagaccactaatacttgtaacgtgggtgcgggcgcagccaccaacacactgagctgttacatctaacgaggcacgaacgaggtgatcaacaaaagatgtggtatcctcctgcaccccacagtcttttttgccacacacgggggacaatactgcgcggggccccccactagtgagaggaagatcctaataatctcagaaaaccaagattcatcaaatatcatcatcatgcacatcaaacactacaaaacaacagacaaaaccactccagcaacatactacaatagctaactgatacacaatcacagctacacaccgacagcatcaactatccagacgac

SEQ ID NO: 500235 - DNA, 1084 bp, Homo sapiens
gtgagactccgtctcaaaaaaagaaaaaagaaacgcacagtgggagccaggcacagtggctcacgcctgtaatcccagcactttgggaggctggtgtgggcgggtcacttgaggccaggagttcaagaccagcctggccaacatggcaaaaccccatctctactaaaaatataaaaattagctgggcatgatggcgtgtgcctgtaatcccagctactcaggaggctgaggcaagaaaatcgcttgaatctgggaggcggaggctgcagtgagctaagatcaggccactgcactccagcctgggcaaaggagcgagactctgcctcaaaaaaaaaaaaaaaaaaaaaaaaaaaagagacgcggggggcgccaagagacacaataaacccaggaaaaaaaggcccccacaaacagaggccaaacacaacaaaagggggggaagtgtgtcttcatctttccacaaatatataaactatgtgtgaaccgcgcgggaatgtgtgggcccggcttccacacggggcaaattccttatagcattccccttctcccccgtgggggaacgtcgggggaaacccccaagagccgccgaacccagggacacgagagagcgggggactccccacagcacgccgaaaattcccacacccaaaagggagccacacccagcaccgcagaaggccaggaaaccccccccctggggctcccactcccaaaaaccccccgcggcaaccctatccccccgaagagcgcgcgccagacccgggaggacaaccacgcggtcacaacccatcaaaacacaaggaaggagccggccaaccccaacaccgcgcacaacagcgcggcacgcccaaagcccctaccatccaaaaacaccccgcgccagcgccataagcaccgaacaaaaccgcccgtaaaaaaacccccgcggcccggtgggaccacacgacaagggggggcctccccaccgggtgtcaccccagacccagaggaaagcgcaaccatgcgagccgacaccacgaaggaccccctggagctctgaacacccatcggggaaccaggagaaccaacgccgtaaagcaaaact

SEQ ID NO: 500236 - DNA, 345 bp, Homo sapiens
  misc_feature (101)..(102): n is a, c, g, or t
  misc_feature (109)..(109): n is a, c, g, or t
ccagcccggggggaaacccctaaaaacccgattaaaaaggggttgctgtccccaggggggggctttgtcctcataaaaagggccagcgattccgagggggnntggggcnccagcttttatcacacgccgaccttttttgggccaaaattgtggggattttttaaaaaaggaaaaagcaagaaagaacccctggggtttttagtttgggaaaaattaggtttcaaatttttccattttggaaaaaatcatggggggggattttgttaaaaatttgggaactctttttttttttaaataaaaggatttcctttaaaaaaaattaaacccccccctttgtagggccca

SEQ ID NO: 500237 - DNA, 710 bp, Homo sapiens
ccggggttccgcggtggaggggtgctatacttgggatgcagtgcgctggtggggactggcagcaatcatgccctgggagctaactgtagagctttggataatgcttttgcaagtttgtacagagaatgtggaagtatcatctgagggtttcattgaccatcctgcatgcctccatcattgcccttcgtggctggccgcagatcttggctggcatgagtgcttaggctttaccgttctgagccagttccttcaatgggatatttgcatagcatccccttcagccaacaagcatgaaatggcttacctcgggaggcggtaggaactacatggaggttactcaattgccagggagaatgtagtagatgcgtggatgtccaaacatgtccaaggacagtatcggtgaagttatggtgccactggatgtaaggaagtactctggatggtatcccagcctgtaatgggtcgatttgaaaatgcccagcttggaagagtatggcttttccacactgtcaatgggaaacggttacaagcctcttgcaagatatcccaatgaatccaaaaaccatcaacattggtacaatggcctagtaatagtacactgattgagccaagcatcgttacaaagcaacgtttaggatgacctagtattgcgcgaattcatgacccatggatatttccatgaacgtaatcctcggaaacctggacctggt

SEQ ID NO: 500238 - DNA, 1649 bp, Homo sapiens
gcaggagcacctcaggcaagctggcaggctgagagacttcgacagcaactgctcggaacaggactgacgcgactgacacacactgcttaagcaaaccaaacacactatgtcagccagcactgactctgacactgcatggctctcgctgcctacgcactacacacgactgaccacgcgccgcttctgcctctctccctacacaagcactggcacacacgcactgaactgctcgcacggcaacgcactgtccacggaacgcagcaacacgcacaggcaaccgccagctgcacccctgcagcaagcacacgcaggcaacgcaacggctgcacagcttcacggccggcggcacggcacacacgacgcgcagacgccgcacagcctctccacgactacgccccacgcttgcgcacccctgcgcacactcccacaccgctgcgacgcagctgaccggacacgcacacaaccgcacgcacacgcccccacgcccacacacacgacgccacgcagcgccacgcaccctcccctgcgcgcacaccacgcgcgctttcgcacttaaaccgcccggccacacgcggcacacacgcacgcccttgcgccacatacaccgtcctaccccagcacgcaccggaacagccctgcccccgtacccacagcctactcggcacagcccccccgtggaacactctcctactgcaggcgaacctcgacgaactcgtcctgctatagcctccacgcgaacaccgactccgcactgcgcaaacggaacgcgcagccattctcatcgcgccggcgccgggcaccaagcaaactccccccccgacccctggcccacccgcccccccccccgccactcccccctcccccccaccccgcgaaacccacccacagcacccccacccaccccccacccacaccaaacgcctgccgccccaccccccctcaccccccgcccaaccctcacggctcagcaccacacacgcctcgtcaaccccaccacgcaactgcaacccccaaaccaccgagcccctccacacagcctccacccggcaacaacaaggcgatcggggacccgacacggccaccgctacctaccctcccatagcatccacgcccacacgcaccgcatcgcccccgtggcaaccctcccgggagcaccgcctggacggcccctcatcacacatctccggcctccccccccgcacccactccccgaagacgccacttacgaaatggaacgaaaacgcgaccccgaacacccccacgcgcccgccacagccacgcagccacgagacagccgaccgaccccacaacacactccgcaccacccacaccgaggcacgccaatcctctcaacactcaaaagcacccggccccccaaagcggagaccccagcgaaccacgaagtcgacctacacaacacgggcaaacaactagtgccccaccccgatacaccacccagacaacctgcgcaacgcgacccgcccacgccccagcgcatgacgacccacgcggatcctccaccataatcccccaactggacaacactccaagcaaccataagtaaagcaaagacaaaaagacaccgaccgctacacctaccagcccgtaaccgaccgactgcgacaggacagcaacgcaaccaccccacg

SEQ ID NO: 500239 - DNA, 677 bp, Homo sapiens
ataaaggcgataaatattttaaagcacggaaaatatgaacaagctattcagctgctatactgagagctattagcttgtgccctacagagaagaaatgtcgacctttctacattttatcaaaacggagctgctggccttttgaacagttgcaaaaatggaaagaagtggcacaagacatgtacgaaaagctgttgaacttaatcccaaatatgtgaaagcgctctttaaacgtgtcaaaagcccatgatgaagctatgacatagtaacgaaggaactgtttagaagatgtcactgcctgggttgtatagttgaggaagggttccataacattcaagcaaagcatgcggttagccgagtaaagcttcgttaaactccttgggaaaggagaaagccatgatgaacatatatgaagaatcgtgagacctcgtgatgccatctccaaaagttgtatctaaagtctatactttcagttgttcgtatatgctacgagaatgaatatctattttcaccaagtctcctatgacttagaaggagagaaatctgatgaagattgagacatggaaggggaggctttagtaagtgaaagaaaattctggatagcttaagaggccaaagcagtatatggaagaagaaaatctaggataaaatcataagtgaatgctcgagaagaaatagat

SEQ ID NO: 500240 - DNA, 360 bp, Homo sapiens
gtaccgctctcgtgagactggtgatactaaaaaattacaaatacacatagtacaaaaaaattacttatttgctttaatctaccataataatttcaaaattacattagcaacattttcactaaaaatatgataaattaaaacagtaattgtattgcaggtatttttattcttggtatatatccatgagggatgtacaaatatattactatatttaaaaatacttgaagcaattcctctttcagtggttaaaccatctactcatacacagttttagattcaattgtttcattttgctttatatttttaaagttttaaattttgttctaattttacattataattacaacaaaacatttacag

SEQ ID NO: 500241 - DNA, 301 bp, Homo sapiens
gttgggggcaagggtccctgcctaaactgtttacgtcccctgggaaggggacccaaggattaattggctgtgaaggatcctcccttagactggcaaaggaggaggcttagcaaaaggagtcatcatggaggaacggtgagaacatggaaccggactccaaaatgacgatttaaaaacccgggagcgaaaaaccaaggccaggttttgggtgtagggcccaaaaaaacaaaacagcccaaagccccaggtgcctggcctggcctagacctttggaatttaaattaaaccatttggagttgga

SEQ ID NO: 500242 - DNA, 509 bp, Homo sapiens
  misc_feature (15)..(15): n is a, c, g, or t
  misc_feature (21)..(21): n is a, c, g, or t
  misc_feature (80)..(80): n is a, c, g, or t
  misc_feature (108)..(108): n is a, c, g, or t
  misc_feature (148)..(148): n is a, c, g, or t
  misc_feature (159)..(159): n is a, c, g, or t
  misc_feature (210)..(210): n is a, c, g, or t
  misc_feature (225)..(225): n is a, c, g, or t
  misc_feature (277)..(277): n is a, c, g, or t
tgtttataagtattngattcntaatacccatattttggagttttagaggggaaattataggcatatggttagccatttancagatatcctccccccatataccaaaangggtagtaattttgctgaatgttttatgttgaagttattnccaaggtattncatggatatgcccatgacatatttggaaaaaatagaaggaattgatttttncaaaaaggttaagtnccaaaggtaggtagtttagtctacagaaataagttagtcacttttggctttnctaatttgtactgtaacattcttttattttgttttaaatatatgtttctcaagtaaacaatttaggtaattttccatacctttttctttctgatgcagacttcaggttaattaatattttactgcatctgatgatgtattatatgtttgaagcctagtgacttttaattttgatgttcttgtgatttcatatgttgtattcttcaagcaataaaattctgatgtgttttata

SEQ ID NO: 500243 - DNA, 351 bp, Homo sapiens
tttttttttttcctttaaaaaccccggggcggtttcacctttcggtttttttctttggccgggggggggtttaaatttttttccgggaaaaagtttttcccttttggctttttttggttccctttttaaaaaatttttttcaaaaaaagggggtggggccggttgggattttccgggattttttttaccccggggtttccaaaaaagggggccaatgggccaaattttttagaggtttttttttttttttccccccccctttccggtttttttttttttttttttcgggttttgggaagggggggttttttttttttttttttttcgggggatttttttccctttagggga

SEQ ID NO: 500244 - DNA, 163 bp, Homo sapiens
ctaaaggcacatatgccatcatgtcactcaatcctagcaacaattcgcagagcaggtgtgctactgcctcatatgcaagataagggaatgaggctgcgcacgatgacgtcattagcccaaggtcatctagcattgtaacagcgagctggtacaggaccttatg

SEQ ID NO: 500245 - DNA, 1004 bp, Homo sapiens
  misc_feature (137)..(137): n is a, c, g, or t
ctacttctcgcgttcgctgtgtcggcgcgctgtatggttgtgagcaagtgtcgctacggtgtggtgcgcaatgttttgtctcgccggggtgtttcttcctggttggtgtccagatgctgttcccggtgtggcctgtnttaatgggttgtgcgtggcctttagcccgcggcttcgggttgcgcgtggacgctcgctgattgggcttggggtaccccgtggaccgctgcggtttttcccgcgcggcggcactattggtcctgggttcccccggggttctaaggttatatcatggatctcggacgcttcctccggggggccatcaccagttggttgtgccttcgtgcttttttggaacctaggggtaccatccttcgtcttcgttacacggccacgaggggcccactttggggcgagtggagtttgcctgagtgcgctgtggcagtctgggcgcactatagcgcagccagttgtggagggtgtgagccccccgggctccaggatgctgctgccaccagatcgggcgccgtatttgcctctcctaggaggggcggctcattcccgttgttgccccctttattgcccggggcgctcctcctctgatcgcactgtgcgtgcttccccccgatagttgccattctgcctcggttgttgtccgcccggctgcggtcactttaccggcttttttatgtgcgccccaacgcctcttttcggcgcatccctcgggttagtccccgcgttagtcttggggtcatccctatagcgcttatcggctccacccatagtggcttctccttcacctccggaggggccccatgtttacttttgttgtagacacccgtaatcgatagacgtggtttgcacgacaagtaggagagaaacctttcatgcgtgggacgcgcaaaacagcactatgagtcgagaggagaatacgccccgcccttaacccctgcggggcggacacgactgggagcccccccccctgccccctgaacccccacatgtca

SEQ ID NO: 500246 - DNA, 151 bp, Homo sapiens
tagatgtctagatcaaagaagtgtgaaagagcacagatagcatagcgaaggtcacttcaaggacctggagaaacaagaacaaaccaaaccaaaacccagcagaaggaaagaaataacaaaaatgggagcagaactaaataaaactgaaaca

SEQ ID NO: 500247 - DNA, 90 bp, Homo sapiens
  misc_feature (43)..(43): n is a, c, g, or t
aggtatagtgttccctaatcatgtacttgtgaagcacccggantttttcatatagtctaaaagctagaagaacaagagtgtatttcgtgg

SEQ ID NO: 500248 - DNA, 616 bp, Homo sapiens
ataatctggatgtcctggatgactatgctacacatattcctatagcagtgctctgatctgaaacaagcatcgattctttgggatcctctatctgctatgtagtgaagacagcacagattgaaagtgcgtaagagacacatactctgcttgatataaacaacagcttttgacatgctgtgtaacactagaagagactattaaataaaggcatacttagttaattatatcagtatgacatgcacatactgcatcttgtcctggataatgatcgcatcagagacacatacaattagacttattccctagtctgaagcaatcatatgccatcttactagggtatatatatcagtctctcatatgacattcgagaactcattatgcgagccgctcataaagaccactgatggacatctcattctgacgtagaatgacacttcattatcaagtataaccctgtatgagagatgctataatgaaaggtcaggcgctatggttcatgcctgcgaagtcgaactattagaagcatatgcagagatatcatgctccgtcgctgccatgagatatgcttgaggatcatgacgctccgtttctacttggattcatgcatatccggccc

SEQ ID NO: 500249 - DNA, 80 bp, Homo sapiens
ccgaagaaaaaaaaattgaaaaaacccccccacaaaatattctatcccccccccccccaaaaaaaaaggggggccctctc

SEQ ID NO: 500250 - DNA, 219 bp, Homo sapiens
ggtgtattggaacatgtcctgtgcccctatcttctcggagaccacgcttatcaaccgtgtcgtgtgacctccacaccttggatattgtgcgatttgtgagcgccgctcgagcggagttggtaacatgttgggttttttcccacccatcatggcctaagatgttccagttttctcagtgtacgcagcctgtgagatagatgattatggcacgcaaaagga

SEQ ID NO: 500251 - DNA, 174 bp, Homo sapiens
  misc_feature (101)..(101): n is a, c, g, or t
ttttttcccccctttttttttccccccccccggccctgggggaaaaaaaaccaggggggttttttttttttgggaggccccccggggggtttttttggggntttttttttaggggttcccccccccgggttttttttttccccccaaaaccttttttttttttttgggggggga

SEQ ID NO: 500252 - DNA, 281 bp, Homo sapiens
  misc_feature (123)..(123): n is a, c, g, or t
  misc_feature (135)..(135): n is a, c, g, or t
  misc_feature (173)..(173): n is a, c, g, or t
  misc_feature (199)..(199): n is a, c, g, or t
cggcacgagttccaaattacctcatccaaatccattctcctgtttcttttctctcaatcatacctggtatcagcttgaagctccaaatacctggcaggcaccctctggtctctattggatttntgggccacaggnctaccaacagttaccagccaaatggacaggggcttgtntactcagaacaattaggccatctttntttttgcttccactgcaacacaaggaaaccttagggtatcctgtctatgatgaaattaaaggaagaaacgaaagtaatgtag

SEQ ID NO: 500253 - DNA, 764 bp, Homo sapiens
tttctcagaggtacccggctgtcggcaagttcgtcagtgagtggatgattttgtggagttaaatagagctacattggagagagaactctgcatgaccggaaccatattaccaatctgatgagcagatgctggcatcttggctgccaggatcagtgggcctgcggagaattgagacatgaacaacttatgctcctgatgccaaacatgttcctactctttcctctaactgtggagaggacattctggagtgacatgatggactccgcacagagcttaataacctattcatggactctttatcttcaagccgaggacggaaaaatagccatattccaggctaagccagacatccagtacgcaccacatttggagcaggagcctacaattttgggagaattatctgtaagcacaatgtcctatctgcacatgagaaattcacatgcgcacaggagtcttcttgaagatggaaaaagtgatggcgccttaagatgcctgtctcttaactgtgggcggactcaaacacgactcttgtactctcggcgatggtattggtgtggatttgcgggcaacctgtgctacaaccggggagcaacccgtgccatctgagatgctcgctatccatggcgaccccggagcttatgaatgaacaaaggccaaccttattcccctcctgccatgcgtggcgggtggccagacgtaacacttgagagtattgaagacacacggacctttccctacacagagaatgctcgcctttcagaaat

SEQ ID NO: 500254 - DNA, 150 bp, Homo sapiens
aggacacaggattgcttcgatgaattagagacctaatcagtgttagctacgctcattggattagtcggttaggattgcggtctaacgatctatggcttgttatcagcttggtcactgctgtgcgtcgaactccggtgtgtttgagcactc

SEQ ID NO: 500255 - DNA, 759 bp, Homo sapiens
tgcgttcaacatcgtttaccttgggaaccaggtcgatcgcgaaggtgtttaccgatacccgcatgatttatcatgaaccatctctgacgatgccgaagggttgaacccctgtaatgaatcaatttcggggccgcggtgtaagttgacggggtttgcggcccatggtgtctgctcaatccatggaagccccttgccgagatacgctaagatttcgatccagacacgatacctgctaccactgttatgagggcactgtatcgtcttccttgggccaatagaataccaggtcccaatcggggacgtattcagttgcttttatagtacagaacaaccgggactaaaagaataagactagcactgctatgataacccatcttccgggaagggaggccaggatgcctcagtgtttaaatgacatgctcaagaatgaagtccaaagacgggaactcatgctgcgccctctaggcaggagccacgcgcggagtgtccaagactagcctgtgcttgggaaaggggcgtgtggaaagagcacggcttccaggagagaggccccctaaacccgtcttggccgggtaataggcctgggtcccactcacccatgccggcagctgtcaccatgtgatcttattcttggatacctgggagggggccaatgggggacctcagggggaggccccctctggaaatgtggttcccagggatgggcctgtacatagaagccaccggatggcacttcccataccgacggagagtattttg

SEQ ID NO: 500256 - DNA, 422 bp, Homo sapiens
gaaactgatctatctaaacacagatcaggtcaggtcactcacctcctcagaaatcttcagtagctctatcattaaccacacagggggttcctaactcgcggtctgggcatgggaggacctttcccggccggatcccggcgatcatcttgtcctgaaatatatactcaggccagggctcaccccttctttacaatggcgggggcgggctcaagagaggcaaacagccatctctctcattcttatcttcccggtcaagacttcacataggtggacggatgctagactatgatgatgagtctccggtgaaagtttctaagtagaactctctcagggtttctagaagcgttttggttgaagaaaatatggtggggagagcgggattttaaagtggtggagctctgggtaaacaaaattatgtgtgc

SEQ ID NO: 500257 - DNA, 572 bp, Homo sapiens
tgaggtagacactagagcgatccccccttcggattacctcaacacaatgaggctcactcacccaccacattaacaacataaaaacctcattcacacagagaaaacaccctcatgttcatgcacctaattggaagcgccaccctagacaatatcaaccatgtaaccttccctcatacacattatcactcttcacacattctaattactacatgactatcctcagaactcgctagtcgcacttaatccaagacctacgattttcacatcttcatagtaagacctctaccatgcacgacaaacactataatgacccacacaggtgcactgacgtaggtggcctgcagatcatgttagcaggttaggctgtacggccagaggctataaggttgcaatgcagtaggcatgatggtttcgcataataactcagtatggggataaaggggtgtaggtgtgcctatgtggaaagcaagtgggctcagggcatttttcatcttagacgcgaaagcctataaatcactgcgcccgctcataaggggatggccatggctaggtttatagatatagggtggttg

SEQ ID NO: 500258 - DNA, 1031 bp, Homo sapiens
  misc_feature (162)..(162): n is a, c, g, or t
ggagtgcagtggtgcaatcatagctcgttgccatctcgacctcctgggcttaagcgatcctccccactcagcctcccaaatagctgggaccacagacgtgcgctgccttgccaggctaatttaatattttttttttccccacgcgacagtggacgaactgcnttctcaaaaaaaaaaaaaaaaaaaaaaaaaaaaaagaggggggttcttcacacgaaacaaaaaaacagttgtgtggtgcctccccagcggggtgggggggagtgagagggggtgccacagtttaggaaaggagagtgtgtgttctcccacattttttctttaaggttattaggggaccttcccaaaaaaacctcaggggaggggcatagtggtgggtgtgggtgtgggagacaagaggaattgggtggtggagacgggcggggtgatttcacccacactcttcttatttcagggggggggaaacagacaatggcgcttttggaaggaagcgggtttcaacggctctcaacagagttgtgcacgcagtgtggaacgaggggatcagaactgtgcattgtgacagcattttgattggacgagtgttgcagacagagggacaacgagggtttacaggggacaacagggtgaagaaaccaggcaaccttcttttctctggggggtggggtacgccaccagctgccggggggtaccacaaccccggggggggggtggccccacacattttgtcttggcgacacccgctgacagagttggggaactgtattattaaggacaatatgagagacttaagtgggcgagtcaagaacatgggggatgaaaagagactctgtgatcaccagatatgagaagacaccaagatttcccggtggagacattttgggcccggtgggaactctttgggacacgtggctacagaacaggtttttctggaagataattttacaagggagggtggacgggaagaactcttctgtgaaaggggagacttaactggggttaaatgtgtgcaagttagagagtacgggtag

SEQ ID NO: 500259 - DNA, 455 bp, Homo sapiens
cacgaggggcaattgaatgtttattcaaaacatatctgaacctcaatggtctggaaaatgcttaaattcatgaacagttgcaaaatttgtagcttcggaagacaatgaaaccagacttcttggtaacattttatagtagtctgagattttctcattgtactgtctaatgagatatctacatgtctattgttttttaaggctgtggtgaatgtcgagttatgcctgtgctttggccatcattgctactgggcaaagtctgttctctaagttataccccttcattaacaacaatgtaatgctagatgctgaaacaaataaaccccaaattccttgtggcttaacataatgtaaatttatttctcactcatatcaagctgaagtggcagctggggctctactctctgcagctcacagggacccagttttatgaaacactcagtgtccaaaatcactca

SEQ ID NO: 500260 - DNA, 355 bp, Homo sapiens
ggacttgtcacagctgccaggagtggtattgatcaatgtgaggctctgggtattgcttcctttcaatttgtctcagagctagttgtagtgagtcattctgtcttatatgatcgtgtatcgtgaaccatcagtaatagtgttgtcaggctagccaaaaagggttagaggtcttgcgggctggggaggttgcaggagcgactacatgtgcactacatgtgcgtctcgttgacttgagcaatcttgagcaatagcggtgttttgtaactttttcctaagactggtgaagttaagttttcttgtctctctttatgcactccttccctacctgctattattcatatacagaataagagca

SEQ ID NO: 500261 - DNA, 145 bp, Homo sapiens
actctttttggtgttttatattgataattgttgtgatgaaattgatggtccctaagatagagtttacacctgctaggagagcaaagacctcaaaagagcaatgacctcaaaagagcaaagaccctaagagagcaatgacccctaa

SEQ ID NO: 500262 - DNA, 325 bp, Homo sapiens
agcccatcgcactgctggccagcaccgtgattgatcaactgctggcgcagatcgctggcaatgccccgatttcccattgcctttctcttcatgtccggccgggcgaaagcactcaaccccatgaggagactcttgatgcgcgcattcagtaaaaccctggcagctgtgctgctgtgcggtgtggccagcctggcccaggccgccgataccgcgatttgctacaactgcccgccggactgggccgactggggcacgcaactcaaggccatcgccgccagtaccggggtgccaagtgcccctggacaacaagaactccggccaatcc

SEQ ID NO: 500263 - DNA, 624 bp, Homo sapiens
  misc_feature (262)..(262): n is a, c, g, or t
ttataatctcgtcagggaatatcacaggtgcatatactttcctagttaatgtactggagcagcaagacgtgaaactgcttgaggagcccatggcaggacgacagacgcagcccaagcagagacagaagaatctgatgatgaagctgcagtagaggaagaagaagaagaaaagaaaccaaagattaacaaagttgcccaaactgtctgggactgggaacttatgaatgatatcaaaccaatatggcagagaccatcaaaagangtaggaggaagatgaatacaaagctttctacaaatcattttcaaaggaaagtgatgaccccatggcttatattcactttactgctgaaggggaggtacctccaaatcaatttaatttgtaccaccatctgctccacgtggtctgtttgacgagtatggatctaaaagagcgatacattaagctctatgtgcgcgtgtattcatcacagacgacttcatgatatgatgcctaatactcacttgtcagggtgtgtgactcagatgatctccctgaatgttccgcgaagctctcagcacataactgctaaggtgataggagagctgtcgtaaacgctggcatgatcagagatgctgatgataatc

SEQ ID NO: 500264 - DNA, 4428 bp, Homo sapiens
  misc_feature (2842)..(2842): n is a, c, g, or t
  misc_feature (3016)..(3016): n is a, c, g, or t
  misc_feature (3438)..(3438): n is a, c, g, or t
  misc_feature (4220)..(4220): n is a, c, g, or t
  misc_feature (4222)..(4222): n is a, c, g, or t
  misc_feature (4224)..(4224): n is a, c, g, or t
  misc_feature (4226)..(4227): n is a, c, g, or t
  misc_feature (4230)..(4231): n is a, c, g, or t
  misc_feature (4233)..(4233): n is a, c, g, or t
  misc_feature (4236)..(4238): n is a, c, g, or t
ggagagtgggccttaccagaagaaatggttgacaatttaccaccctccaacaattgcatactgggccatattcttcacaggctagctgaaaaatctcttcctcctcgagcggaatcaacaacacctgaattaccttcatttgctgttaaaggatgcttattggggaaaacattaagtggaaaaactaccattttaaggtctctacaaaaagactttcctatacagatactttctattgacactcttgtccaagaagctatccaagcatttcatgacaatgaaaaagtcagtgaggttctaccaattcagaaaaatgatgaagaagatgctctaccagttctgcaagaggagattaaagaaagccaggatccacaacatgtattttcagctggtccagtttcagatgaagtattaccagaaacagaaggtgctaatgctgataaaacaccaaaagctgaagaagtcaaatcaagtgatagtttcttaaaactcactacacgtgctcagcttggtgcaaaatcagaacagttgctgaagaaaggaaagagcattcctgatgtgctgcttgttgacatcatagtaaatgctattaacgagatacctgtgaatcaagactgtatcctagatggttttccaatgactttaaaccaagcacagcttctggaagaagctcttacaggctgcaatagaaacctcacagaagtggaaagaaaaaaagcacaaaaatccacattggctattgatcctgcgacttccaaagaaatacctcttccctctcctgcatttgattttgtcatattattagatgtttcagatacttcctcaatgagtcgcatgaatgatattatagctgaagaattgtcctataaaactgctcacgaagatatcagtcaacgtgtagctgctgaaaaccaagataaggatggagaccaaaatttaagagaccagatacaacatagaattataggcttcttggacaactggcctttattggagcaatggttttcagagccagaaaatattttgataaaaatcaatgctgaaatagataaggaatctttatgtgaaaaagtaaaagaaattcttacgactgaaatagcaaaaaaaaagaataaagttgagaagaaattagaagaaaaggaagctgagaaaaaagcagcagtttccctggctgagcttccacttcctacacctcctcctgctcctcctcctgaaccagaaaaagagaaggaaattcatcaaagccatgtgccttcaaaaactcctactgcaaaaggaaaacctcaatcagaagccccgcatggtaagcaagaatctcttcaggaaggaaaagggaagaaaggtgagaccgcactcaaaagaaaaggttctcctaaaggaaaatcatcaggaggaaaagtaccagtaaagaaatcacctgctgactctacagatacatcacctgttgcaatagtgccacagccacctaagccaggatcagaagaatgggtctatgtgaatgaaccagttcctgaggaaatgcctttgtttttagtaccttactgggaactaatagaaaattcctatataaacaccatcaaaacagtactcaggcatctgagggaagaccagcatactgtgcttgcttacttatatgagattagaacaagtttccaggagtttctaaagcgtccggatcacaagcaagattttgtagctcaatggcaggctgatttcaactcccttcctgatgacctgtgggatgatgaggaaacaaaggctgaactacatcaacgagtgaatgatctgcgagaccgcctgtgggacatttgtgatgcccggaaggaagaggcggagcaggagcggcttgacatcattaatgagagctggttacaggacactcttggaatgacaatgaaccatttcttttccctgatgcaggcagagctgaaccgtttccaagatacaaagagactccttcaagattattactggggaatggaaagtaaaatcccagtagaggacaacaagagatttactcgaatccctttggtccaactggatagtaaagacaattctgaaagccagcttagaattcctctagttcctcgaatatccatttctctggaaacagttacacccaaaccaaaaacaaaatcagtactgaagggcaagatggataactccctagaaaatgttgagtccaactttgaggccgatgaaaagttggtcatggacacctggcagcaggcttctttagcagtatctcacatggtggctgctgaaattcatcagaggcttatggaagaagaaaaagaaaaccagccagcagaccccaaagaaaaatctcctcagatgggtgcaaataaaaaagtcaaaaaggagccacccaagaaaaaacaggaagacaaaaaacccaaaggtaaatcaccacctatggcagaagcaactcctgtcatagtaacaacagaggaaattgctgaaatcaaaaggaaaaatgaactgagggtcaaaataaaggaagaacaccttgctgccttgcaatttgaagaaatagccacgcaatttcgacttgaactgataaagacaaaagcattggctcttcttgaagatttagtaacaaaggtggttgatgtatataaactcatggaaaaatggcttggtgagaggtatttgaatgaaatggccagtacagaaaaattaactgacgtagctcgctatcacattgaaacatctacaaaaattcagaatgaactttatttaagccaagaagacttcttcattaatggcaatataaaagtcttcccagatcctcccccatcaatacgtcctccacctgtagaaaaggaagaagatggtaccntgaccattgaacagcttgacagtcttcgagatcagttcttagatatggcacctaaaggcataataggaaataaagcatttactgacattctgatcgatttggtgaccctgaaccttggcacaaacaactttcctagtaattggatgcaccttacccaacctgaattacaggaantaacatctttattaacagtcaactccgagttcgtggactggcggaagttcctgttagtaacctcaatgccttggcccattcccttggaggaggagctccttgagacccttcagaagttcaaggctgtggataaggagcagttgggcaccatcacttttgagcagtatatgcaggctggtctgtggtttacaggagatgaagatataaaaattccagaaaatcctcttgaaccccttccatttaataggcaggagcatcttatagagtttttctttaggctatttgctgactatgagaaggatccaccccagcttgactacacacagatgctgctttactttgcttgccacccagacaccgtggaaggagtctacagggccctcagtgtggctgttggaactcatgtcttccaacaagtcaangcttccattccaagtgcagaaaagacctcctcaactgatgcaggtccagctgaggaatttcctgaacctgaggaaaatgctgcaagagaagaaaggaaattaaaagacgacacggagaaaagggaacagaaggatgaagaaatccctgaaaatgcaaacaatgaaaagatgtccatggaaacactactcaaagtgttcaaagggggaagtgaagcacaggactccaatagatttgccagccacctaaagatagagaacatttatgcagagggcttcataaaaacatttcaagacctaggtgccaagaacctggagccaattgaagtcgctgttctcttgaagcatccttttattcaagacctgatttcaaattattcagactataagtttcctgtacacatcatctatgtagtggaaatgatagtgtgtgcaaaaggttgggcaccacttccatcaggaaaacagtgtgcaagatggagaaactaaggacaaaccccagagaaactggacaaacccagcagaagaaaggaagaactgcaactcagaaatcacataaccaccaagcaggtctggaccacacatgctaaatgtgcatccactatggcgagtcccaggcctttaacagcagggactaaggagggcagaggctgacaccaaccccctttcatactgtagcactacatccctctcagataccagtttaacacgaagtctccctgtttgactcctgtgagttgtgtattgaactacaaagtgtttgctgagttgaaaataaaagcgcntncncnntgnnanaannnagattgtgtatcttgacttctcaatgatagcaagttacattttgcagttttcttcctatacccacaaatgaaactattcagacttaaatatcttcctgtgtgcctaaacgtttttgttttaagttgctgatccttttaaatattaaattattaattaatattaaaattaattttattgcctgtattagta

SEQ ID NO: 500265 - DNA, 347 bp, Homo sapiens
  misc_feature (325)..(325): n is a, c, g, or t
gggctccccagcataccggggggtgtgtaaggtgtggactaacccgccgccaccaccctcggttccagcaggctcggcatgaatctgggtgcactggcacctctttttcacatgggccacagtttcagtacttcagcctcaggggggtccctgatgtatatctagggtgtaactcaagcccagttggagattggggagtctcgggtgatcacatctggtctcggcggtaggaatcaacagagggagacgtcctctacataaaagctccaggtgaaaagctactcctagtcttaacatgggcagtcctggtgtcactgtcttcggnccctgatgggagcccaaggggt

SEQ ID NO: 500266 - DNA, 1396 bp, Homo sapiens
  misc_feature (1319)..(1319): n is a, c, g, or t
ggagagtgggccttaccagaagaaatggttgacaatttaccaccctccaacaattgcatactgggccatattcttcacaggctagctgaaaaatctcttcctcctcgagcggaatcaacaacacctgaattaccttcatttgctgttaaaggatgcttattggggaaaacattaagtggaaaaactaccattttaaggtctctacaaaaagactttcctatacagatactttctattgacactcttgtccaagaagctatccaagcatttcatgacaatgaaaaagtcagtgaggttctaccaattcagaaaaatgatgaagaagatgctctaccagttctgcaagaggagattaaagaaagccaggatccacaacatgtattttcagctggtccagtttcagatgaagtattaccagaaacagaaggtgctaatgctgataaaacaccaaaagctgaagaagtcaaatcaagtgatagtttcttaaaactcactacacgtgctcagcttggtgcaaaatcagaacagttgctgaagaaaggaaagagcattcctgatgtgctgcttgttgacatcatagtaaatgctattaacgagatacctgtgaatcaagactgtatcctagatggttttccaatgactttaaaccaagcacagcttctggaagaagctcttacaggctgcaatagaaacctcacagaagtggaaagaaaaaaagcacaaaaatccacattggctattgatcctgcgacttccaaagaaatacctcttccctctcctgcatttgattttgtcatattattagatgtttcagatacttcctcaatgagtcgcatgaatgatattatagctgaagaattgtcctataaaactgctcacgaagatatcagtcaacgtgtagctgctgaaaaccaagataaggatggagaccaaaatttaagagaccagatacaacatagaattataggcttcttggacaactggcctttattggagcaatggttttcagagccagaaaatattttgataaaaatcaatgctgaaatagataaggaatctttatgtgaaaaagtaaaagaaattcttacgactgaaatagcaaaaaaaaagaataaagttgagaagaaattagaagaaaaggaagctgagaaaaaagcagcagtttccctggctgagcttccacttcctacacctcctcctgctcctcctcctgaaccagaaaaagagaaggaaattcatcaaagccatgtgccttcaaaaactcctactgcaaaaggaaaacctcaatcaggtgattgacagaatgatttataatcctnttttcagtttcttatttttactcagtaaagaattataaattatagtctatctacattcagactttgggcaactttca

SEQ ID NO: 500267 - DNA, 473 bp, Homo sapiens
attgcgagatatcccaaaggcatactgtctcatcgatattataggggtccatcacaacccacatgtgtggcggatcctgaggtgcatgcctaccccattcaacagcacacaccccatacactctaataaagtgtgtgtctacgaccaccttccgctttgacccagagaacagcaaaggggaggtcaactctggcttatattcctttatccgacagggcccaggcactgccatacgggcaggcgttcgccatggaggagatgaaagtggtcctggcgttgatagctacagcgccactgagttacacaggctggaacgcagtggcgctgtaccagctcactgcaggactcacaactggggtcaagccatgatggcacctcagcctccaaagtagccgggaccacaggcgtacacccccacaactgaatcctttacaacttattaagagaagaagtctagctgttgcccaagatga

SEQ ID NO: 500268 - DNA, 3982 bp, Homo sapiens
  misc_feature (2842)..(2842): n is a, c, g, or t
  misc_feature (3016)..(3016): n is a, c, g, or t
  misc_feature (3438)..(3438): n is a, c, g, or t
ggagagtgggccttaccagaagaaatggttgacaatttaccaccctccaacaattgcatactgggccatattcttcacaggctagctgaaaaatctcttcctcctcgagcggaatcaacaacacctgaattaccttcatttgctgttaaaggatgcttattggggaaaacattaagtggaaaaactaccattttaaggtctctacaaaaagactttcctatacagatactttctattgacactcttgtccaagaagctatccaagcatttcatgacaatgaaaaagtcagtgaggttctaccaattcagaaaaatgatgaagaagatgctctaccagttctgcaagaggagattaaagaaagccaggatccacaacatgtattttcagctggtccagtttcagatgaagtattaccagaaacagaaggtgctaatgctgataaaacaccaaaagctgaagaagtcaaatcaagtgatagtttcttaaaactcactacacgtgctcagcttggtgcaaaatcagaacagttgctgaagaaaggaaagagcattcctgatgtgctgcttgttgacatcatagtaaatgctattaacgagatacctgtgaatcaagactgtatcctagatggttttccaatgactttaaaccaagcacagcttctggaagaagctcttacaggctgcaatagaaacctcacagaagtggaaagaaaaaaagcacaaaaatccacattggctattgatcctgcgacttccaaagaaatacctcttccctctcctgcatttgattttgtcatattattagatgtttcagatacttcctcaatgagtcgcatgaatgatattatagctgaagaattgtcctataaaactgctcacgaagatatcagtcaacgtgtagctgctgaaaaccaagataaggatggagaccaaaatttaagagaccagatacaacatagaattataggcttcttggacaactggcctttattggagcaatggttttcagagccagaaaatattttgataaaaatcaatgctgaaatagataaggaatctttatgtgaaaaagtaaaagaaattcttacgactgaaatagcaaaaaaaaagaataaagttgagaagaaattagaagaaaaggaagctgagaaaaaagcagcagtttccctggctgagcttccacttcctacacctcctcctgctcctcctcctgaaccagaaaaagagaaggaaattcatcaaagccatgtgccttcaaaaactcctactgcaaaaggaaaacctcaatcagaagccccgcatggtaagcaagaatctcttcaggaaggaaaagggaagaaaggtgagaccgcactcaaaagaaaaggttctcctaaaggaaaatcatcaggaggaaaagtaccagtaaagaaatcacctgctgactctacagatacatcacctgttgcaatagtgccacagccacctaagccaggatcagaagaatgggtctatgtgaatgaaccagttcctgaggaaatgcctttgtttttagtaccttactgggaactaatagaaaattcctatataaacaccatcaaaacagtactcaggcatctgagggaagaccagcatactgtgcttgcttacttatatgagattagaacaagtttccaggagtttctaaagcgtccggatcacaagcaagattttgtagctcaatggcaggctgatttcaactcccttcctgatgacctgtgggatgatgaggaaacaaaggctgaactacatcaacgagtgaatgatctgcgagaccgcctgtgggacatttgtgatgcccggaaggaagaggcggagcaggagcggcttgacatcattaatgagagctggttacaggacactcttggaatgacaatgaaccatttcttttccctgatgcaggcagagctgaaccgtttccaagatacaaagagactccttcaagattattactggggaatggaaagtaaaatcccagtagaggacaacaagagatttactcgaatccctttggtccaactggatagtaaagacaattctgaaagccagcttagaattcctctagttcctcgaatatccatttctctggaaacagttacacccaaaccaaaaacaaaatcagtactgaagggcaagatggataactccctagaaaatgttgagtccaactttgaggccgatgaaaagttggtcatggacacctggcagcaggcttctttagcagtatctcacatggtggctgctgaaattcatcagaggcttatggaagaagaaaaagaaaaccagccagcagaccccaaagaaaaatctcctcagatgggtgcaaataaaaaagtcaaaaaggagccacccaagaaaaaacaggaagacaaaaaacccaaaggtaaatcaccacctatggcagaagcaactcctgtcatagtaacaacagaggaaattgctgaaatcaaaaggaaaaatgaactgagggtcaaaataaaggaagaacaccttgctgccttgcaatttgaagaaatagccacgcaatttcgacttgaactgataaagacaaaagcattggctcttcttgaagatttagtaacaaaggtggttgatgtatataaactcatggaaaaatggcttggtgagaggtatttgaatgaaatggccagtacagaaaaattaactgacgtagctcgctatcacattgaaacatctacaaaaattcagaatgaactttatttaagccaagaagacttcttcattaatggcaatataaaagtcttcccagatcctcccccatcaatacgtcctccacctgtagaaaaggaagaagatggtaccntgaccattgaacagcttgacagtcttcgagatcagttcttagatatggcacctaaaggcataataggaaataaagcatttactgacattctgatcgatttggtgaccctgaaccttggcacaaacaactttcctagtaattggatgcaccttacccaacctgaattacaggaantaacatctttattaacagtcaactccgagttcgtggactggcggaagttcctgttagtaacctcaatgccttggcccattcccttggaggaggagctccttgagacccttcagaagttcaaggctgtggataaggagcagttgggcaccatcacttttgagcagtatatgcaggctggtctgtggtttacaggagatgaagatataaaaattccagaaaatcctcttgaaccccttccatttaataggcaggagcatcttatagagtttttctttaggctatttgctgactatgagaaggatccaccccagcttgactacacacagatgctgctttactttgcttgccacccagacaccgtggaaggagtctacagggccctcagtgtggctgttggaactcatgtcttccaacaagtcaangcttccattccaagtgcagaaaagacctcctcaactgatgcaggtccagctgaggaatttcctgaacctgaggaaaatgctgcaagagaagaaaggaaattaaaagacgacacggagaaaagggaacagaaggatgaagaaatccctgaaaatgcaaacaatgaaaagatgtccatggaaacactactcaaagtgttcaaagggggaagtgaagcacaggactccaatagatttgccagccacctaaagatagagaacatttatgcagagggcttcataaaaacatttcaagacctaggtgccaagaacctggagccaattgaagtcgctgttctcttgaagcatccttttattcaagacctgatttcaaattattcagactataagtttcctgatattaaaataattctccaaaggagtgaacatgtacaaggaagtgatggagagagatcaccttcaagacatacagaggaaaagaaatgaagacaaaagagtgtgatttttttaattctgcaataaatcttccaaaaattaaatgtgaaaa

SEQ ID NO: 500269 - DNA, 4865 bp, Homo sapiens
  misc_feature (2842)..(2842): n is a, c, g, or t
  misc_feature (3899)..(3899): n is a, c, g, or t
  misc_feature (4321)..(4321): n is a, c, g, or t
ggagagtgggccttaccagaagaaatggttgacaatttaccaccctccaacaattgcatactgggccatattcttcacaggctagctgaaaaatctcttcctcctcgagcggaatcaacaacacctgaattaccttcatttgctgttaaaggatgcttattggggaaaacattaagtggaaaaactaccattttaaggtctctacaaaaagactttcctatacagatactttctattgacactcttgtccaagaagctatccaagcatttcatgacaatgaaaaagtcagtgaggttctaccaattcagaaaaatgatgaagaagatgctctaccagttctgcaagaggagattaaagaaagccaggatccacaacatgtattttcagctggtccagtttcagatgaagtattaccagaaacagaaggtgctaatgctgataaaacaccaaaagctgaagaagtcaaatcaagtgatagtttcttaaaactcactacacgtgctcagcttggtgcaaaatcagaacagttgctgaagaaaggaaagagcattcctgatgtgctgcttgttgacatcatagtaaatgctattaacgagatacctgtgaatcaagactgtatcctagatggttttccaatgactttaaaccaagcacagcttctggaagaagctcttacaggctgcaatagaaacctcacagaagtggaaagaaaaaaagcacaaaaatccacattggctattgatcctgcgacttccaaagaaatacctcttccctctcctgcatttgattttgtcatattattagatgtttcagatacttcctcaatgagtcgcatgaatgatattatagctgaagaattgtcctataaaactgctcacgaagatatcagtcaacgtgtagctgctgaaaaccaagataaggatggagaccaaaatttaagagaccagatacaacatagaattataggcttcttggacaactggcctttattggagcaatggttttcagagccagaaaatattttgataaaaatcaatgctgaaatagataaggaatctttatgtgaaaaagtaaaagaaattcttacgactgaaatagcaaaaaaaaagaataaagttgagaagaaattagaagaaaaggaagctgagaaaaaagcagcagtttccctggctgagcttccacttcctacacctcctcctgctcctcctcctgaaccagaaaaagagaaggaaattcatcaaagccatgtgccttcaaaaactcctactgcaaaaggaaaacctcaatcagaagccccgcatggtaagcaagaatctcttcaggaaggaaaagggaagaaaggtgagaccgcactcaaaagaaaaggttctcctaaaggaaaatcatcaggaggaaaagtaccagtaaagaaatcacctgctgactctacagatacatcacctgttgcaatagtgccacagccacctaagccaggatcagaagaatgggtctatgtgaatgaaccagttcctgaggaaatgcctttgtttttagtaccttactgggaactaatagaaaattcctatataaacaccatcaaaacagtactcaggcatctgagggaagaccagcatactgtgcttgcttacttatatgagattagaacaagtttccaggagtttctaaagcgtccggatcacaagcaagattttgtagctcaatggcaggctgatttcaactcccttcctgatgacctgtgggatgatgaggaaacaaaggctgaactacatcaacgagtgaatgatctgcgagaccgcctgtgggacatttgtgatgcccggaaggaagaggcggagcaggagcggcttgacatcattaatgagagctggttacaggacactcttggaatgacaatgaaccatttcttttccctgatgcaggcagagctgaaccgtttccaagatacaaagagactccttcaagattattactggggaatggaaagtaaaatcccagtagaggacaacaagagatttactcgaatccctttggtccaactggatagtaaagacaattctgaaagccagcttagaattcctctagttcctcgaatatccatttctctggaaacagttacacccaaaccaaaaacaaaatcagtactgaagggcaagatggataactccctagaaaatgttgagtccaactttgaggccgatgaaaagttggtcatggacacctggcagcaggcttctttagcagtatctcacatggtggctgctgaaattcatcagaggcttatggaagaagaaaaagaaaaccagccagcagaccccaaagaaaaatctcctcagatgggtgcaaataaaaaagtcaaaaaggagccacccaagaaaaaacaggaagacaaaaaacccaaaggtaaatcaccacctatggcagaagcaactcctgtcatagtaacaacagaggaaattgctgaaatcaaaaggaaaaatgaactgagggtcaaaataaaggaagaacaccttgctgccttgcaatttgaagaaatagccacgcaatttcgacttgaactgataaagacaaaagcattggctcttcttgaagatttagtaacaaaggtggttgatgtatataaactcatggaaaaatggcttggtgagaggtatttgaatgaaatggccagtacagaaaaattaactgacgtagctcgctatcacattgaaacatctacaaaaattcagaatgaactttatttaagccaagaagacttcttcattaatggcaatataaaagtcttcccagatcctcccccatcaatacgtcctccacctgtagaaaaggaagaagatggtaccntgaccattgaacagcttgacagtcttcgagatcagttcttagatatggcacctaaagagtgctctgagaactgctttcaaaggccttcaccttcgacctgtgatgccttctcaaataggagacaggaagtggcttcatggattacaggcagccctccagaactttctcaagggatatcctgcaattgttcggcaactgcactcagcaggcagaggcaaaagtgacaccagtcaaaagaaacccaaagaacttctggagtcccttctccaagctgacattgttaaatttgcccacttcttgttggatgtcatgaatgtccttagcattctgtcctgtgtcaataagaatagaaattcctcaattgctgacatatttgccactttagagtcaatgctggaaatgctccaaatgtatcaaacaagactagggccaaaagaacgcatggtggattcagccacacactttcatggtaactgcctcagagggaaagaaaacatttctgctgtgagaaacattgttttaacacatcttatcaagagacttcaaggctgtttcagagatgccagccaaaatgtggtgagggctaccgtgattggaagttttaaattgtggcccacaaagataaatcaagaatttggagaaaaagaggtatccatcctgactgcacattatgaaccagtattagaagctgccaatgtgaaacttagtgaagtggatactgaatggagcatgttgaaattagagatttatgccagatttcagaacattcgaaaattgacctgggattttgtgaattccatttacttacacaagtatccaaatatcctgacactagtcgacctagtgttgacccttcctgcaagttcagctgaagcagaacatggctttagtcagatgaaatggaccaagtcacatatgcatgcaaaaatcaaggctgaaagcataataggaaataaagcatttactgacattctgatcgatttggtgaccctgaaccttggcacaaacaactttcctagtaattggatgcaccttacccaacctgaattacaggaantaacatctttattaacagtcaactccgagttcgtggactggcggaagttcctgttagtaacctcaatgccttggcccattcccttggaggaggagctccttgagacccttcagaagttcaaggctgtggataaggagcagttgggcaccatcacttttgagcagtatatgcaggctggtctgtggtttacaggagatgaagatataaaaattccagaaaatcctcttgaaccccttccatttaataggcaggagcatcttatagagtttttctttaggctatttgctgactatgagaaggatccaccccagcttgactacacacagatgctgctttactttgcttgccacccagacaccgtggaaggagtctacagggccctcagtgtggctgttggaactcatgtcttccaacaagtcaangcttccattccaagtgcagaaaagacctcctcaactgatgcaggtccagctgaggaatttcctgaacctgaggaaaatgctgcaagagaagaaaggaaattaaaagacgacacggagaaaagggaacagaaggatgaagaaatccctgaaaatgcaaacaatgaaaagatgtccatggaaacactactcaaagtgttcaaagggggaagtgaagcacaggactccaatagatttgccagccacctaaagatagagaacatttatgcagagggcttcataaaaacatttcaagacctaggtgccaagaacctggagccaattgaagtcgctgttctcttgaagcatccttttattcaagacctgatttcaaattattcagactataagtttcctgatattaaaataattctccaaaggagtgaacatgtacaaggaagtgatggagagagatcaccttcaagacatacagaggaaaagaaatgaagacaaaagagtgtgatttttttaattctgcaataaatcttccaaaaattaaatgtgaaaa

SEQ ID NO: 500270 - DNA, 406 bp, Homo sapiens
aaggatcagaaacctagatggacgagtaccacaggagtgctatagctgatcagtgacctgcatctgtgaaaggataaaagtaaaacaacaagggtggataacaaacgtctcagaccagccacagttaaagacataatagaggccaggcacagtggctcatgtgtgcaatcccagcacttgggaaaaccaagcagggcggataacttgaggtcaggagtaagagacctccctggctaacatggcaaacatcctgttcttgaccgggtgcagtggcgcacatttatcatcccaaaagctttgggagactgaggcggttgaatcacttgaggtcatgagtctgagacgaccctaatcaacatggtgacatccatgtctctactaaaaaatgctaaattagccaggcatg

SEQ ID NO: 500271 - DNA, 1332 bp, Homo sapiens
  misc_feature (612)..(612): n is a, c, g, or t
  misc_feature (935)..(935): n is a, c, g, or t
tctgtacatttcttcagatcttctgatgaaccaaattcctttaatttgtcatgtcaaacttgttaatattttcctttgtgatttatacttttttgtatcttaagaaatcactttaaacccagcctgtaagaatcaaagggtgcaggtgctcccgacagtcctgcgaggctcgccggtccctggctttccatgcttgggcaactgtttcacacccttttctcgccacaaacccctcctcccaaagtgctgggattacaggcgtgagccactgcgcccggccccaaattatttttgtgacctgagcatcaccacaaaagagatccagggaccagcctcactcagggtctgccctccccgtccatgcccctgctgctgaacccaagtcagagatggtttcaggtgcctttgctgggatacagtgacccttgatatcccaaaacttggaacgaagcagattcctatcacctcacataccccgctgtgatcgctgaccctaggaacaaaatccatattgcctggcatagggctggctctgtcctgacgggggggtcaccccaggagtgagagccagctccacattgggagggtggccctcacactgatcgacataanaagggaaaccaatggacactgcccttgtttattcttattgaaaactcaggctaggccgggcgcggtggctcgcgcctgtaatcctagcacttagggaggctgaggccaggcggattgcctgagctcaggagtaagagacagccttgggcagcacggtgaagccccgtctcaactaaaatacaaaaaattcaattagccgggtgtggcggatgtgtgcctatggtcccagctgctcaggaggctgaggcgggagaatggttgaacctgggagtcagaggttgcagtgagccaggagtcgcgccaatggcatgccaagcctcagntgacagagtgagactggtctccaaaaaacaaaaaaaccaaacaacaaacaagacaaccgagtcaggcgggaccatcagacactacgacacagcgcggcacagaaacaacaaccacgcacagggaacgcaggggacccacaagacgataagtagccacacgtgcgacacaacgaagagctacaacgacagaagagacccggcggcacagagacacaacgcagggcgagcattaccaagcacagaaacacacgcaccggcgggcgtaacacacgcggaggactggtggacacaacccccaaaacgagaccgcaggacgacataagaggaggagtacacaaacagacggaagcacactggcgagagcagagagagactcagaactacccccacacacccg

SEQ ID NO: 500272 - DNA, 1220 bp, Homo sapiens
  misc_feature (465)..(465): n is a, c, g, or t
  misc_feature (1220)..(1220): n is a, c, g, or t
ctacataataggccaagaacaaaagccagcatccattcctcactccaccactttgtctattttcagtgtgtgtcattgctactactgaaagacgatgtgtgaacactttcctcttctcattatataagcagcagtggctcaggaactttacgagagctgcagtagaccgtagacacatgcctcatttcatcactactaccatttggtagacccatcgagtcccaagggttattcagctctccagcattagagaggtgccagttgcttgcctgatgaaacccaaatgcacgacttaatcgccttccattgtaccccaacagttgtctgtcatagaatcattgcttaactacctggactctgagcttctggccatgtggggtgtacgagcgcccatggtaaactgcgcgccacgccgaacgtctgtgggacgaaaaggcctcctgaaaggtaaatagcgccgcaggngttacctttcctttttataatcggtaagggcgctccctaggtggaagggtactgtaggaaaggcagcacctaatgggccccttcggtggctcaacaagcctacgttgggctgctaagggaccataatcccccgcctggcttacgtgctatgacccttaacattaagaatattgcaaccaaaaagacaattttcatgtccccacgtgggcacatttgcggatcgggaccaactttattgcccctcggataaggatcccccgcaacgcccattatcctccctggaggggaacgccgcgtttggcaagttgccccattgggccatagcaataattccgaccccttctagcaatacccactttggcggcgcacgagagcgaacgtaagagggatttccgacgacacgtttcgtacggccttataggaggctcacttcacaaccgaccccttagtctttgtggcgaacctctacgcccgaaggattcccctgtagggattgattggtacaccccaacgagagggtctgagacaggcaagcctttcccacgatttaacctttggccaaatgagacacgatagcttctggggaatcgagagaattacacagcacacactttttagagggaacccttattttaggtaaattgtgccttccacgttgaacatcctggtaaaacacttttagtatgtacaaccttcttaccaatattcctctggggtgagaaaaaagacgcgactactgtgtatgcaagcactgn

SEQ ID NO: 500273 - DNA, 154 bp, Homo sapiens
ggtgatctacgaggatctccctagaaaacagcttgtgaatacagtccccgtggcatccctgtgagggtgacgttagcattaccccacactcattttatgttgcctaagcattgcgtggccttcctgtctagtctctcctgtaagcgaaagtcaa

SEQ ID NO: 500274 - DNA, 103 bp, Homo sapiens
tatcgctgataggcatgcggtacaaaaataaaatggatatggaccaaacgaaaaactgacctataacagagatgcaaagaattttaaatgggaggtctcgtag

SEQ ID NO: 500275 - DNA, 1732 bp, Homo sapiens
  misc_feature (50)..(50): n is a, c, g, or t
  misc_feature (304)..(304): n is a, c, g, or t
  misc_feature (1198)..(1198): n is a, c, g, or t
agttctgtgacgctcctctccctcctttgtgtgggcgtactgtcgctgtntcttgtcttatgattgatgcccccctgctagtgtcgtcgctctcgtttgtgttgactcccgtctctctcggaacgctccccctttgctggtgggcttagctggtgtgttagaacataccacgtgttttcttcctcccgcctttcttcgccctcatctgttgcgccatttgtcccgccgtgtgtttacacccttcctctgtgggtcacctctttcccattcgctccgtatggcggcctctttgtttcttcatcgnctgtcgatcctcctcgtgtttggggacaccccctctttttggcggggcggtcttgcccctcggatgtttttgctgcagatcatttttcttcctactcgggggtttctcctctcctgtctggtgtagttgcaccgcctagacggtgggggcggctatcataccacctccttttttccgatgctcctaattagattctttttatgttgttggaataagtgccgcgcccgtcatttttgtggtttcgcactttgtttcctctctcctggtgcaccacaccgggggggggcattactaccacccctcgcttgttcctctattatgcactctctccggctgggtatgtgatgatatttcatgccttctgtggtggtaggacattcccccctacctatttgttgaacaactcatacttctgtccccccaacaatggtggttgtgttgtaggatcccgcgcggcattgttggtgcccccacaccctgtgtatcgctatatggtatttttttcgtcccggtgggggggtctcccccccaccgatgtgttggtcgtcttctatgattccccccctctcgtggggtcgtgatagccgcgttgttgtctgtgttctccttgtgtcccccgtcgagtgagttgctttgttggtgtagatcaacgccctctcgttgagcgtctcccctcgtcgatggttttgtactcccccctctccccgcagttctttttcattgcgtcgccgctacgccacctggggtgtgctcccccctcttcttgactacgctcgctgtgtgttgtactcccccccccctccttgtcgcgggtgtcttctcatctctctctctgaggggtctctgtgtggcggttgaacacctgtgcttgcacacgtcaccctcgctgagggncgtctacccctccctctttggaccctcctctcgcccccccttcctcactctcggtcttcccccgcagggcctctacattagcggaagaggcacccctgcgcgagaggttgtgagcggagactttcgagcgcgcgcccgcggagttttcacactctctttctccctctctcgggcgcacgtgtgttgcgatctctctcagaggtataccacctcggttatattgtctcgggggcgctctctgggacacctcccaccgccacatggcgcaccggacccctctctgtttacaccccacggttcccctctgtgcgcctctggctcagcgcgcaggtggagcgcctctgccccaccacaaaaggtctcccacttttctcacgctgccccacatcaccccctctcacacctccccattgtggcacctagctgggacacacggtttcttcctaagaactccctcataaccccctggaaaatttttttatttttatttttttggggccttaactataaaaaattgcttttggccttccttta

SEQ ID NO: 500276 - DNA, 517 bp, Homo sapiens
gggtgcccggcattgtgtgcaccggaccttttgtggtctgggccatccagcccctttgcctttttctagagtgcactcggagccacgaggacttcactgtgggccatggtgtgtagtgttctccccatcaacagcccggccgacatggttttttccattaatggggtccaggaccccgggccccccagggcctacattcttcagagggagggggggtggatcagtgggtttcaggggatgaccctcccccccgaatttggaggggtttgggttttgggggatgtttttatccgccaggacttttccgtttttgacaggggaaacaaccaggggggggtggcccccgtgggttaagcctaagtttttttagccccccccccaggaagttttggcctttgtcctggggccccttttaagggatttaattttcccggctgttttttcccggggggggggggggttttgggcctgttccctgttctcccaaaaagggggaattaaaacataaccccctgga

SEQ ID NO: 500277 - DNA, 186 bp, Homo sapiens
caggttaaatccatggcttactatatatatacactgtcaatgaaacattcacctctatttaattttccttgacaaggggaggcgtctaaaacaaatcaccagatcattaatgcaacccaaaaatcaacttatgtctgtgatggcttgacacctatcccacattccattggatgttcagactttgct

SEQ ID NO: 500278 - DNA, 987 bp, Homo sapiens
  misc_feature (36)..(36): n is a, c, g, or t
  misc_feature (42)..(42): n is a, c, g, or t
  misc_feature (219)..(219): n is a, c, g, or t
  misc_feature (247)..(247): n is a, c, g, or t
  misc_feature (268)..(268): n is a, c, g, or t
  misc_feature (509)..(509): n is a, c, g, or t
  misc_feature (515)..(515): n is a, c, g, or t
  misc_feature (544)..(544): n is a, c, g, or t
  misc_feature (567)..(567): n is a, c, g, or t
  misc_feature (586)..(586): n is a, c, g, or t
  misc_feature (624)..(624): n is a, c, g, or t
  misc_feature (672)..(672): n is a, c, g, or t
  misc_feature (736)..(736): n is a, c, g, or t
  misc_feature (739)..(739): n is a, c, g, or t
tgagacagcacacacggcgcctggcatgggcgctgngtctgngccctggggtgtgtgtcctggggccttgccttacaatggcacctgccccgcaggactactgcgggattcccgagataagccctatagcagccctgtcagagcagaggagagggcacggcaatggtggcttactctctactctcagacaagctgattaaagcagagacgcacccctgnggaggagaatattttctgtaacttattntgaaagctcatcctgagtgtncaaacctggcaactcctgtttttttgcaaaatattctcattatgagaaatttggaaaacacataaaagtagataaaggaccaaaaagacaccaaagccagctcttactcatcttctggagagcttccttccggccttgctttgctccccctgtgaattgtttcaatagttgggattgacctggaaaacaatttcatacaactcctgggaggcctgcctgtgtcagatgtcataaatgcgtntaattntcatggcacacacaccagtttggcatggngctccagtgtctgggtggaccgngtctggtgaggcactttgnggctcagcagcagcattcgcgccacacagccacgggtnatggaggcacagcagccgggcacccatatctgccgtcctaacgtcctngtcaaggtaagacgtgacccatctgcagtccaccgtcaacaaacaggatttaacccataacctnccnggacttgagaccttttccaaacttcaacactgaaacttatttggccttacttaaaatgactcacttaaggggattaaaaggccaaccacgataagggataaaccgatgaaatttttaccacattcaatattttctaggggggcccgtcccaattccctataggagccgatcaaatactggcggctttcaagccgcctgggaatctcgggtaccacttatgcttgggaaatccttttcacgtgggaacc

SEQ ID NO: 500279 - DNA, 104 bp, Homo sapiens
gctcgactgaactgtggggtcgacgggaggggtgccttttacatgttcagtgtgaacaccgagcgctcgtccagggaaggctgccatgcacggcgtggtcgacg

SEQ ID NO: 500280 - DNA, 628 bp, Homo sapiens
  misc_feature (230)..(230): n is a, c, g, or t
taaaaggtttactatgtttaaaggaccaaggggttattattaaaaaaaatttaccagaggaaatttggaaatcaataacaattaaaagcaagaatattctccccaataattagagaaatacaattaaaaacaaaggtgaaatgtgttatttcacacaagtcaaactggacaaaacaaaattatttggactattacttaccaataggtgtaaagtgtgggtgttcacaatnaaatactcgtctggtcatatggaaaaaaaaacaaaaaaacaaaaaaaaaaaaacaaaaaaaaaaaaaaaaaaaacaacaaagagggggggcgggaaaaaaataaaccccgaggaggggggcaccaatatgtgggccaacccaggtttttggtcgaacaaagggccgcccacataaaagcgagacgctaaataaaacccagcaccgacacggccccacggtgaaaacaacacgtgcagcgggggaaaccaccaccacgcgacgaacatcgtgagaagaaccccccaacattcggggggggagcacacatgagcggcgacaccccaacaagaaaaataacgccgccgacgaccaacaacatacggcgaacagttgaaacacgaaaatccggcggaaaaat

SEQ ID NO: 500281 - DNA, 555 bp, Homo sapiens
  misc_feature (54)..(54): n is a, c, g, or t
tggtgaatcagaaactgaatgaatgactgctaaactctccgtaccatacaaggncgctaaggtaaacagacatgctcattgaaaaactgtagaggaatctgataaaaaaaatcctaactaaaaataccaaagacaaaaataaaatgcacaccagagagggggcacctcccctgaagtgtctgccttaagcggtgccctgacatgtgtagctcccacccccactgttattgtgtagtttcaaagagaggccccacccatgtctagtgttaggagtttgtgtctgtataaactactgagctcaggacgcacagacatagttcaacacacacactacaggttagtcgaagcgatcatccagctgaagcttgtgagaagtgcactgcttcatatgtgtgggagcagctgctgctgcgtcgctcagcagcgagcgagcgagcaacaacatcgtgcgagcgacacatcaccaccctccgctgaatattttacaagtgctactccatacggcgtgacatatattattcctcatcttttaaagagagcggttaaaacgtgagt

SEQ ID NO: 500282 - DNA, 129 bp, Homo sapiens
gctatatatcctaacagcaggaggggagatacagaggcaggaggcaggaggcagaaaaggcatacccagaaccacagttgatgaggcccaaactaaatgtgacaacagtggagacagtacgtattccaa

SEQ ID NO: 500283 - DNA, 1190 bp, Homo sapiens
  misc_feature (445)..(445): n is a, c, g, or t
  misc_feature (456)..(456): n is a, c, g, or t
  misc_feature (459)..(459): n is a, c, g, or t
  misc_feature (468)..(468): n is a, c, g, or t
  misc_feature (470)..(471): n is a, c, g, or t
  misc_feature (478)..(478): n is a, c, g, or t
  misc_feature (485)..(486): n is a, c, g, or t
  misc_feature (500)..(500): n is a, c, g, or t
  misc_feature (503)..(503): n is a, c, g, or t
  misc_feature (505)..(505): n is a, c, g, or t
  misc_feature (516)..(516): n is a, c, g, or t
  misc_feature (519)..(520): n is a, c, g, or t
  misc_feature (537)..(537): n is a, c, g, or t
  misc_feature (548)..(548): n is a, c, g, or t
  misc_feature (550)..(550): n is a, c, g, or t
  misc_feature (561)..(561): n is a, c, g, or t
  misc_feature (805)..(805): n is a, c, g, or t
  misc_feature (818)..(818): n is a, c, g, or t
  misc_feature (866)..(866): n is a, c, g, or t
  misc_feature (868)..(868): n is a, c, g, or t
  misc_feature (890)..(890): n is a, c, g, or t
  misc_feature (949)..(949): n is a, c, g, or t
  misc_feature (999)..(999): n is a, c, g, or t
  misc_feature (1117)..(1117): n is a, c, g, or t
tttggtcttttttttctttcgtttttgttttttttctgtttggtcttggtttgttgtgctcctgttttgttttgttgtttttttgtgcagtttctttttggatattcctggttgatcttgtgtgattgcttttttggctttattctgtattgctctactttctctcttttttcttcctgtttgttttttttttggcttctcttatgtgttgatatgtacctttgtttggtgcttatttttaagtctgctaatggcaattaccttatgcatgtacatttcccagactttcatgaagctgttgaggtcctatgtgcaattatgcagctatgttgtcgatatattttatcatctctctctatagtctccttttcttcataacatagatactgacatgataggaagctctcagcttagggttatagagatatatattttagattatagnacatggattcnaantgactggancnnattggcngacaccnnactggtaacctgcnatncntctggtgttanccnncaggattgttccactanaatttattttncnaaaaatttacntcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaanacactattggatnttttatttcctttttttgattcacgcttatacccgggctgcaaacctncncatttatgttcctcgaccacantggggatttttttaaatgtctacattctttctaataaactgttggaacgacttcttggnctgtccttttaagtgtctggcttactgtaatttttatgtatttaccattnactggaatggagtttatttgaggaagaatttgggattattcctctgtttgaaaaaagaggcttgctgtaatgtcacaggaaaccttttaaaagtggatctgtaatagcatatgtagancacttcagcagttggaaaagttaagtgttgtgtgatttgatttgcatattaagctaaatgtgttgtcctccta

SEQ ID NO: 500284 - DNA, 686 bp, Homo sapiens
  misc_feature (445)..(445): n is a, c, g, or t
  misc_feature (495)..(495): n is a, c, g, or t
  misc_feature (613)..(613): n is a, c, g, or t
tgttgtggcgcccctgttgtcgcgttagttgggtgtcctggtgtgttctcgggccgcctgtgtggggtgttcttcgtttgtccgcccccccttgttttttttttgtctggtcctgccgtttttcttttttttctcctttgttttaggaggacatacacatcttagttttattctccatccgattctacaccacactttctctctccaactgctgcaaagtgcatctactatatgctattactcgatccacttcttacaaggtttcctgctgacattaccagcaagcctcttttttccagacagcaggtactaatcccaaattcttccgtcaaatctactccacttccagtaaactggtaaactcacataacaactctaccagtcaagcccagacacttacactgtctacattctttctaataaactgttggaacgacttcttggnctgtccttttaagtgtctggcttactgtaatttttatgtatttaccattnactggaatggagtttatttgaggaagaatttgggattattcctctgtttgaaaaaagaggcttgctgtaatgtcacaggaaaccttttaaaagtggatctgtaatagcatatgtagancacttcagcagttggaaaagttaagtgttgtgtgatttgatttgcatattaagctaaatgtgttgtcctccta

SEQ ID NO: 500285 - DNA, 943 bp, Homo sapiens
gactgcattccagcctgggcgaagagcgagtctcaaaaaaaaaaaaacaccgatgtgggcatgtgaaaagctccgggaagatgcagaaccccttggggaaccagagggaaccatgtgggtgcaggaaggcccaccgaaaatttctaatgggtcttacgggtcgtgggaggaacatcagtgtgggaacgatgaaaaatcattattgctaaaaagaagagggttaaaaggctgagggataccctaaagctcgtggtaaattgaattttggacgtgagagaataggagggcttataaggttcatctttcaattaccacaaaattgattcttagattatttggatagatctctggggttacaaacggggattttctatggatagaagcgggaattgcagtgtgagtgcgcataggagtatagaacattttaaaaagagattgaagagccagactagtgagtttcaagggtgtacaggtcttggaccctcttttgatgctgaaaaatcgtggaattaataggtgggagaatgagatactggttatcctttctaatgggacattcttttaaggtttttgggagacattcaggaatcgaataatgtcagagtgtgaaacacatggatgttggggtaattatttgaatgttggtgggattaagatcattggagtaggaatgtgggtgaatgacgggtactaaaatttagtgtgatagcagagggagtggggtgagataaagagcagatcacaaagtatgtggcagctaggaaacgagtagcctttctggaaagaagattgggcggcaagagtaggtcgataagggaataaaacattggattgggggctggaacaagaatggtagaaatatagcacgaggagctttggaataggaaaggacgtataaagaaatcgggggggctaagagggaatatcgaaaaggggtatggta

SEQ ID NO: 500286 - DNA, 495 bp, Homo sapiens
tgtactagggattacaggtgactcccaccgatgcctggctagatttcggtagttcatgagtagagatggggtttcagcatgtaagccaggctggtctcagagctcctggcctcgagtgatctgtcatccttggctggtgattacagatgtgagccaccacgcccagcctcatttttttgagactgggccagggaagggggcagtgggccagtgactgtctctctctgttgcccaggctggagtgcaggatcgtgatcatggcccattgcagcctctacctcccgggctcaagcaatcctcccacctcagcctcccaagaagccggggaccacaggcatgttccaccacacccagcttatttttggtcaagatggggtcttgccatattgcccaggatggtctcgaactcctgggttcaagcaatccaacccagcgttcccaaagttgctgggattatgttgcgaaaagctgagtgtcgggtactacgctttggca

SEQ ID NO: 500287 - DNA, 1072 bp, Homo sapiens
  misc_feature (7)..(7): n is a, c, g, or t
  misc_feature (160)..(161): n is a, c, g, or t
  misc_feature (608)..(608): n is a, c, g, or t
  misc_feature (631)..(631): n is a, c, g, or t
gcctatntggttgcctttttgaaacccaacctgtgtccaatccaatcccaaccgtgtaccaattatcccaaaaacatccagctagcacgccgcatacgtggagaacgtgcttaagaatccactatgatgggaaacatttcattctcaaaaaaaaaaaaannaatttctcttcttcctgttattggtagttctgaacgttagatattttttttccatggggtcaaaaggtacctaagtatatgattgcgagtggaaaaataggggacagaaatcaggtattggcagtttttccattttcatttgtgtgtgaatttttaatataaatgcggaggcgtaaatctttagatgagtattcagtgttcaacttgcgtatttaacgaatcattaggattttctcataaatacacctgttaaatttttctggacaatgccagcatttggatttttttaaaacaagtaatttcttattgatggcaactaaatggtgtttgtagcatttttatcatacagtagattccatccattcactatacttttctaactgagttgtcctacatgcaagtacatgtttttaatgtgtctgtcttctgtgctgttcctgtaagttngctattaaaatacattaaactanaaaaaaaaaaaaaaaaaaaaaaaaaaaaattttgggggggctgggccacttggaaaaggtttcaaaaccaattcgtgttttggggcgccaggggcccaaggtaaggtggtatcggccacacttgggcaataaggctggtcccaaagaggaacccggggcactatagcataggggggtggggattctcacacccaatataaaaaaacgcgccggggggagaacagcacggggttcgtggaacaaaaatcccaagaagcggagcgtccagagggacaaatagcgaggacattataaaaaagaggggtttcaaggaacgagccgtagatataaaaatactcgccccccgccgtggtggaatgaaaacgcgacaagcggacggcgctagtataacgagacaggacacaagaacaagaagacaacagcgaggagcaagcgtgagag

SEQ ID NO: 500288 - DNA, 540 bp, Homo sapiens
attatggccgggggccataactgcgtttagacttcccgctgcgctaagtggcatataggctggtgtataccttgttacagacgctggggaacataaagtagcctctgttgtgaggacgagcgagttaaggcatacattcattttatactgtgaccggttcaggagcacatcttgcaaaaggcctcttttcattcattgtttctggaaaggaaagatctatcaagattgttttacattgaatatatgataggttttttaatgagatattagttgaaaaagttgtggaggtctaacaaacggatgctcgaaccttgcaaggtaagtgtatgataaaatgacagtttttgaagacaggtcaataggaggaatatgtggactgataacattagtagaatccttgaacttgaatgtattagacttaaatgctgatgtaaaactgaaacatgattggtcagagattatcattaggtagggttaacatgaatagtcgggaacgatataatatgcttacgttatgcccaaaagcatttgcatggaata

SEQ ID NO: 500289 - DNA, 247 bp, Homo sapiens
  misc_feature (154)..(154): n is a, c, g, or t
taattctgcaccacagcccgcactggcggatacggattcaaatccaatttagaaaatcacttcctgatgtggtatacactaaacaccacactgcagccaacccagtccagccttggttgtgaggcagtgcccggtgccttgtccttgctgaggncacaatgagtcagactgcgcagaacagctgtgggtctgcaagggccctcctgggcttgccccagtgagggttgggttgtgtggtcttgtgaag

SEQ ID NO: 500290 - DNA, 682 bp, Homo sapiens
  misc_feature (81)..(81): n is a, c, g, or t
  misc_feature (183)..(183): n is a, c, g, or t
  misc_feature (213)..(213): n is a, c, g, or t
  misc_feature (234)..(234): n is a, c, g, or t
  misc_feature (394)..(394): n is a, c, g, or t
  misc_feature (467)..(467): n is a, c, g, or t
  misc_feature (532)..(532): n is a, c, g, or t
  misc_feature (535)..(535): n is a, c, g, or t
  misc_feature (556)..(556): n is a, c, g, or t
  misc_feature (569)..(569): n is a, c, g, or t
tttttttttgggctctaaagggggtagagggggtgctatagggtaaatacgggccctatttcaaagattttaaggggaatnaattctaggacgaggggcatgaaacgggggttggctccacagatttcagagcatggaccgtagtataccccgggtcgtgtagcggtgaaaggggttgggttnaagacgtccggggaatggcatctggttttnaagcctaaggtgggggacagntcatgagtgcaagacgtctggtgatgtaattattatacagaaggggggcttcaatcgggagtactactcgatggtcaacgtcaaggagtcgcaggtcgccgggttctaggaataaggggggaagtatgtaggagtggaagattagtccgccgaagtcggngtactcgtaggttcagtaccatggggggccaatggattggatggtaagggagggatcgtggacctcgtcggtnatgtaaaggatgcgtagggatgggagggcgatgaggactaggatgatgggggcaggatagtcaanggnttctattcctgagcgtctganatgtagtatagtnagtggtgggagtgtccggaacagggcataccgggactaggaagcaggatacggaccatgattcatgaagggggtgaacatgaaacggtgatagatcttctatgatagggggaa

SEQ ID NO: 500291 - DNA, 387 bp, Homo sapiens
cctaatcgagcggtgaaaatcgacagcaatgccgatctcccaggcggcggaacgataccggctcctgaatttcccgatttgtttaatggtactactgtcgggccgaatgaattgaaagagtatcccaatgtggggccagggcgttacaacccgattcgtgtgctgttaccgcaaggccttgctaacgttggcctgaatgacacgattgaagtgactttcaaggggttccggaatgttgacggcagtgatggcgcatcaccggttgaactgcccttggcggatatttgtttcgctaccacacttgattaataccgaagatctggacttggagtattacgaggtctttgtccctgagcggaatcactatgccatctgtactcgcggcgc

SEQ ID NO: 500292 - DNA, 739 bp, Homo sapiens
gagctgcacctcctccaccacctgttcccagggccgtggtgtggaccacctcgggggcttgggtacgtggtacaccagtaaggggagccatcaccagaggtgccactgtgactcgagggtgcccaccccactatgtgaggggtgctccagcaccaagagcacggacagcgggtttccagaggatacctttgggcctccaacttcttggacagaaacatttgaagactatggatatgatgatacataggcagaacaaaagtaacgaagggctacggaagggctattaacagccagagtcaagggggacctcagaatattatgatatggacatgggggaaggtcaagattcttatgaagcttatggccaggacgacttggatattgggacccaggccgtcggttgaaggccccttcggtggataggccagtgaaggggagcataccagaggagcaccaatagtggacggtttttaaaaacacaaacattggggggaaaattatcaggttatgaagcaaagtgggtatagatttctggtatctcgcgaggatccgtgtgggcttaaaccgaagaaaagacaagtaaatggtctaaaggtgtttgccttcgggggtccctttttttcccaattttatgcaattcttaattctgcattcggacttctgaatgtgagattttaaaatgcgtaaactacgattggaatctcgaataatttcagggggtagaagcctctttggggaa

SEQ ID NO: 500293 - DNA, 920 bp, Homo sapiens
ctccttcacaagaaaatattgcatctgtcttgaagaaaattaccatacagagtctaagattgatcgagacaagtcttttatactttgaggaacacagtggactacataaatcagtctgttgtactcaggccaatagctgtggaaagaaaattatttgaaaacttacgagcaagatggttccatcttttgccctagaagcaattgaagtgtcattatacctaataagtgtctccataacatctcttaatagatcacacttaggggcaactcatggaggggtcttcaaagaccttgcaagtaagtactaactatggagatatcggctaagttcaatgcttgtctgagaggtcactgtactttcactgtaagagcagttatgagctgtatcttacattgatataagaccagagtccactaagatgtgaaacccagtctgtatctatagatagaagattgactgaggaaggatttgaataatcacttgtacaggtcttaggggaagcgagtgcatttgaaatctcttgaggtgacaggcttgtaatggtcatattttgtagccatggagattggactaatctcactgagcatgttgggccattatccagtcctgtctgccatggtgtttactataccctgtataagctaagaatggtcttcctgcagtcttttataactcgggtgtggtgaaaagaaaggtcataagtactagataatgccattgacgttgaattattatcactaattccagcgacatatcgctttatttggaactagctattactcatctgtgtatattattgagtctggggctgctttgaaaatgagttcgttgccatacgacgattggttaaggccctacaaagccctaattatttactggctggttttggcacaaaaaaagtttgtccactcctctgttt

SEQ ID NO: 500294 - DNA, 970 bp, Homo sapiens
ggggagccggagagatcgcgcgccttgccgtcaatcggagcctgtgagccgagaacgagccatgtggctagaaatcctcctcacttcagtgctgggctttgccatctactggttcatctcccgggacaaacgaggaaactttgccacttgaagatgggtgagtgggggccaggcacgaggtccgcagccagggaggacagacagcgatccgccctttcaaggtggaaacgtcagatgaggagatccactgatttacaccagaaggatcgagtaagttccgttctcaccccatcgttatggagggacagtctgcttccacatagtggcgttcaagctccaacatacctgaagaacagtcatctcctagctggcggaatgaatttgacctggaagaagcaggtggagattctcaaccagataccctcgagcttcaagactaagcattgaatgggctggacagtccacttgcatccacgtgaagccccgcccagcgtagaaccggaggacataccccgaagacccttgctgatggtgcacgggtggcaccggctctttctacagagttgttataagatcatgccactcctgactgaccccaagaaccatggcctgagcgatgagcacgtataagaagtcgatctgcccttccatcctggctatggcttctcagaggcatcctccaacgaaggggttcaactcgagtggacaccgacaggaatcttttacaaggctgatgctgcggctgggcttccaggaattctacaatgcaagggagggggacctgggggtacctgatctgactaatatgggccagaatgggtgcccagacaggtgaaggcctgcacttgagatggctttggtagcaggcaagttcgtctacgctgacctctctgggacaggggtacgggaggttacttgggctcactgaccaggagtttggagctgatggaaccggcaggaaaaggtatcc

SEQ ID NO: 500295 - DNA, 800 bp, Homo sapiens
aatagaaaaaccccccaaccctaaggtttttaaaacccaaaaactctccctttttttgaagcccacagtttagttccaaccctttcttttcacttttcgagattggcgttctaaaattatacttcaaaatgtgggtaacgttcagaaatctgcccaggggcttacccccttgtaattttcaagttttcccaaagtggcccacaccttctgtttataatgaagaatttcaggagcactccacctttgtttaaatcgtccttttttttctgccccattgtccaattccttctaatcagaaaagcatccccacttatttcctccgcgtctctgtcgtctaataaacgccttagcatggagtttgcacctcggggtcatgctttccaccaggtacttttctcatctctcaaaacattatctcattgtctcttcagtggtgaacgttcctcctatcatccagttagtataggccatttatgttccaaaccttcttaaaacgtcaatatttccttatacaaccaattataatctaggccaacagtccttaaattgagaagatatctatgactcatcttgctctatgccctccctgattttccaagctggcgtatctttgatcattttccagtgtccctcgacccgatagccaccacttcagcctctaaatctaccagtccttaaaattcagcaggcctggtgcatatgtgtgtcaagcatcatttataaagtatgcggtcagtgggtcacttatgacctaatgttttcttccagcctggacaacatggcaagacccctgtctctac

SEQ ID NO: 500296 - DNA, 164 bp, Homo sapiens
tgccatcactgtcatatgtatactggcctagtgatcaagtctaaccccaggtcagctactccttctatgtgtgacccaggcaagggagtccccctctgggtacacttctgttctacgtgaaggcagtgctcggtcaagtcagtgtttgtccaaaaatgagacat

SEQ ID NO: 500297 - DNA, 151 bp, Homo sapiens
aacatgcaacggactgatcagacgaagaggggcgtttggtattgtggttatggcaggcggttttatattgaatattgtctgtgattaaattgatcctccctaagatagaggagacatctgctaggtgttgggatcagtccgttcgcatgtt

SEQ ID NO: 500298 - DNA, 467 bp, Homo sapiens
  misc_feature (27)..(27): n is a, c, g, or t
tgacttgcccaaaaaagaaagcagaanaacccacccccaaagacgttcgaaagagaagggggaaatctgggggtctgccccttcctttagaaaagccgaggttcagggtgagagcccctctgagcggtccttggttgagctagcggagcggggaggctcccggcgcccctgcgatgagacccccaccctcacgccggctgcgccccgggacctccgcgaggattcgtccggcgggcgcgcgagcgagcggggtctcttcgggtttcaagcggccccggggccggcgcctcgtgaccctgccggactctccctccccgcgcggcagcgaagcgcatcaccgaggctggggccgggctcaccgtggggccagagcccgctcccagcaggatctcggcgaagaccagcccccgcacgccagcccgccgggtggaagcccggggcaccaggacaggcccggaggcggccgc

SEQ ID NO: 500299 - DNA, 1624 bp, Homo sapiens
  misc_feature (767)..(768): n is a, c, g, or t
tggggctctagaagggggtaaagggggtgctatagggtaaatacgggccctatttcaaaaattttaagggggaattaattctaggacgaggggcttgaaacacgtggtggttggctccccacagaattctcagaagcctatgtgcaccggtagtttataccccgcggctcggtgttagcgggtgaaaaggtggttggcgttaagaacgtccgggaaatggctatcgtggttttataagccctaagtggtggggcaccagctctcagtggagtgtgccaaaacgtctcgtggtgtgaagtgtgtaattatttattacgaaatggtgggggcttctcaactcgggggagttacctactctcgaagtgtggtcacacgtctcagagggagtctcgcgaggtctcgcgcgtgggtctcatagggaaatataaagtggggggaaaagtatatgtgatagagagtgtgtgaaaaattatagtctccgccgcgaaaagaactcggggtgtataacactcagaagaggtgtctcacgtatacccatgtgtgcgggtggggcccacatgtgtgcattgtggagagtgggcacacgagggagaggagggacactccgtgtgtgacacccctgcgctcggtgggttctagtgtgtcacaggaggagcagtgccgtactaagaggaagtggggagagcgggcccgaaagtgagagggacacttcagggacagtgaaagtggcgcggagcccagggaaataagttctccagaaagccggnntacccataaatttctcgcgatgagagcgcgccttccgggcagacagtgggtagagtacaaatccaagacttaaagactaacgggagtgcggcagcacgcgggttccggggcacaccaggcgggcgcactaaccgggggacaccttaagagaaaacggaccagaaataagcgcgggcaaacacaccgtgcactcaagatgaaaggagggcagggagaaaccacccactggaacacacggcgggggaactaaaaagacccccctcccactactgggaacctaggggcgcgaacacggatacagccgggtcttcggccaaacaaacctctctataagtaaagaccagaacaaccggggtgccaaacggcggggggtgttacccccggggaactcctgtgaggcacaaacgagggggaacatcaccggagacaagcgggcgaggcacacacggaagcaacataacgacacgtccacaagggtcccacccacacaacatgtacacacgtgtgtctgcggggagcaaaccctgggtggagcaacacaacgagggggcgaacaacatccgcgggagccgcgtggatatcagaacagcggcggtgcaacaggggggcaactcaccagggtcgcaaagggtgtgtttatggtaccccccaataaaacacaacgcttttacaacaggcttgtcgagcgacgagcgaggagggaccaccacccaactgagggagggaagcggagggaaccacccacaaacaaagacgtatgatatcaccgggcggaactgtacaacgcccctcttaacgaaaaaatacaacgcggagtcaagcatgcaccaacaggagcagacgacacacaacacag

SEQ ID NO: 500300 - DNA, 343 bp, Homo sapiens
attcagaagctgcccacatgagaagggcatgacgtcaccagactgtttctggactgggagaccttgaggctctaggagtatttctgacacctacactggttcctcaggtaccgggacctgtagtggaggattgagcccactgagcatctcactgtacaggtaagagaagggaaagctggatccacattccagcctggaatgagccagacactatcctccccaccctctgtctcacccacctccctgcttcggcttcacggccacctcaccaggaaggcttctgcatggttcttggccttgccaaggccctgctcttgaaaggcaaaggaggggaaaagggaaa

SEQ ID NO: 500301 - DNA, 366 bp, Homo sapiens
gagatagcaaagaaacatataaaacaaaattacaaatgcagtgccagatgttcatttattactcttaatgagaatacattaaaactaccattttaaaagttgaagactggccaggctaggtgactctcccctgtaatcccactttggaaggccaagacaggagtatcacttgagcccaggagttcaagaccagcctggccaacatggcaaaatgccatctctactaaaaatatttaaaaaattagctgggcgtggtgcctcatgcacctgtaatcccagctacttgggaggccgaggtggaagaatcgcttgaaaccaggaggcagaggttgcagtgagctgagatcaggccactgcactccagcc

SEQ ID NO: 500302 - DNA, 102 bp, Homo sapiens
ggtgctgggaatacggaaccatttgctctgggaaaggctgcggtgcgggatccactcttggaaccttgccctgtttgatcctcagctacgcatgcgccatat

SEQ ID NO: 500303 - DNA, 98 bp, Homo sapiens
taccccctggaaaaattggactttctggagttatttaacccctatggtcagtatttttgggccttaatgataatttaatataaatttagcttttctta

SEQ ID NO: 500304 - DNA, 299 bp, Homo sapiens
tggaaagcacaccctctgagaggcgaaccatcccaacaggatacattactacagtatgttctatagaggtgaaccatcccaacaggacacattactacattactacaggatgatctatagaggtgaaccatcccaacaggatacattactacagtatgatctatagaggtgaaccatcctaacaggatacattactacagtatgttctatagaggtgaaccatcccaccaggatacattactacagtattatctatggaggtgaaccatcccaccaggatacattactacattactaca

SEQ ID NO: 500305 - DNA, 216 bp, Homo sapiens
gatatactaaaaccatacatgttcatatattattagcattcccctaatcattgaaatcaatacacaattcaatcatactctattgtattcatatttattttatattaccactcatgttttatagtaaataatcattctgtcatattcacctatttcctgcagccatccaatcatgcacttatttccacccacacttcagcctatgtttatacatcc

SEQ ID NO: 500306 - DNA, 345 bp, Homo sapiens
  misc_feature (7)..(7): n is a, c, g, or t
aaaaagncaccccccccccggcccttttgcttccctcccatcagtttgggtgacaggaagaaaccacccctcaaccccacaagggttttgtgttccttttcacgcaaaaggggctttttatataacccaatgtgggggtttaggggctttttgataatggacagttttttgtgaatttaaatttatttctttttatatttttagggcccatttcctttttaataaggttaaaaagaaaaaaaaagtctagcgaaaaaactcctgtttttgccatgtgatgttccccaagggcagctgtagaaaagggcttgtccggtgttgaataaaaaaaccccctttgataga

SEQ ID NO: 500307 - DNA, 373 bp, Homo sapiens
  misc_feature (238)..(238): n is a, c, g, or t
  misc_feature (266)..(266): n is a, c, g, or t
  misc_feature (272)..(272): n is a, c, g, or t
  misc_feature (284)..(284): n is a, c, g, or t
  misc_feature (287)..(287): n is a, c, g, or t
  misc_feature (296)..(296): n is a, c, g, or t
  misc_feature (322)..(322): n is a, c, g, or t
  misc_feature (335)..(335): n is a, c, g, or t
  misc_feature (348)..(348): n is a, c, g, or t
  misc_feature (351)..(351): n is a, c, g, or t
  misc_feature (361)..(361): n is a, c, g, or t
agcatcccctgggcagtctgagcttcctcgagctcgcctgccagcctctagttcttcctgtgctccttgatcacctgagctgcctccggttctatttggtcctctccttcctgtaaggcttccttttatgttttgtttcaatcccaaatgtcttaatgttttgcagtgtgtatgggtttgagccccttgttcattctccttcctttttcctcccgcttccctctccatgaagtgattntgttgacaataatgtatactgcgcgttnttttcnctggtttatctncanaaatttttntgggcttttttcggtgttaaattcanccctgcgctaaancggggatgttccnttnaataaaaaancagtgtggttta

SEQ ID NO: 500308 - DNA, 398 bp, Homo sapiens
cacttttcctggcctataaagtcgaactttaagggattcctttgctcctgtatctgataccaggctgtgagaagcagccaggtcacctcttgaatgctttgctgcttagaaatttcttctgccagatactcttgatcactctcaagttcaactttttacaggttcctatggcatgaacaacacaatgcaggcaaactctttgctagggcataacatgatgacttttactccagttcccaataaactcctcatttccatctgagacctcattagcctggctttcactgtccatatttctatcagcattttggtcaaaattatttaaccaagtctttaagaagttccaaacttttcctcatcttcctgtcttcttctgagtcctcggaggttattggcat

SEQ ID NO: 500309 - DNA, 204 bp, Homo sapiens
  misc_feature (17)..(17): n is a, c, g, or t
  misc_feature (29)..(29): n is a, c, g, or t
  misc_feature (108)..(108): n is a, c, g, or t
  misc_feature (139)..(139): n is a, c, g, or t
  misc_feature (164)..(164): n is a, c, g, or t
ggagagcagcacgcagntgaaggcagagnggaatgacaccgcaagccaaggaacacggagcattgctgggaccaccggaagaagccagaagacaggcctggagctggntttccctcacagccccagaaggaacccaccntggtgccaccttgatttcggacttntggccttcagaactgggagagaataaatttctgttgcttt

SEQ ID NO: 500310 - DNA, 2280 bp, Homo sapiens
ggcacgagggcgcgggcggcggtgacatcacggccacggctggcgggaggggcggcggcgccccgcgcacatcacttcctcggcgcctccccgggggaggacgggcgaacgaggcgcggacggacaggcggacagcagggcggacagcagggaggacagcagggcgggcagggggcggacggccacggcgcggggggcgctcccggctcccgctcccgcgtccccgacccatggcgggcccggccccgcccgcggccgacgagctcccgggcccggccgccaggcgcctctactccaggatggaggcgtcctgcctagagctggcgctggagggcgagcgtctgtgcaaggcgggcgacttcaagacaggcgtggccttctttgaggctgctgtgcaggtgggcaccgaggacctgaagacactgagtgccatctacagccagctgggcaacgcctacttctacctgaaggagcacggccgggcgctggaataccacaagcatgacctcctgctggcgcggaccatcggtgaccgcatgggggaggccaaggccagtggaaacctgggaaacacactcaaggtcctggggcgcttcgacgaggctgccgtctgctgccagcggcatctgagcatcgcccaagagcagggagacaaggttggggaggcgagggccctctacaacatcgggaacgtgtaccacgccaaaggcaagcaactgtcctggaacgccgcaaacgccacgcaggaccccgggcacctgccgcccgatgtccgagagaccctgtgcaaggcctccgagttctacgagaggaacctgtccctggtgaaggagctgggcgaccgtgcggcgcagggcagggcctacggcaacctgggcaacacccactatttgttggggaacttcacagaggccacgaccttccacaaggagcgcctggccattgctaaggagtttggagacaaggcagccgagaggagggcctacagcaacctggggaacgcccacgtcttcctggggctgctttgacgtggccgccgagtactacaagaagacgctgcaactgtctcggcagctcagggaccaggcagtggaggcgcaggcctgctacagtctgggcaacacctacacgctgctgcaggactacgagcgcgcggccgagtaccacctgcggcacctgctcattgcccaggagctggccgacagagtgggcgagggccgggcgtgctggagcctgggaaatgcctacgtgtccatggggcgcccagcgcaggccctgaccttcgccaagaagcacctgcagatctcccaggagatcggggaccgccatggggagctcacggcccgcatgaacgtggcgcagctgcagctggtgctcggccgcctgaccagcccggcagcctcagagaagcctgacctggccggctatgaggcccagggtgagttccagggttgtgggggggtcttgctccccacaggcacggaccgcatcaggagctgcggaggggtgggatcgaggccaggccagcatggcggaggtggcagccgccagaaaatggcgcctacaagccagttcttcttggcctcagggacagcacaggcctgaggttcaccctgagcccttcccacccgcatcctgagtggcgctgcagggctgctggatgaaggacaggaggtggtcgcctgttgccccactggctgctccagggcctccacccccacctccccctggagccctcggtgcagggagggcttctgtcctcagacccaagtaggagagggctgctgggaggcgagagggcatcagccagagggctgggctgggctgggctgggctgggctgtgggagccctatgtgcctggggcagtaatcaggcaaggcccaaggccatgcgaggccaccgtggtgacctcattcatggaccgctggtcgtcccatgccggtcagcagtgctgcagacacaggacagaacgtcccctgcaaagcgaaaagactaataggtgccaggggggtggtgccaggttgggccgacttcctgaggtggctggcaggtgggtgaggggcaggcttggggggagcagctgccccacccatgtgtcccccactcccaaaggtcttgagtttgccagcccccgagaagggatgcctgcctcccagaacgtacctggtgccccccaggcctgctaaggaccaggctgggaacaccaggcttggatgtggtgctgggctgccggagtttctttttcttatcttatttttaataattaaatgtttttatag

SEQ ID NO: 500311 - DNA, 132 bp, Homo sapiens
gcgtttctagaggatccctctactcgcgggtgctgaggtggtgggtcagcatggatccgatcctaggtggtgggacaaacaccctttggctaatgctactgcgtacgctctggctgctgagtacaccttgta

SEQ ID NO: 500312 - DNA, 297 bp, Homo sapiens
attgtataatgcctgaagtgctctgtatgcctgtcttcagctcacaatggagagcaccggtgtgagatcacgtgagctccggctacaagtgcatggcctggccgccatgcttcatcgtcatctcagaccttcgtccagggtgtctaacatgctcacggccaacaaacaggtacagtcaactagacgagtaaaccagaggacaggagagctgtccttgaccaaaataactgggagcgggaggaatgtaatttcatacccttcaccaaaaaaaaaagggcgaggagatgaatgtacggt

SEQ ID NO: 500313 - DNA, 2064 bp, Homo sapiens
  misc_feature (1818)..(1818): n is a, c, g, or t
  misc_feature (1887)..(1887): n is a, c, g, or t
  misc_feature (1915)..(1915): n is a, c, g, or t
  misc_feature (1992)..(1992): n is a, c, g, or t
  misc_feature (2007)..(2007): n is a, c, g, or t
  misc_feature (2013)..(2013): n is a, c, g, or t
  misc_feature (2020)..(2020): n is a, c, g, or t
  misc_feature (2027)..(2027): n is a, c, g, or t
ggcacgagggcgcgggcggcggtgacatcacggccacggctggcgggaggggcggcggcgccccgcgcacatcacttcctcggcgcctccccgggggaggacgggcgaacgaggcgcggacggacaggcggacagcagggcggacagcagggaggacagcagggcgggcagggggcggacggccacggcgcggggggcgctcccggctcccgctcccgcgtccccgacccatggcgggcccggccccgcccgcggccgacgagctcccgggcccggccgccaggcgcctctactccaggatggaggcgtcctgcctagagctggcgctggagggcgagcgtctgtgcaaggcgggcgacttcaagacaggcgtggccttctttgaggctgctgtgcaggtgggcaccgaggacctgaagacactgagtgccatctacagccagctgggcaacgcctacttctacctgaaggagcacggccgggcgctggaataccacaagcatgacctcctgctggcgcggaccatcggtgaccgcatgggggaggccaaggccagtggaaacctgggaaacacactcaaggtcctggggcgcttcgacgaggctgccgtctgctgccagcggcatctgagcatcgcccaagagcagggagacaaggttggggaggcgagggccctctacaacatcgggaacgtgtaccacgccaaaggcaagcaactgtcctggaacgccgcaaacgccacgcaggaccccgggcacctgccgcccgatgtccgagagaccctgtgcaaggcctccgagttctacgagaggaacctgtccctggtgaaggagctgggcgaccgtgcggcgcagggcagggcctacggcaacctgggcaacacccactatttgttggggaacttcacagaggccacgaccttccacaaggagcgcctggccattgctaaggagtttggagacaaggcagccgagaggagggcctacagcaacctggggaacgcccacgtcttcctggggctgctttgacgtggccgccgagtactacaagaagacgctgcaactgtctcggcagctcagggaccaggcagtggaggcgcaggcctgctacagtctgggcaacacctacacgctgctgcaggactacgagcgcgcggccgagtaccacctgcggcacctgctcattgcccaggagctggccgacagagtgggcgagggccgggcgtgctggagcctgggaaatgcctacgtgtccatggggcgcccagcgcaggccctgaccttcgccaagaagcacctgcagatctcccaggagatcggggaccgccatggggagctcacggcccgcatgaacgtggcgcagctgcagctggtgctcggccgcctgaccagcccggcagcctcagagaagcctgacctggccggctatgaggcccagggggccagacccaagaggacgcagaggctgagcgcggagacctgggacctgctgagactccccctggagcgggagcagaatggagacagccaccattcaggggactggcgggggcccagcagggactcgctacccctccccgtgaggagcaggaagtaccaggaaggccctggacgctgagaggaggccccgggagggcagccactccccgctggacagcgccgacgtccgggtgcacgtgccacgcacgagcatcccgagggccccgtcttcggacgaggagtgcttctttgacctgttgaccaagttccagagcagccgcatggacgaccagcgttgtcccctggacgatggccaggccggggctgccgaggccaggcngccccacacctggaggacaggatcgcccagcctcgatgacggctcgcccagaccgaggaattcttcgancctcatcgccagctcccagagccgcggnttggacgaccagggggccagctgtgggcagcctgcggggctgcgaatcacccacagcaatgcagggcactccgaggncacggtgaagccccngaccgngggacantcttcanatgctgatagtaccagcctccagacgatgacgcgtgc

SEQ ID NO: 500314 - DNA, 103 bp, Homo sapiens
ttgtgcagcacgtggctaagatcgcggagatagaagcagagatggctcggactcaaaagaacaaggccacagcacaccacttagggctgcttaaggctcgtct

SEQ ID NO: 500315 - DNA, 2163 bp, Homo sapiens
  misc_feature (1917)..(1917): n is a, c, g, or t
  misc_feature (1986)..(1986): n is a, c, g, or t
  misc_feature (2014)..(2014): n is a, c, g, or t
  misc_feature (2091)..(2091): n is a, c, g, or t
  misc_feature (2106)..(2106): n is a, c, g, or t
  misc_feature (2112)..(2112): n is a, c, g, or t
  misc_feature (2119)..(2119): n is a, c, g, or t
  misc_feature (2126)..(2126): n is a, c, g, or t
ggcacgagggcgcgggcggcggtgacatcacggccacggctggcgggaggggcggcggcgccccgcgcacatcacttcctcggcgcctccccgggggaggacgggcgaacgaggcgcggacggacaggcggacagcagggcggacagcagggaggacagcagggcgggcagggggcggacggccacggcgcggggggcgctcccggctcccgctcccgcgtccccgacccatggcgggcccggccccgcccgcggccgacgagctcccgggcccggccgccaggcgcctctactccaggatggaggcgtcctgcctagagctggcgctggagggcgagcgtctgtgcaaggcgggcgacttcaagacaggcgtggccttctttgaggctgctgtgcaggtgggcaccgaggacctgaagacactgagtgccatctacagccagctgggcaacgcctacttctacctgaaggagcacggccgggcgctggaataccacaagcatgacctcctgctggcgcggaccatcggtgaccgcatgggggaggccaaggccagtggaaacctgggaaacacactcaaggtcctggggcgcttcgacgaggctgccgtctgctgccagcggcatctgagcatcgcccaagagcagggagacaaggttggggaggcgagggccctctacaacatcgggaacgtgtaccacgccaaaggcaagcaactgtcctggaacgccgcaaacgccacgcaggaccccgggcacctgccgcccgatgtccgagagaccctgtgcaaggcctccgagttctacgagaggaacctgtccctggtgaaggagctgggcgaccgtgcggcgcagggcagggcctacggcaacctgggcaacacccactatttgttggggaacttcacagaggccacgaccttccacaaggagcgcctggccattgctaaggagtttggagacaaggcagccgagaggagggcctacagcaacctggggaacgcccacgtcttcctggggctgctttgacgtggccgccgagtactacaagaagacgctgcaactgtctcggcagctcagggaccaggcagtggaggcgcaggcctgctacagtctgggcaacacctacacgctgctgcaggactacgagcgcgcggccgagtaccacctgcggcacctgctcattgcccaggagctggccgacagagtgggcgagggccgggcgtgctggagcctgggaaatgcctacgtgtccatggggcgcccagcgcaggccctgaccttcgccaagaagcacctgcagatctcccaggagatcggggaccgccatggggagctcacggcccgcatgaacgtggcgcagctgcagctggtgctcggccgcctgaccagcccggcagcctcagagaagcctgacctggccggctatgaggcccagggggccagacccaagaggacgcagaggctgagcgcggagacctgggacctgctgagactccccctggagcgggagcagaatggagacagccaccaatatcacgggtgcacctgggctggtggagcacccgagcacgggacactcgcgtagcgcccttcacaccggtgcaacgggacggccaggcgaacggttagcccaaggggaacacggggcacaccgggacccgacattgggaggcaaggggcaagggggccccacccagggggcgaacggggcacaaggcaccaacgttcccaccgacttggcaccaggcggccggacgatcccgggattgcacgtgccacgcacgagcatcccgagggccccgtcttcggacgaggagtgcttctttgacctgttgaccaagttccagagcagccgcatggacgaccagcgttgtcccctggacgatggccaggccggggctgccgaggccaggcngccccacacctggaggacaggatcgcccagcctcgatgacggctcgcccagaccgaggaattcttcgancctcatcgccagctcccagagccgcggnttggacgaccagggggccagctgtgggcagcctgcggggctgcgaatcacccacagcaatgcagggcactccgaggncacggtgaagccccngaccgngggacantcttcanatgctgatagtaccagcctccagacgatgacgcgtgc

SEQ ID NO: 500316 - DNA, 771 bp, Homo sapiens
gaggctttggctgggtgaggcggtcagacggcggcgtgtaggacgctccgggagtccccggtgtctggtgtggccgccatggcatgcagcccagtgcagcggggtctccttggagggtatatccctgagagtcttctgaggaagcggagctccagagggaagccatgacagcaagtcctggacaacttgggatccctcccacagtgccacgggggctgcagagctggacctgatccttccttcgaggcattatggaaagtcccatagtaagatccctggccaaggccctatgagacggctggagcgagacgaagctggaggccgtgacgagacaacaacctggagctggtgcaggagatcctgtctgggacctggcagcagctggctgatgcagagcaagcacagacagccgagacttgtgcccacatcctccaggagccccacttccagatcccatcctggagacgcacgactctgtggcctcacaagacctatgagacaccaacaccacagacctggcctggacccatacgtacagcaacagacatgtacactcccgaatgctgtgacgcattggttggtgcactcccgaatgacagcccggagacacaatcttgaggtagtaacggtacacgcagttcgacgggcggcgatgctgggtcgatacgagcgccatccttgcaatggtagcacattctaggttcacgcaaggcctgccgacatggttggtacatccatcaggaggataacgggcaccatgtggcctgaccc

SEQ ID NO: 500317 - DNA, 806 bp, Homo sapiens
  misc_feature (560)..(560): n is a, c, g, or t
  misc_feature (629)..(629): n is a, c, g, or t
  misc_feature (657)..(657): n is a, c, g, or t
  misc_feature (734)..(734): n is a, c, g, or t
  misc_feature (749)..(749): n is a, c, g, or t
  misc_feature (755)..(755): n is a, c, g, or t
  misc_feature (762)..(762): n is a, c, g, or t
  misc_feature (769)..(769): n is a, c, g, or t
tgcggtgtctggtggacgggccagtgcctggcagaagcagctgtgccgggcccaggacccggaggatgcggtggggaaaccaacttaggcccccatggcactgggggcggcagagggagagccaggccctcatgtgcatgtgcacacctgggagacggagcggggctctcgctgggtgtggggccagacccaagaggacgcagaggctgagcgcggagacctgggacctgctgagactccccctggagcgggagcagaatggagacagccaccattcaggggactggcgggggcccagcagggactcgctacccctccccgtgaggagcaggaagtaccaggaaggccctggacgctgagaggaggccccgggagggcagccactccccgctggacagcgccgacgtccgggtgcacgtgccacgcacgagcatcccgagggccccgtcttcggacgaggagtgcttctttgacctgttgaccaagttccagagcagccgcatggacgaccagcgttgtcccctggacgatggccaggccggggctgccgaggccaggcngccccacacctggaggacaggatcgcccagcctcgatgacggctcgcccagaccgaggaattcttcgancctcatcgccagctcccagagccgcggnttggacgaccagggggccagctgtgggcagcctgcggggctgcgaatcacccacagcaatgcagggcactccgaggncacggtgaagccccngaccgngggacantcttcanatgctgatagtaccagcctccagacgatgacgcgtgc

SEQ ID NO: 500318 - DNA, 145 bp, Homo sapiens
ctgcccccgcaagacgaactctacctagcacaacaggctcttctttgattcctgcgtacggcttcttcactaactatatactagcgggggcagcccccgcaagacgccgccgcgatgcgctacgtcgcctcctacctgctggctg

SEQ ID NO: 500319 - DNA, 586 bp, Homo sapiens
ggtggaagtgacatcgtctctaacccctgcgtgccaatccctgatgcaccgccgtgatgcccaggtaagacaggtcgacctggaagtccaactacttccttaagatcatgcaactattggatgattatccgaaatgtctcacttgtgggagcagacacatgtgggctccaagcagatgcgcagatccggcatgtcccttcgcgggaaggctagtggtgctgatgggcaaggaacaaccatgatgcgccaaggaccatccgagggcacctggaaaacaacccagctctggagaaactgctgcctcatcatccggcggaatgtgggcttgcgttcacctgaggaggaccctctagctgagatcagggagcactgttgctggccaataaggtgccacactgtgtgcccgtccgctgtgtgccacttggcccatgtgaacgtcagcctgtgccagcccagaacactggtctcgggacccgagaagacctcctttattccaggctttagagtatcaacactaaaatctccaggggaccaccatctgtaaatcctgacgtgatgtggcaaggctgatcaagactggagacca

SEQ ID NO: 500320 - DNA, 210 bp, Homo sapiens
tctagaggatcccttatgcatatttattgattgatgcagttcttgaattatacctagaagcaaactgaccagcggatcagcagaaaattaacagcaggaaaaaaaaattagtatacatgtcttatctagagaaatgaagaaatttttattgcttttatcatttaaaaatcatttgtgaattcctctttaagagaaaccgtcgaattcgag

SEQ ID NO: 500321 - DNA, 267 bp, Homo sapiens
attcgcggtcgagtcgacgcttagagaggaaaagctggctctggtcaagtagatcatggcaggatgaattccaactcacttttttacaactccaactactatgtgtatcttcgttactttcactttcttacaacctggccagaggcattttttaaatcaggcccagtatcagtattctttttgtgtgtgccaatgttgatatcacatccctatgaagttgaaaaataaagttaattttgaccgtcagacagattgaatgaagaagaa

SEQ ID NO: 500322 - DNA, 203 bp, Homo sapiens
aggatgctctcgaattcgctccctcgatggtcatagcttggtggcctagatgtgaagatagtcctccgcaaaaaaatctcaataaaatctgaaataagtcaagtgtattgagcttgcacttaaacggaacttgcctgtgaatttcgaggtttggtataaatagcgtgaagtggaaaaccaggctctccaggaatgggaaaact

SEQ ID NO: 500323 - DNA, 702 bp, Homo sapiens
atatggattagatatgattggctgaaattaggagattatgacctctgctccagaagaagtctttctgactctggattatccaggacatacctccctggccccccgccctctcttggtaacccgcccaggattaatggaatatcttgggttttatttccccgggagctttagagaaatgaggttataccgagctgactccccaaagccccaaagttacttgggccccgctttgggttccagatatatcaaaggggtattaaatgatgcatgaaattggcgctctgttttattttcgataaatccatagccccctttatgtagcccctggatgatccacataattgggaaattaccctttaaaaaaaacctgagtatccttcgcctaggatttttatctccccatggttatatcctgccatccagtggataattttgagagtcgtgttccagaatataacattgagaattttcagagttgttgcaaatcccgacttgttggaaactaataataatatcgtgacctggatttctatacgatagtgtttgtgtttagaagatgggtagatattgccgataagactgtttttcagaatcatgttaactattgggttgtgaactgaagtagtcccgggtttgccttgaacccttaccttctacctttaccccaaattaaccaattaaaacctgtatttaatgttgcca

SEQ ID NO: 500324 - DNA, 542 bp, Homo sapiens
gtaaacgggagacggtttactgaggaaagtctactaatcagaaacctctttactggtgagtcgatgttattaaccaggagacagctataactagtggactttctagatatacatgaaccaataaactccttatgtgattctaatccagctccgacttcggtttactcgctgactatacaaccaacagatccctaacctatacattcatcatacttagcccattcctaccttccctcaggatagcacagggaatacaggtaaggtcactacagatttcttggttccactaaagcccaggctatcacgctgacaaaggtcagaggcagcaaccaggtactaagtacactgggtgactcagctgtctgtacagaggagaatggacttccttaggaaaagaatagccaaatgagaagcacgtgcaccgaacggcctctactaggcaaagataacgtaggggtctcaacactcttccccacagacctgtctcatgggggtgtcgcttctgggtctatatgctcctggcatcaggaacctagacccac

SEQ ID NO: 500325 - DNA, 904 bp, Homo sapiens
tcccctggctttagaatccggcagattgcagtcctgtggcagctgagttagtgtatgactatgaggtctacgtccctacgctacgtaccgtgaaggtacagtcactcgcctcaagtagaatcaatactcaggaagtgttgcaaagttcgctttgatgaattgtcaatcgaatccatgtcctatcgtcaagagatcttaaagaatctcctgaccagtgcagtacgattaaccatgaatttactgcccagtttcataacacgcagtatgcctattttggaatgttgtttataccatgaaccagtactgtttaagtttgatacagaggcagttagacaaagttgagcaaagcctagtcgagtaccagttgtcaaaagatatcctagtgcaaactatatccatatcgctcttgggtgtcagattgtatctgtgcttctaacaagtgttttcaactaaactacctcaagtgctctcgggagattgggcattgggggtagcaacccggattttggcttggacagtcggcggaaaattcgctgaaatctcaaaaccatgccgattggacgcaatatgggggtaacacctggcaaagggtcccagaaaactccagctggcccccacgttcgattcatccccgggggtttcaccctcacacttccttttagcaacgataacaagtctttctccgaacggggccttcgaaacgccgttgtctttgcacatctccttcaccctggcgggacgggggatggtggggcgatcctccaggttcggcccattctcaacgcagtgctctgccaggagaattggattcggaagaccttaggggtagggtataaacccgacgggatacgagggcaccaacacggggaaaaaagtcctgcgttgcaacttgatcccacctgag

SEQ ID NO: 500326 - DNA, 1308 bp, Homo sapiens
gtactgtgcgtgtgtaccagtgtgaagatcaggaagcgtgtcatccatgatgtcatgccgaggcttggggatagtacaagggaagcagttcaggtaactgacgaattggtctgtaagaactagtacgacaatatcaaagggaaaagggaccataaggacttagaacttagataatcctcaaatggatagggaaatcaacaagaaatttataagacattgttaaaaggtaaacaaatgagatgggaattatagagaagaatataatagtatgatagatcacatatgaagggatacacatgaagaaagaccgagttgagagcaagagtaatgatggacgagcgatttaatcgtgtttgttattaaggcaacagttacaagtgtgattgcaagggataccgtagtagagccttagaggacctggtgtaggaatagtaaagggctccaattagttacgtgtgaaaaaaaaaggataaacaaaccgggtaagacgttcgtattatattgcgagagcaatccacgatgtaagtgtccatgtgtctacgtcgaagggtaatatcctgggaagaagcaagggggaaggaagaatgtgtgaggggacaaaaattgagtggtaacgacgcgaagggaaacgataacgaggatggaaacgaagggaagttggggaccagcggtcgaacgtagcgcagtacaaagtaagacgcaaagggttggccatacgcgttcgaaagagtaccaaggccagcgacggcatgcacagaacatgagatgggcgccgtacgacgtatggagggattcggtcgaaaacagaggttacgccagaaaattccagatgcgagatccaacggccgagtacggaccaaggaaattggggaaccggaaggacatcgcagcagtcgatggaaccagtggacgtagcagcggtgataagagatggaacttaaaggcgggggacacagaggggaaaacaccacacaagcagcacgcacggacaccatagcgtgaccacactgccctcccacagaaggttaccaacactaggtctccgtcgacttggatcacataccacgagctgtggcgataaccgtagggaacacgcgaagcggcgcgcacaggcggacatcccacgcaggcaagcctcgccacttagcgagcaacaccgccgataccacaggagagatgcacgccagtcccaacctcagagacacaagaatggggacaagcgacgaacacgggagggacagaccaacaagaataaaacagggcacagaggagacgcaggaaaagcagacaagaggcacagcaggaaac

SEQ ID NO: 500327 - DNA, 133 bp, Homo sapiens
agctttttttttttatatactcagaaatatctgcttccgcttttgtttttaagttttcaatattcatcatttcctcttttagtctgttatgactttccagttacacagtaagtcgattatatggtgcaagctt

SEQ ID NO: 500328 - DNA, 226 bp, Homo sapiens
tgttattttaccctcaaagaccaggtagtgaagtggtaccaggaggggtttcaagcagaggttaagaagagcctcaatcgggcgggcatggtgacaaacatctgtaatcccagctactcaggaggctgaggcaggggaatcgcttgaacccaggaggcagaggttgcggtgaaccgagatggcgccactgcattccagcctgggcaacagaccaagactccatctc

SEQ ID NO: 500329 - DNA, 357 bp, Homo sapiens
actgggaaatagccgacgtcgctgtaatatttagcttagaaaaagacatttattttactaggctgatgctaccgtttctgctccctgcctgtaaaacccttctttcccactgtagctgctcttcttttaagagcattagcagatgaaataaacctttggtagctagtctggaaatattccatcatttggatatctttttttgggagaaaaatttcaaaacaagcaaactacaaacatttagagtctgatctgcccacgggaaatacagtatttaaaaatacatgtttgacacataaagataaatactgcatgatttcaattaaagcagtcaaacttgtaagagttagatattgattg

SEQ ID NO: 500330 - DNA, 307 bp, Homo sapiens
  misc_feature (43)..(43): n is a, c, g, or t
ctgtgctcagaggatcccttccggtgttatcgccacctgcctnaacagcatcaggtgcctctaagcgggcctgttgacccagcaaatatgagcccaacaggggagacgctggctctgcagcctctcaggagaaggcggtctgagaaattggggttaatatgccttgttccgtgcttgagcgacagctagttaagtgcatgggttgctcggcacataggccatctctcaccagttgcacattagacccacttataaagtcaatcgattcgaaccaattagcaagaagataaggacaccggaaataagg

SEQ ID NO: 500331 - DNA, 269 bp, Homo sapiens
tgatacaccccaatcacgacaactaccaggtttgtggagcaggctgaggctctgaaggccaagggcagtcaggtggtgtgctgtctgagtgtaaatgatgcctttgtgactggcgagtgggggcgagcccacaaggcggaaggcaaggttcgggtcctgtgtgatccccctgtgggccttgggaaggagacagaatttattactagatgattcgctggtgtccatctttgggaatcgacgttttcaggaggttctccatggtggtatag

SEQ ID NO: 500332 - DNA, 382 bp, Homo sapiens
aaaaaaaaaatccctgtttcctgctttccaaaatggagggccttaacatcaaccaaagttcaaaacaaaaacaaaacacaggagctagctgggcgcggtggctcacacccgtggtcccaacattttgggagaccaaggtgggaggaatgcttgagttgtaggagttcaaaccagcctggcaaatatggcaagaccccatctctctaaaaagtaaacaaaaatcagccgagcatcatatcacatgcctgtagtcccagctactctggaggctgagatgaagactgcttgagccagggagggcaaggctgccgtgagccaagatcacaccaccacaccctagccagggagacagagcaagactctctctcaaaacaaacaacca

SEQ ID NO: 500333 - DNA, 676 bp, Homo sapiens
gagcaagtctatgaatgagggacgcgggggaaactctagcgccaggcatgtctcatgtaacattgcacgagccacattgcggagtacacgaccagtctataaattgttgacagttatacattatatgcgagtcatactcgcgagaaaggagacactttatggctttcctttgggagattcagctcttaagggatctcactctaccagtgagctgctaactaaaggcaggctgctgaagtatatagcatcaatcccacaatggcacaccttgcttcagatccataggatgagcccccttcttgagccctgtatatgtgagcagcttatttatttagatgcatttcatggcaccagaccctaacgggcagctaggtatttcactggagaccacttactccgctgagctttgctgtgtattttttttttcgcatgatttatttgaacttcaaagaaagatggcgagatccttgcacttaccagtgtggacggaaccaggctagcgttttctttgcctgggtgggcctctacaaaacggtttacctttgttatagggcatatgataccttaagcctcaattcccaggcaagagaaacatgctttttagcaaaggcttgccaggtaaacgcgctgtcttttgtttgactaaaacaggagggaccctgcttcagcaaggagt

SEQ ID NO: 500334 - DNA, 169 bp, Homo sapiens
accgcgagtgtcatgaggatgattgtatgtgatcacgtcagctgtctacagatggccgttttaagccgtatgaagtactcgttacaagttcccccattttaccttgtccgaaaaccagaacaagccttagcgagttagaacagtgatcttggcctcgatgccggggtac

SEQ ID NO: 500335 - DNA, 557 bp, Homo sapiens
tagaatttacttagagtcaaagtgactagatttaattacaaaaagtatttggtgtataccgttatacactcattaacataggggtcttatggacagaggtcctatgtactttaaaagaatatgtaggggctatagacttttttgccctctacctcccttctccatttcctttggaagttaagacatttaagggggagaataaggtgcatatgcgagtggggttcgtttaaaaaaaattaggtaaatacatatataattacaataacaacagttggtagttctctaaaatatttaattatgggtaaatcagaaaaggcccttaaatttgggcatctggttgaatgaatgtgttaaggatctcttctgtgggtggttctctttatactgaatgctgtcaatattatgtgagcacttactgtggcgaaccatgtggcttttcaaatatttctatttaatcctaaaaaactcctgggaaatgggtataattcccattttacagatgagaaaatgtgtccttgtgtagaatacccatcatgtgatagcttctgtgcatatta

SEQ ID NO: 500336 - DNA, 120 bp, Homo sapiens
gcttttgaaaatgctaacgagagactactggacattatgtcagaggaggggaacagtgacggaggtatagtagttgaagatgtagagatattagctaccaaaactctattaaacaaacaa

SEQ ID NO: 500337 - DNA, 472 bp, Homo sapiens
tcctttataatttttaagggatcaaaacaaagcatctaaaaccgcagtttcgggaaaaaccactggttctggccggtctggtatctctcttcaaactggacctgggcctcccgtcgggcctggcgttaaaagagcaggatctctgaagacatccttatggacagacagtttggtccaggggggatatccacagagtccctggggggcattaggtggattggtgagttatacactttcacaaaaagatttaatctttggatctctgggcagatcttcttcttggcccatgggcagctggtcacttggcggggggtacgcgggtcaattccagccaccaagagccagtgggcgtggagagggggcgaaccgggagggtgccaatcatcagagtggtctcttcagcgaagtgaacgaggcttgggcgttcgcgggagaataggcgtctccagcccgagggcacagagccacacac

SEQ ID NO: 500338 - DNA, 383 bp, Homo sapiens
tacccctaataatgagagcccaatggcgatgacttcgccttaagtggacgtcggttaaacacaagataataaaatactctgagaaattgggtatgtaaattttactttcaacgggataaaacttcaaataccataacaccaaagcattattatactcaccagtatttttgtggccttttagaatataaagtggccttggactgtccagagacaaaatgcatatattgtggtcatttccaccggcggcaattaggccatgagggtagatgtcacttgagggtatgacgcatacacaagatacaaacattggatggccactcatacagtgcatctctgtgaagctcctgtttgcactggaacgacatgataagtaatagatacat

SEQ ID NO: 500339 - DNA, 907 bp, Homo sapiens
gctttccaacttggccgctgcagaatggtctcccgcaaagacggctggcgagaagacacaacggtgccgttctgccatcaacgacggtggtaacccgagaatacacccatcagacattgcagcaagcgtcgatccatggcacgtgcgcttcacagaagcagtgctacctcgtggcagctcacaagagattcggaagtttgcccactgacgggaggatggcaaacttcgcaggactgctgtcgccattgagtaactcacgcgctacaatcacaaagcctggttctgtgtgcccaagaaggagataccggcaactgttgccactaacccgaaagtgccagtgttgtccggcctgttctcacgaatataccgcttacttgacggattgtccccgacttcacaccatacataaacgctataataagctttctgaggtttgccctaagtgatagcccttgttgtaccctaccttttccataaagattcgttaccagcatccaggtccacacgttgttgcgcaattgcacgaacctaaaattcggctgaactcgctgcaggatttccacaacttacacggtttcctaacactagcttacccaaaagaatgagcgaccttgactccagaaaacccactacaagaaagagcatccattgttgtgcgggggcgacgcgaacctttagggggccctccccgtgaaagaaaaaaccttttttactgaaagaaagcccttagtctgtttatttgggacgcctctgttgtgcaccccctatcatgagagtaggcgcttacaacacagtagcgctaacttaagggcagggttcgccccaaaggaagacttcgcgggtgcaagtgcataacagaggggggagggaaggaattcaacttcccgaatggtcaaaagatacggcg

SEQ ID NO: 500340 - DNA, 92 bp, Homo sapiens
gatcagaataggccagagtggatcatctccgaattggcttgttacacgtactctatggtagctgtacctctgtatgacaccttgggaccaga

SEQ ID NO: 500341 - DNA, 326 bp, Homo sapiens
  misc_feature (272)..(272): n is a, c, g, or t
cttgtacccaattcagccaacaaaaatgcaaggagatgtttgggctgacgctgtaatagtttacagatatctgtaaagttgacaaaagaagttttcttggttcctactcggacgacttgtggaggtttcatgacaaatttccttttctcccctgcaaccatatctgggttcttttccctcatggtgttgaacactcgattcagcggctcatcgtatgtgtagtatctttctgagcctccaaagcagggcctgtctgataacagaatgggctnccatcatctaattttctttttgtaggtataaataaaaaacctgttgacgttaaa

SEQ ID NO: 500342 - DNA, 323 bp, Homo sapiens
aggacaggaatccagctcggagctcctattaagatgactgttggccgggtgcagtggctcccgcctgtaatcccagcacttcaggaggtcgaagcgggcagatcatgaggtcaacagattgagaccatcatggccaacatggtgaaaccccgtctctactaaaaatacaaaaattagctgggtgtggtggcaggcacctgtagtcccagctatttgggaggctgaggcaggagaatcgcttgaacccgggaggtggaggttgcagtgagccaagatcgcgccactgcactccagcctggtgacagaacgagactacttctaaa

SEQ ID NO: 500343 - DNA, 288 bp, Homo sapiens
gccagaggatcccagtggaagatgtgcatgtctctcagtttaaatcaagagctagaaattattatgtttagtgagaaaggcatgaaagctgagggaggccaaaagctaggcctctgcaccagacggtcagccaagtggtgaagaatgcaaaggaaaagttacagaaggaaattgaaagtgctactccagtaaacacacaaatgataagaaagcaaaacagccttactgctgatgtggagaaagttggaggggtctgaatagaagatcaaaccagcacattcttccaag

SEQ ID NO: 500344 - DNA, 317 bp, Homo sapiens
ctgatgtttgcctgcagaaccatgagctgattaaaccttttttttttttaaataaattacccagccggaggaatttttttatagcggggcaagaatggcctaatacaggctgttacaagggaaaaattctttttttttttttttttttgaaaagggatttaacttgcccttaagcttggagggcgggggggaaatttggtttaattgaaccctccccctccagggtaaagggaattttcttgcttaacccccccaagagcttaaaataacaaagggcccccccccccccgggttgttttttgttttcccacaaaaaa

SEQ ID NO: 500345 - DNA, 131 bp, Homo sapiens
  misc_feature (11)..(11): n is a, c, g, or t
  misc_feature (93)..(93): n is a, c, g, or t
gcggcacttanaggtggggagcagagaatatcttatccaacatcaactctggccagatttgaactcttcaatctcttgcactcaaagcttgtnaagatagttaagcgtgcataagtggcccgccaatcgaa

SEQ ID NO: 500346 - DNA, 229 bp, Homo sapiens
tcctggccacattctgactcatgcatcgtccacccctggcgtgaactccctagccccgctgctgtcggctctgcttccaatcgctacaacgcggaccgtctgcgtcaacggccccataggtcctcccgacaaccactggattgtcagatcactctccgatgtgtcatctcaccatgccagtaattgtgctgggagactgcctctccacaattctttcctgcaaaacgaa

SEQ ID NO: 500347 - DNA, 81 bp, Homo sapiens
cccacgcgtcgcggacgcgtgggtcgacccacgcgtccggagggagcgagcaggcgaagccgcggtaggacggggtgaaga

SEQ ID NO: 500348 - DNA, 105 bp, Homo sapiens
ctaacgacattgatgcattcttcaggaaagtacgaggcatactaaataagcttactcctgaaaagttgacaagctatgccttgagctcctcgaatgtggggttca

SEQ ID NO: 500349 - DNA, 210 bp, Homo sapiens
caatgtgaaacgcagctggcggcacgtcgtccttcttgggtgcgaggagcacgccatcaagttggacaacaccgagacaatcaccgcgcagcacatgccgcggcgtacgtatacaagactcaatctaacactccctgttcggtcttctgaatcgctgaaacagcacttggctgagtcgcgacaggccggattaaagccgaattcgatttg

SEQ ID NO: 500350 - DNA, 280 bp, Homo sapiens
agggagtagtgaccagtaagattcgtacaggcaagcgaggggctgtccgtgatccgtagcacggagaatgggcgacccaggggtccaagaacactcgctgggctcaacatagtcctcgacacaggactgagaaagaaagtgtctcctttccgggaaagcacatgtaaacagtaaagggcctgaatctcttctaaaccaataattgacctctaggcacccaccataatactgctaccttcaggcagaagacactgctctatgtaagccaatcaccaccaag

SEQ ID NO: 500351 - DNA, 329 bp, Homo sapiens
ccagcgatgccagccagggtcaaggtgacggggatggctttaaagatcgccagcgtagccagggtatagaggatgagggcgaggtcggcgatgaggccgggcaggccgtagaccaggaccataaagatcatgacggcagcgatgccgacaccaccggcgatgactgatttttcgatggagtcttgaccgagggtcgctccgaccgagcgctcttcgaggatgcggacgggcactggcagcgagccagcattgagtttttgcatcagatcgagggcctgatcctgagtaaagctgccggtgatctgaccgcgcccgccagtgatcggctc

SEQ ID NO: 500352 - DNA, 223 bp, Homo sapiens
ggggggggggcccccccccccttttttttccccccttaaaaaaccgggggggggccccccccccgggttttttttttgggggggggggggggaaattttttcccccgggacccccttttcccctttgccccttttttggggcccttttaacccgtttttgtcaaaaaaacgggggggggggggccgggtttttcccgggtttttttcccccccccgccccgca

SEQ ID NO: 500353 - DNA, 133 bp, Homo sapiens
cacgagggcggtcgcaacggttcttccctgggcggacgatggagagacaaggcaggagggtggtggtgtgcgacacgctaccgggtttgtgaagtgtggatatgcacgctctaactttccagaatacatcttc

SEQ ID NO: 500354 - DNA, 676 bp, Homo sapiens
acccccaaatggaatcagggcacattgctcggctacgccaaccacctgcatgataatgatcgttggcccatgggcgactcgggcgcgggcgtggccttgccgccgcgttttgatgctgcgcttgaactggtgccttgcagcttgccgctgacgctaagccagcagcaggacaaggccatggccctgggcatgatgcacgacttgcagccgcgggcgccgttcaagcgccgcgtgcgcaggtggttgcagcaattattggcgggccgtagtccatcgccttacggagagaatgaattcttccgcaaggcggtgcgccgccatgaattgctctgggttttaaagcaggattgagaccttattgaaggcaggcttgcagggcctgccgccccttttttttgccgggctgcgtgcccgcagccagattgcagcatggagagttatgaaacctcgtttcaaggttttgcagttacagccggactacaacgtcaagacccacgacttcgccgacctcggcgagcagatcgtcaaggccttgccggctgaacgtttcgaggtcacatccgggtttctcagcggccgtccgctgcccggccagcccttgagcgtggctgaacactcccattacttcgagctgccggaaaagtccctaaaaggcatccgtatcggcgccatgtgg

SEQ ID NO: 500355 - DNA, 300 bp, Homo sapiens
tcatcgagctcgcaccgtagacacttacggtgagactccatctcaaaaaaaaaaaaaaaaaaagaaaagagccaggcagcccactgctcaaacacagaaatgcttttcatgcttttaaaggaaaacccaatttaattaaaaaacaggtggggctaaggagggtgaaaaggttaaaaacgtgaaaaattttctgtgcaggacaggaatttcccaagctccattaatctcacttctcaccaccgtctgatatctctcccctttctctctttcccttgttcccccctgttaacccccaaacag

SEQ ID NO: 500356 - DNA, 122 bp, Homo sapiens
tcgtgtactgcgatgcccatagaaaatacctacatgcgattactctagagcaggcccgtcatttgtagccatcaccagtgacagccacgacctgcctgtgtgaaatctaggggatcctacta

SEQ ID NO: 500357 - DNA, 301 bp, Homo sapiens
aagcccaaaaatttttccccggggtttgttgtaataacgccccccccttttttgggggggggccccccccggggggggggccccccccccccccggggttttttttaaaattttttcggcgccccccccggggggcccccccgggttaagaccccccccccccttttccccccgggggggggcccccagggaagggcccccccccccggaaattttcccgggccaaaaaggccgggccccaccgaatggcttttacaggccttcacttggaagcgctggggtttgctcaaagcgaacagtt

SEQ ID NO: 500358 - DNA, 245 bp, Homo sapiens
gtcgattagagcatccccctcaagactggcccgcgatgactggcactctcctggccctagctgagtgccgtgcgggccacattgcaggctgcctctgcctggagaacttctcctcgcaggttgtggaacgacacaataagccggaagtggaagtcaggagtagcaaagagctcctgtgacaacctgtgaccatcagcaggaatgagaaggataaggttctgattgagggctccatcaactctgtc

SEQ ID NO: 500359 - DNA, 890 bp, Homo sapiens
ccgtgctctacgtattagctgacttctcgctgcggtcgtgcgaccgccgtctgtgctacccctcctccctctctcggttgcccagcgacaagacttcgtcaactggggactcgcacccctcggttcgtccccgtgtgtgtcatccctattggctgctcttgctcctacaggcctgtgtcccactttttgtgggagcgcccccgattttcttgcccccagattagggttcctttccggtgcccacataactcccgtggtttctccccttctcccgcggggggttgtcttctccccgtcgctcatacaaactatcctcctgttcgttgtcttactgtccaccaaggtgggtatttcctcccccccctcgggtgcttccgggtctggtggtctcgcgagtgttgttcaccaccagaatgtttggcaaagaggggtgggttttgaacccccctgctccccagaccggatgagtcttctccttctttctgggaaacgcgacaccagtccttcgtcgctctccgcactccatccccgcaggcatcaccctcggttcctctctctcccgcgcatggagtgatatctggcgcgcctccgcccctctgtctgtctctccgatgatgtttcaccatagttcttcattgcggtgcgggggcgccaggtgcgttctcgctcacacacttcactccaaggtgggtgtccctccttcctagaagcggtacggtacggctcctccttggagagcgtcgttgtagaacccccccttttcagcacacctcttttttgtctgtctactcccagaccccccctctccccctgcggtcctcctctccccccctgtctcggggcccccccccccctataaaaacacccgagcccctttttttaaacaggca

SEQ ID NO: 500360 - DNA, 296 bp, Homo sapiens
  misc_feature (1)..(1): n is a, c, g, or t
nagatgtctgtggtgcgtgtgtgaaattcaggtgctagaagctactagtagaaaaaccaaaaggagagctatatcttaccattctgtccatttcgggagcttgtcagtgtgtcagtttttcctccccgaagacactccttccccaagtagttgtaggaagataaaaaacctgttaccagataacaaacactgaactcctatttgaccagaactttttcctctcgagatagttttttctttttaatgaaaaatgcataggaattggagattggttgtctcacacagccatttaggta

SEQ ID NO: 500361 - DNA, 929 bp, Homo sapiens
tagccatggaggctagaagcactggtgcccctggccatgatagtgaccatcttcctgctcctggtggacctgatgcaccggcaccaacagctggcgctgcacagcatacccgccaggtcccctgccactgcccgggtctgggcaaccattgctgcatgtggactaaccagaacacaccatactgcttcgagcagttgcggcgccgcttacggggacacgtgtacacgcctgcagctgtgccctggacgccgagtggtcgtgctccatgggctggcggcgtgcgcgaggcgatggtgacccgcggacgaggacacggacgaccgccgcatgcagcccatctaacaggtcctgggcattcgggccgcgtacccaagcagcgtgatcctagtaggaagcataatgggcccgacgtggcgcgagcaagagcgcagactatcctccgactagtccacactatgacgcaaaactaggcgtccattgcggcacacgcaaagatcggcactggagccacgatggggctgacacccagaggaaatgccagaccctgcgcatcatggatgagccgcgcattacagccggcacccaagggccccggaccggcccacaatatacggcccccaaccgggagacccctaatggaccaacaaggaccggctggacagccacaacgccgctgacactacggacaccattccacagtccaaccactggcgcaggtgacagcccacgctagcatccgcaggagtcaacggcaacgacaacccccatccgaactatagccctcacgcgcacctgcacttggaccccatacgacgttccaaggcacacgggcaaccttcgcaacgggacgcgcaagctaccagcggacactgcccattcgccgacaacaacgagcacacttgacaaatgacatgggcccccgcgacaac

SEQ ID NO: 500362 - DNA, 927 bp, Homo sapiens
ccactcctgatccttaccttggtggcagctgctcttggtgcccccttgatgatgatgacaagatcgtgggggctacaagtgtgaggagaattcgtgtcccctacctaggtgtccctgtaattcatggcaatacctacttctgtgcgtggcatcccttcatcgaagcggaacagtgggtggcgtaggtcgagcaggccacgtgcgtacaaagtcccggcaattcccgaggtgagaactgggagatgcacagacaatgccggaagtcctggaggggaatggagcaggttcatgaatcgcaagccaaagagtcatccgcgaccccaaatacgagagtgaagaagctgaacaatgacatcattgttactcaagctctcctcacgtgcagtgatcaacgcccgggtgtacaccagtcctactgctgtccacctgccactcccaagccactggcacgaggtgcctcatctctggctggggcactgactgagagctctggtcgccgactatacagaatgagttgcagtgccttgtgatgctcctgtgctgacgcgcggctatagtgtgaagctcctaccctggaaagagttatcaagccaatgtactgtgtgggcttccttgaggaggcacggatcatgtcaggctgattcatggtgggccctgtggtctgatggacaggtccaggagtgtctctggggtgatgggtgtgccaagaagacagctggagttacccagggctacacctagtgaaggttagagcgcaaggtgcatagaaagccagagtttagccaacaaaaggacgggcccgcaaaaaaacaaaaatttgggccggcccaagtatacacggcgcagaaaagacagtcaacggacggtcacacgggcacacaaggtgctcaacgacacgcggggcgaagagcccaggatagcgactac

SEQ ID NO: 500363 - DNA, 211 bp, Homo sapiens
  misc_feature (41)..(41): n is a, c, g, or t
  misc_feature (84)..(85): n is a, c, g, or t
  misc_feature (93)..(93): n is a, c, g, or t
  misc_feature (100)..(101): n is a, c, g, or t
  misc_feature (111)..(113): n is a, c, g, or t
  misc_feature (128)..(128): n is a, c, g, or t
  misc_feature (154)..(154): n is a, c, g, or t
  misc_feature (156)..(156): n is a, c, g, or t
  misc_feature (191)..(191): n is a, c, g, or t
caactacaaccagcaatttaagattactattactttaaganaatcaatttcatagtattggttttaaatctttttaagtttttnnaatacganctatttnnataggttctnnntcagaagtaaaattntgtacatatatacatgtacatatctntntagtttgggttcatttctataacattttgtaaganaataaaagtttgagcacctg

SEQ ID NO: 500364 - DNA, 292 bp, Homo sapiens
agccgacgccaggttaggggtcgtatcagagctgcagccatcagcctatgcagagcatagccatgagggatctgagtcgcgtccatgacctacaccacagctcacagcaacgccggaatccttaacccactgcgcaaggccagggatcgaacccacaacctcatggttcctagtccaatttgttaaccactgagccacaacgggaactcctccaagtattcttaactataatcaccatgctgtactgttagctctccaaaacttatttgtctcataactaaaagtttacacc

SEQ ID NO: 500365 - DNA, 905 bp, Homo sapiens
  misc_feature (902)..(903): n is a, c, g, or t
gacggatatgcgcgtttatcgtctgcgcatgtgcaagtcaatcccactttccggcttctccctgttagtgttgctggtgcagagggttcgcagctcaggaaggagggagccccaggaacaggatgtcccaccgtaagaactgctctcgtggacagaacagagacctcctcaccagggcttccaaactagatgcagaagaacccagaataggagcaggtcttgattgcccaaccagcgggcacttcttcatccccttgccagagagcaccagactgggtgatgtcgccacgatccagaagccatcacatgatgtgtgacactgaacactgtgggccaacttgcagaaggtggttactcctttacggttctccacactctttcaggagcccgcagaaaatgaacatatctcaggcatcagtgtcattcacggacgtgactatgaattcagccaggaggagtgcagcaaatggcccctgtgcagaagactctgtacagagatgtgatgctgcgagaactacagcacctcgtctcagtggggtctgctgttgcaaccagaggtgacccttcaccgttggagcagagagagcctggttctcagagggagggattctcaacctgagtcccaaagtgagttactgcgcagagaagacataatcctgcacgaagtggtcagacccaggcgcttagggggacacgctaatattgcagactttttaaagctaggcacaaggcgtcacaatataaacgggcccgacaccaaaaacaaaatgtggggcccccgaaattacactgtggccggcaagagacaggcattccaaacggatgggcccaaaccgcgggtaccaggtgtgtagaacccccgcacgcaaaaaaaaaaataaaagaaacacacacaaacaaanngg

SEQ ID NO: 500366 - DNA, 109 bp, Homo sapiens
gtaaataattcattttaataattattatgatctgaatggtctttgtaattttcttcttgaaaacccagattatccaaagagagaagacagaatcattataaatcccagt

SEQ ID NO: 500367 - DNA, 143 bp, Homo sapiens
cgatctgaggatctatggtctctcctcaaggggcatctgtccaccatgcagtgccctagcttagagctccctcaattcccctggcaacaacccccactctgttgctgacttgaggagtcttgtgtgcaatttgcttgtgaaat

SEQ ID NO: 500368 - DNA, 163 bp, Homo sapiens
  misc_feature (8)..(8): n is a, c, g, or t
ttatctanaggtccctggcaggctctctacctggccaggctctctcccggtcttaccccatctcagccgggggtaacttcagtggttcatatggtcctacagcaactcaaggccatcatggcggcgtccgcttccgtcaagtcttcacagaaagctggaagca

SEQ ID NO: 500369 - DNA, 975 bp, Homo sapiens
ctatgtgggacactcgacgttaggaacccactgtaggtcaagttagaagggccgctcttgaatcaggatcagactatatcccttctgtgaattgctactcgagccaggctatctgtagcctgggtggggagcccagataatgtgaggctggtaggagggtattggaaaagtgccaagaaatgccaagctttggttcgtcaccactataaaaagtttatgaacatgtcagagggaatggatgatgtgatttgtgaggtcttaactcagataacccggtttcttacttgtataggcttctttctcagaatgccagggagagtacatgcagggattccatctaatcaccctcagcactctttctctggtcctgctggaatagatttcgatttcctttcttgattttaggagcctcagtctgctatctcctttggtgggtaccaccactcactcgcttgatatcttctactccctttgccattcaccttgcgttacgactgagcacgggagttagatcttggtcgacctagctcttctattcctcactgtgtaccccacaaacaagattagtcccaggttaacaaagaacctactggaggtaacactgcggagagcaagctgtcggactctgggcatggtgcctttccccattaaacataaggtccccctggcgtttgtatggtaacccataagcaacccccattacctttcgctcctctccagaaataaatcatcttccctttgtataaatggctcagcattccgcatcctgcttgaacttggcacacttggctggcacggtacgcgactggatgacttggccgttcgtcgccgccccttagaacaggtctgggacacaggtgttccacccattgtggcgcgatcactagtcaccacacaaaacccaacacatgggaggtcaaaatatacagaggcaccaacaacccagcactaacaagccaactacagacaaaaacg

SEQ ID NO: 500370 - DNA, 104 bp, Homo sapiens
ccagattagccatgtggatggatggatgggtgggtggctgagttaggtggataattgaatggatgagagtataaacacttgcttagctgagtggatggaggggt

SEQ ID NO: 500371 - DNA, 685 bp, Homo sapiens
  misc_feature (83)..(83): n is a, c, g, or t
  misc_feature (89)..(89): n is a, c, g, or t
gaacagatcagcaaatttaaaagaaaaccaaacagctcttttagaaatgaaacactaatgtctcagtggacatatttggtgcnagttanatacagtagaagagagaaacagtaaataggaagattaagaacttacccagtgaataggaagataaaaaaatttcagataaattattacagagaataacgtgggaaggcagaggacagaataagggacgcggaagatggaatgagggctaacgtacatttgatggatgtcccagaggcagaggaaacaatggctgtcaaggagtaggttggggttttcagaactggtgaaatatactgacctacagacagggagccctgaagccgcctggcagaacaaaggaaaagcaacccccacctgcaaactacagatgagcaacaagcaggcagtggcttcctggacagatgcggtgctaggagacttcacctggctctcaggagcaacgacagaagccagaaacagtgatgtgctgtcacacacctgagcaaactccactgaactaggatactaagccacggaaagaacagtcacaagggatggccaaataaagacattctcaagtaaacaaaggcggacagtgtgtcactgatccttgtggtgggaattccaggagcgtccttcaagcagaaggcaagcagcagagggctgcgcgtgagtg

SEQ ID NO: 500372 - DNA, 110 bp, Homo sapiens
tacagcaggagcagctgtggggccagctgcaggatctggactccaggctccgtgctgggagctcagagtttgattcagagcacaacctaacaatgcaatgaagggcacag

SEQ ID NO: 500373 - DNA, 109 bp, Homo sapiens
aacaaacctgcacgttgtgacatgtaccctaaaacttaaagtataattaataaaaaaatactcttctaggctagcataacccagactctaaccttaaggtaaataatta

SEQ ID NO: 500374 - DNA, 590 bp, Homo sapiens
  misc_feature (83)..(83): n is a, c, g, or t
  misc_feature (89)..(89): n is a, c, g, or t
gaacagatcagcaaatttaaaagaaaaccaaacagctcttttagaaatgaaacactaatgtctcagtggacatatttggtgcnagttanatacagtagaagagagaaacagtaaataggaagattaagaacttacccagtgaataggaagataaaaaaatttcagataaattattacagagaataacgtgggaaggcagaggacagaataagggacgcggaagatggaatgagggctaacgtacatttgatggatgtcccagaggcagaggaaacaatggctgtcaaggagtaggttggggttttcagaactggtgaaatatactgacctacagacagggagccctgaagccgcctggcagaacaaaggaaaagcaacccccacctgcaaactacagatgagcaacaagcaggcagtggcttcctggacagatgcggtgctaggagacttcacctggctctcaggagcaacgacagaagccagaaacagtgatgtgctgtcacacacctgagcaaactccactgaactaggatactaagccacggaaagaacagtcacaagggatggccaaataaagacattctcaagta

SEQ ID NO: 500375 - DNA, 489 bp, Homo sapiens
  misc_feature (83)..(83): n is a, c, g, or t
  misc_feature (89)..(89): n is a, c, g, or t
gaacagatcagcaaatttaaaagaaaaccaaacagctcttttagaaatgaaacactaatgtctcagtggacatatttggtgcnagttanatacagtagaagagagaaacagtaaataggaagattaagaacttacccagtgaataggaagataaaaaaatttcagataaattattacagagaataacgtgggaaggcagaggacagaataagggacgcggaagatggaatgagggctaacgtacatttgatggatgtcccagaggcagaggaaacaatggctgtcaaggagtaggttggggttttcagaactggtgaaatatactgacctacagacagggagccctgaagccgcctggcagaacaaaggaaaagcaacccccacctcctcaaacgcagagaggacaaacgcagagaggatcagcaagcaggagtatgacttccttggtcaacgcgagaacagctcctattcaagtcctctctgcgtttg

SEQ ID NO: 500376 - DNA, 129 bp, Homo sapiens
atagctgtgtgtgcgcacactgcagtccagctactctgaggctgaggcaggagtattgcttaacaaaaaaaaaccccagggcagattttgcccactgcactccagcctgggcaaaagagcaagactcca

SEQ ID NO: 500377 - DNA, 111 bp, Homo sapiens
  misc_feature (28)..(28): n is a, c, g, or t
gggcgcggtggcagacgtcacggaggtngacgactgcgggggtccgactaccaaaaggcctcagtctgaagaaaaatagattcatagaaaactctggccgccccccgaatg

SEQ ID NO: 500378 - DNA, 239 bp, Homo sapiens
  misc_feature (27)..(27): n is a, c, g, or t
  misc_feature (211)..(211): n is a, c, g, or t
aggatcaggtataacaccacagcttanacaaacacactcacaactcctcctcatcctaacaatcacacactcaaggttactctgcagcttgcatcatctccgagattaataccaaaaattctccattgacggcccaaatttgtgtctgagcgctgtttccgcaggcattaaatgtcacgcatgcattagtaatccctccaacgccgagcantgagctgtgataatgtttcagtcgacgc

SEQ ID NO: 500379 - DNA, 675 bp, Homo sapiens
atcggagcaagcaggtagacctgattgagcagaggtcctaaattccattcccaacaaccagatgaaggctcacaactttctctatctgtacagctacagtgtgtactcatatacttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccccccccctcttttttttctccgggggctccctttctcgccccccccgtttttttttgcacggggggcctccttattgggcttttttttatcgtcgggactgcgcgcccacgtgctgtcttcacgcaaagagtggcacgggtgtgagggacgaaacgaggggctccgggtggggtctcttctgttggctgaaggagagtctcttcttttctcggggcggggtggcggaccacaacaatttgtcgcgcggccaataactctcttatcttaatatacggcgaagcgatcatataatagagaaccgcgctactcaaagagtgagccgacggatccttcctataacacaatcctttttgttatgggagacgagtgctgttgtgaagagcgagcagcggggagggagacaacacatgagccgacaccgcgccatataatatatattgagcgtggagtga

SEQ ID NO: 500380 - DNA, 388 bp, Homo sapiens
  misc_feature (305)..(305): n is a, c, g, or t
  misc_feature (326)..(326): n is a, c, g, or t
gtttagattagaatatctttcccaattgttacagtgacatatatgctgcaatatttaacaactggagtattagccacatgggttattttttcaactctgtgtttagaatttttttattgtgtgttatttaaaatattacatatgcagctgggagaactacacctttgtgcacatagatttatatattaatttgtagaaaatattttctttatatatttccttaccatacaaggtgccttgttcatccaggaaaactttgtgttttggtatttttggaacaaggcaacacggggcacccttccagnacgtattgccttttctcaagntatacgtctgaccaagtgtataaatgttacacttactttcagagttctttttagatctaaag

SEQ ID NO: 500381 - DNA, 832 bp, Homo sapiens
cagctactgaggaggctgagacaggagaatggcgtgaacccgtgaggcagagcttgcagtgagccgaaattgcaccactgcactccagcctgggcgacagagcaagactccgtctcaaaaaaaaaaaaaaaaaaaagcagttgctattaacaccactcagtatttgcttcaaaaatattaaagaacatacacaccattgagagagaggtacagtgacatgggttcacacttaacgggttgggatgtacacaggcaaaatcatttggagacatccttggaaatgtgtctctaaagccttggatctagtaatggtccaggctttctaacgaaactttgaaggctgtgtaccaagatttacttatgaaactccatttacgctttgttaacacactctaaggcaaggggatggcttagttgaatgaaccggcggtgtatgcattgaccagactccactgttgacaatgtgcatattgtcgtcctgtggaagcattgtcatcacgtatgatcgcatctcgtgacctaagacacacagtaaggctgctggcggggggtcactcctggtaatcccgagcacctttgcgcagggccaggcaaaagggattggccttagaacccgcgagttcagaacgaatctgggccaacatagactcgctatgtggtttcaacattcttcttcgacagacagaaaacgccccataggtagtcacggtacccatatttgagctccctccctgggtcaccccttgggccgacatggccacggtcggtctaaaacgggaactgtgcccaagcattgtgcaacgcaacatagtggcgcaagggggcttcacaa

SEQ ID NO: 500382 - DNA, 304 bp, Homo sapiens
ctgagcattcgcgtgggcatcaacctggcggtatccggtgcctgggtttcagcctcggctgatgctcatctacacgatcagcacgcggcatgtgttctcacagcgtcgcatggcggaccgcgccatgaatttgcgctgttccgtgatcggtggagcggggctgctgctgaccgaggccctgctgtggctgctggtccggcagatcggagtcgcgccgctggcgccaagctcggcagccctgtggtcgttcctcttcaatttcgcgttgccaagagcctgctgttcacctccttgaaccccaccc

SEQ ID NO: 500383 - DNA, 731 bp, Homo sapiens
gctccagtgccatggcgccctccaggaagttcttcgtagggggaaactgggagatgaacgggcggagagcagagtctgggggagctcatcggtactctggaacgcgggcaaggtgccggccgacaccgaggtggttcgtgctccccctagtgcctatatcgacttcggcgcggtagaatctagatcccaagatagcggtgtggttgccgcggaactgctcaattgaagtgagtaatggtggcttttactggcggacgatcagccctggcatgatctaagactgcggagccatgtgcgtggtggtcctggtggtcactcagatgcatgaagaggcgtgtcttctgaggcgcagtcagatcgagctgaactaggcgcagcaaagtggccactgttctggcgtgagggatctggagtatcgttgcatgtgggagaaggaggatgaattggaagggaatgtgtgagaagagtgttgtcgagcatgacaaaggtcatcgagataagtgaaggatggagcaaggtcgtctgggctatgagctgtgtgggccatgggtacaggccaagactgaatacccaataggtccaggaagtagcacgagaagctccgaggatggctgaagtccaggcgtctctgatgcggtggtcaggagcacccgtatcatttatggaggctctgtgattggggcaactgcaaggagctggcagcagctgatgtggatggttccttgtgggtg

SEQ ID NO: 500384 - DNA, 539 bp, Homo sapiens
tataataccacagagccagctatacatggagacagtgtttataattactctaatgaatctccccaagaattcggggattggagttaaaggggataattatggtagggtatggggccagtgagtacagagtgctgacttggtcaggtatggagattaaatcacatgggagtctaaacttgtcctcttgctgctgagtcggttcctcggcaggggccacaaaaccagattatccaatttatcaatctgggtaagtgccagcttgattaagccatcaagtacagggtctgcagaaatatctccagcactgatcttaggttttacaaccatgttatgtcatccgattagcaatcttgggagttttagaatcttgcaagcctccagttggttagactcctaaagcatgattttgtaatcttgttgggtaattttgttagtcctaccaaggcagtctagtcctcaggcaggaagggggttacttttgggaacggggtgttatctgtctttgtttcacaactaaaaatattaactaagttctccca

SEQ ID NO: 500385 - DNA, 1149 bp, Homo sapiens
ttattttgttatgcatctctggatgtgtccgttcctttgccagttgattctaattgtcgtctcaatgtttctcacccttttagcttcatggctattttctccgttcacggaaattgttggagttcttctttccctgcatttttgtatcgttaaatcgcgtctgtttttctgtacaatacttccccttttttgtaattaacctgtatcttgcctgtgcgatactatccgtggggttccaattataactgcaacttcatatggcatcctgcggttgttcctaccatcgaattgtatgtgcctgactaccgttggtttttgtttgccccttgtctttctcacagctatgcagttcctcatattattaatcagtggctgcctgttctcgtatcctgctgttcctgttactgcattatcagccctcaatgaagcagagatcgcctggtcaaagcatatctcttccagttgcgcctcttctccttggtggtcttcttaagctacagactcttccacaagacagtctacctgcagtcggccctgagcagctctacttactgcagagaagttcccttcaccgcatcccgtcgcctgccccactgaaggctactgcaggtcactgagttgcctgccatccaaaggggatgggcgggattggaagaagctgtggcagctctttctccctgttcacctcaccgcctgccagggaaggcaggacccgctctgccaagggccctctgcgtattcccttctctctgaggcaattgaaatttttgtctctggtgcacgtaaggcagaatgttccctgacaccagtgctagctggattctctaacatcgaccgtgagtctgaaaggaccacaggttatttctgcagctatttctctagcactttgccagtccctgtgcctggaatgattggaacactctttgtttttcatccctgatgccactctacccttaccacctttccatatctgccttctaccacccttggatgaatggattttgtaatctctaagctgattgtcattttgtgaatctgttaaccttctagcttgtctgttctcgatgaaacacatatcatatggatcactgggacggtaaaaggcgtgtcccagttgctccaggtcacatccccatagtagccagttac

SEQ ID NO: 500386 - DNA, 421 bp, Homo sapiens
  misc_feature (4)..(4): n is a, c, g, or t
  misc_feature (126)..(126): n is a, c, g, or t
accnacaaagaaggccaatttaaacttaatcccatgaattagagatgatgaaaagggtttggaaaatttgttgtgccccaaatttccatgcctgaaaatgtaatcccctagtgttggaggtgaagnccctggtgggagttgtttgggtcatgggggtggaccctcatggcttggtactgtcctcatgagagtatgatagtgagtgagttctcaagagatatgactgtttaaaagtgtgtggcacctcctccccatcctcacactctttcttgcctcctctctcgccatgtgagatgcctcctcgctgttcacctgctgccatgattgtaaacttcctgaggcctccccagaagccaagtagatgcaagcattatgcttctgtaaagcctgcaggaccatgatccaattaaatctcttttct

SEQ ID NO: 500387 - DNA, 122 bp, Homo sapiens
ccttcagagttgggtgaggcttcctgcagcatcaccgggggtcgtagggagctctggatgggaggaattcaatttccctgtccctatcatcacacccactgaccccattgacagagaaatgg

SEQ ID NO: 500388 - DNA, 607 bp, Homo sapiens
caaaagacaacagaggaggtattaaatcaaaaactacagctaaagtaacaaaagaattatatgtaaactcactcctgttccctttctatttccccaattaaaggtgctgctggtcaggaagttccacaagataaagcatggctataaaagtgtggtctgaaccccaagttagagaaagtgtggacttggaacaggaaaacagtgataatgagcatttggttgacaacatgaagttccattacttttagaggaatctgatcttcgaaggatccccaggtgtaaagactacaccccttgaggcgaccgacagaatattaaccctgtaacatctaatttcagatgaagaaatgtcattgaacacagttacaggagaaccaaaaactatcagttccagtgagaaacaaaggataaggcgtaattcttctgacagtgctagtagataatcctaagcctaataaatttgccaaaatctaagcaatcagcagactgtggactcaaaattcagatcctggatgaatggctagcaatcctcaacagaggtgcccaggatgaggtcacagttcttcttcagatactgctattcaatgaaattcatacaaaacataag

SEQ ID NO: 500389 - DNA, 431 bp, Homo sapiens
  misc_feature (319)..(319): n is a, c, g, or t
  misc_feature (359)..(359): n is a, c, g, or t
agataaaatgtaaactgtttctttaaaattggggcttcaactttggaatttcacagcgtgctaaaataacagatttctcagaagtctttcagcaagataaacattattaaataacttatttatgaaagtattaaaatgcttacatttgaacttgatggctaacttacaaagattctctatgtatcaaatgtaacttactgtgactaaacttaatttaatatttactctataaccaaatgaaatatatttaaaatatattgaatattttatattgttatatcctgacaagattataatattttaatgtactaatatttcngtaattatatctaaaatattattttattatattgcctaanaataaacatttgttaaattggagctggtcctttttttccaaaatggaaataaattttttttggattgtaaaa

SEQ ID NO: 500390 - DNA, 978 bp, Homo sapiens
gagcgaaagggcatggtacaggctggcactgtacattggactcctaggcgagggcacgcctgcatccaggacccattgatcgatgccatgaagcgtaggcctcaggaagagtgtatagggccgcaaggatcagtgcaagcagcatcacgcgtagcatcgcagaatcacatcgggaaattccgcggaaagagacatgcgtcggcacgggattcttgcatcagctcatcaacacgttctagcatttgggcacctccgctacagtgcacctcaagtgtgcgaggatgacaagaaggaccgtcgagagcactaggcgcgcataacaattcatcatgcaagcgaatccacgacttgggcagtagcacgagtagatacgtggtgtcgaggaattctcttgattgtgcgaaccttgttcgggccggtaaggaggagaaacaatacataggtgagttggctgcttgggaacgccttgacgatgacgcgttggcgcaacacgagtaggtaaaagggagagatgaaggacgacggaaaagtgccacttgggttggataacgcgtgggggagagttggcacgcaacaggagacttggcccgccttgagcaacacccattcgaacttttgatgcccagattagacccccaaagcaacactcgatcgggtggctcgtgacacggtgagcattagaggacaaagcacccttaaagtttaatatggtagcatttagtaagtaccattaccggaaggggagttgcaaccccggaccgccatagagaatagcacaagcggaagagatagacatatagacacagataaccacttccagcacagtgcagagctacccgtgagcaaacgaatcacagacaccccagaaagtgtggaacacaaccgcatcatcgcattacacaaataggaccacattggcaaagagccagttaggttcgccacatataacagttatattagcccactactagaacaaca

SEQ ID NO: 500391 - DNA, 110 bp, Homo sapiens
cggccctcctagccgccagcacagtcagcgccatcgggttgctcgggttcgtcggtctcatcgtgccgcacatcatgcggctgatcgtcggaaatcgccacgtcatcctg

SEQ ID NO: 500392 - DNA, 1380 bp, Homo sapiens
gcgcgagcggacgcggcagcgcctctgtctcgctttttcttatttttcccccctttcccctttctttttgtttttttgctgtttcttttctcccctcccccccttgcacaatattcccctgggagggggctttcaccggggcagggggcagagccgggtctacacccagggggtagtaaccacgcgcccgagcggaggcccgcaaatgagggaaagcgggcagccacaagcacacaacaccgggcgcctcgagagcggcgacgcgcggccggacgagagacagaggagagacacgacaggggaaaaaaaaaaatcaaagcgagccacgcgagcacgaaaagtgagagaagacgcaccgaggtgaccagagaaccgacaaggggcaggggcacgaggtaagaccacagaaagcgcaagtacaccacccacaagacagccagaggggaacgcaagaaagagacgacgatacaacggaaggacagggagcccgaaacacaagacacacgaccacagaccgacagggggacgacacccaacctgcggcggcgcagcacatgggcgacagcgcacgcgcaaggagtggtgacaaacatgggagaaacaccaccagaaggagaggaccgccgaggggcaacaccgaccaaagcagaagagtataacagcgaacaagacggcacgaacacgcgcagaagagagcgagcaccgcgagtgacgaacaacgagggagcaccacaagagagagcagacagcagacgaaacacgcccggcagccaagacgcaaaaacacgagggagcagggaaactagaacagagcgcacagacaacgaccccacaaacggacaactccaacagacgagaacacggaagacggaagaggacaagaagaaagagaggcaacaagcaagggacagaaccgggtgcccaccgacggacgacagggcaaccgaacgcacaaaacccacggcaaacagagaccgacaccgccgacaaccacacaacaagacactgaccgacaaaaacaggcgagaaccacgcagcaagcggcagaaaccacgggccaccacccagacagcgtcacgccaaaggtagacacccccaaggagacagaatgcagaaaaaaatgtgtcaccaaaacgaaaaggcaggcacaaagcacacaggaagacaacacggagacaagcaaaggagcacaagccaaggtagaacaccagacagacacacgggaggagcgtcggagagagaagcgacacaacacaaggcagacacagcgaaaatcaggacgccagcaggacgaagcaggaagccacgagcaacgaacaggcccaacgccggagagaggccgacaaaccagagggatacacacagcgaagcgaagacgag

SEQ ID NO: 500393 - DNA, 291 bp, Homo sapiens
gcttcattaggaagatgctatttgagtaaagaactttgaggacttcaaggagttagtcatgtgggcaactacacaactgcattggaggcagagggaacatttactctaaagtccttaaggcaggaaaattccaagactgatcaagtaacagcaggagagcgtgtgcagacgccttgggccaagaatgttgaatacattactgaagggagccaagggtgggaggtgatccgagagagtgaatttttcctggtgtggatcagggccggaatttcccgggttgtgttgtgtgtc

SEQ ID NO: 500394 - DNA, 697 bp, Homo sapiens
  misc_feature (185)..(185): n is a, c, g, or t
agtttgggccgggccaatgtgaaaatgactgaatgaaacagtacaaggtcaggggctcagtaaaatctgtttagagacagactaattccgtcatagctaccctagtgaaaagaaaaccaccatccattgataacgctttatatagagtttataaagcaattgtgttttgtaatataacgaatcanggatgttattgtatattcgactgcccaactaaagaactctatagtgagtgtgacattcccagcccagcatattgtcagctgctcgtttcatatgctatatgatatggctttctttgcaagtgcctatttttatgctaggcatgttaacatcagggatttgagtgtggaacaactcgaatgtctgttctcttggtaagccccttgtaatgatagagccaaatcaggctgccagactatgtagaaattcatcatccagttactaaatcagaaatccacacatcccactacctttatatatcgcctaggagcagagtactcatcacagcttgctaaatcccatataacgctatgtatgggtatgtaagtaacaatactgtccgcatttacggtttcattcaaacactcttgctgtatatatcctcaatgatttatgtattgacatcttcaatcatgcttctattgtcctacctttattacagacatgtcatttgtatcgcctgcatgctcatttt

SEQ ID NO: 500395 - DNA, 767 bp, Homo sapiens
  misc_feature (244)..(244): n is a, c, g, or t
aaaaaaattagaaaggttctgtcttgcacttgtgcccatgggccatataaatccgagacgctccaaaatataaatcctgttggtttgacttaacaacacaacccttgtaggccttgcatggtagggttccaggagaatttggaccaacagaaaaggagccaatggacaccaagttaaaaggttttgctggccaggtatggtggctcacgcctgtaatccaagcacttgggagggctaaggtggncggatcacctgatgtcaggagttcaagaccagcctggccagcatggtgaaaccccatctttactaaaaatacaaaaaactagccaggcgtggtggtgggcacctgtaatcccagctacttgggaggctgaggcaggagaatctcttgaacccaggaggcggaggttgcagtgagccgagatcgctccactgcactccagcccaggtgacagtgtgagactccatctcaaaaaaaaaaataagaggccgggtgcggtggctcaagcctgtaatcccagcactttgggaggccgaggcaggcagatcacgaggtcaggagatccagaccatcctggctaacacggtgaaaccccgtctctactaaaaatacaaaaaaattagtcgggcgtggtggcggacgcctgtattcacagctactcgggaggttgaggcaggagaatggggtgaacccgggaggaagagcttgcagtgagccgagatcgcgccactgcactccagcctgggtgacagagccagactccatc

SEQ ID NO: 500396 - DNA, 218 bp, Homo sapiens
  misc_feature (153)..(153): n is a, c, g, or t
  misc_feature (178)..(178): n is a, c, g, or t
ctaggcccccttctggaggtgaatggtaaccgggatagcaccatgggaatgtacttaatgccgctgaactggacacttaaaaatggttaagatcgtagattttggccaggcacagtgactcacgcctgtagtcccagcactttgggaggacanaggaggtggatctcttgaggccagnagttcgaaagcagtctgggcaacatggtaaaaccctgtgg

SEQ ID NO: 500397 - DNA, 113 bp, Homo sapiens
gtgagtgctggtacctgcaccccggtgtgctggcccggatcttccggaagtcgggtggcttgaaaatgcagcccaaacgcgggtggtacacctccatctagaggctaaatacc

SEQ ID NO: 500398 - DNA, 791 bp, Homo sapiens
atggtggttgttccctttgtagtgttccctctttttatttgctctggagcccctatttgtcctcttgttttcacgttatttggccttgtggtctctcttgatttcctcacgtctgtcattttgttgttgtcacgctgtgtcttggctcccttttgagttcaggtattggcctagtgatgtactctactctcttcttcttctctgtactcctcttgttttatgtgattcccctaggtatcttttgtacccttgatttatgtacgtgtagatgtccttctactctcccgtagtctctattgtctatgtactatatgtctcgtgtatttctgtcagttccgttgtcctatggtcgtgtctctactacttgtctcctcatagtctgttagtctgtagttttcgttaggccgtctagtctacccatagttccctgtcatggtagttgatagtctgcaatcacttgtttgattctacctagtacttttatgcaagtatcatcaggcttatacccatcatagctgactcctagtgtggaacatccgggctggtctttgtagtggactacgtaggatggggtctggggtaaccaccacccagccacaggcgctgtcagcctgcccacctcaccttcccgctggactatctaccttaaccagcctttcatcttcgtactgagggacacagacacaggggcccttctcttcattggcaagattctggaccccatggggcccactaatatccctagcttaatattccaatacctcgtagctagtaaacccgagggacagtac

SEQ ID NO: 500399 - DNA, 197 bp, Homo sapiens
agatctctaatttcttaatgcaaacatgtaccttacaacaccctacaggtcctaaaccaccaaacctgcattaaaaatttcggttggggcgtacctcagagcgagaacccaaccttccgagacattacatgctagagacttcaccgagtcgaatgcgaactactatactccattgatccaataacttgaccaacgta

SEQ ID NO: 500400 - DNA, 452 bp, Homo sapiens
cctcgccctgcgtcggcatccatccagtacatgcatcctgagggaggagcgctgaggcctgagcgtggacagagagctcatcatcgagtcgtgcgacgcctcctcggcctcggaggagagccccaagcgggagcaggactcaccacccgatgaagcccagcggccacatggagtgccatcacgggaggagactgagcgatccgggcccgaggagctgtagcgccaatgccaggacggggccgtggccgcagccagggtatacctatcctacgagctaaccccctcaaaatgagaccccagaactggaccccgagctgccccctggagacggagccctggagcctgagacgcccatgtagccacggaagcctgaacgaagacgtcgagttccaaccaaagtcctgcggacacaaagggccctgggaccactaggtcctggcgaccccgcccca

SEQ ID NO: 500401 - DNA, 242 bp, Homo sapiens
acttggggtgggtgcatcagagaaaacctctcagagagagtccatttcttcaacagtcaacaattatttatcgaggagcgacactgtgccaggcacggtgctaggtgatagacatacatcagttaacaaaactgagggaacatctaacccttatggagcttaactcataatggggagggagtggtgagagtgataatagacaacaaatgggtacataatatagcaactggtagtaaatggta

SEQ ID NO: 500402 - DNA, 1628 bp, Homo sapiens
agtgaggcgaattctggaggctgctgcatgcttacttgaagaccgacgactttatctggtgtggcgacacgagtgacactttggtctgagcatcacagttagtactgcaccctgttgtggctctataagccaggttctagagccttctattccgccaggccgttacccaataaccaaccgctggtatcctcagcctgcgattaaccagtcgccagatatccagggctagtctatggcgccgaacgctcgaatacctggtgttcacgatagattggccccaggttttgactggctggtcgaggctttgcaagaaggaccctaatgccttagcatagcggacaccacgctaccgggccatcccacgacacgcgctacccacggcgcaacgccgacgcacaggtcacgacacgcccccccaggcggcttagaaggcgaggacacgcgaagggcagcaccagcacagcggcggcgctgcgcaacctagcctctcccttcgaaccggaccgcgacccattcggcgctggcacctcggtcagacgccacgagccccctcggctttggcactgtgccctcctcatcgcgtccccacccggccccgccccttctgcgcgcctccaccccttgcccccaagacgaagtttttacccctttcgcgcgcgccttcgcgcctgtctggaccctcttctccgcccccgccccgagtctcctctcccagtgtctgtagctccctctcccccctcctcatcgcgcccgccctcactgtgcccccgtctttctcctctgcgcacagccgccgctctctggagctcatagcgacgacgcgccttgtgcggtcccccctcgtctcggttaaactcctccaaccgtcatttggcttttccccctctgacactgaccttctccccgccctagaccctcttcacctacaggcctgtccagttctctcgctcccgtcgcggcctgttgcccaccacccctcttcgtgctatactctcgaccgaccgcacattgccctgcgcccccgtcagtacctcgcctttatcttggggaccacctcctaaacgcagcttctctttctctgcgcgtctgtgcactcccgctggcccccgcagcatgcgcctttccgcaggcagtccgcgcactagccaggccgccctcccgcgctctattcctcttgccggccacctgctttctgcgtcatggcgttgacccttatccactgtccgtacaccactccacaccaaggcgtcacccccccatatgctaccccacccccatgtccccccatccactcaccactacctctacctcccccacaccaccatccccctccactctccgcctcctccacttctctctacctacccaccaccacacactcacggcccaccgccactcatccatcacctcctccactcactcccctcaccaccccacccataactccacacgacacaactaccacctactacactctaccacccgctctctcctactctgcccccgtccctcgcccccataccctccctcccctcctacccccgcagctccgtctccctccctctgctctcccctactccttctctcgccttctcccttttttcttccctccccccctccctccctct

SEQ ID NO: 500403 - DNA, 269 bp, Homo sapiens
cccctttgtttcccccggcccgtttttccttaaagccttttttttttttaaggggaacccggaaaggggaaatttggcaattttggaaaaggttccaaatttcctttgggttttttaatttaaaatttttttttgggggttttgggttcccgggtaaagtgttgggatttttggttccggggggttcccttttaattttgggagggcttttaaaattttttaaaattgggcctttttttccctgggaccccttttttggaaatttttta

SEQ ID NO: 500404 - DNA, 720 bp, Homo sapiens
ggcaaggattccgtgcctttgtgacagactgggacacagtgacagcacggtggctgggctgacgctgctggctgttggggtctactcagccaagaatgccacgcttgtcgccggccgcttcatcgaggctcggctggggaagccgtccctagtgacgggagacgctcccgcatcacggtgcttgattgtctgctgcgcgaccccatccaggtcacgacggcggctcctcacgtcgaccccaggaccgcgctggagggtgttgtgctcagtcccagcctggaacgccacctgggtgcgcgacatcgccatagcaacaacggaacacccaagatagaaccgcagcctgtacaggaaccaaatcctgatgtactgggccaccagtgcaccgggaagacgctgtttgccaagaaactcgcacctgcgactcaggcatggacctacgccatcatgacaggcggggcacgtgcgccccatgggggcgcgggaaggcgtgaccgccatgcacaagctctttgactgggcaactacagccggcgctggtctcctgctctttgtggatgaacgccagactgccttccattcgcgaacgcgagccaccgcacgaagctcacgccgcaggcacatccaggcgccaccactgaacgcccttcctgttaccgaccggaccacgcacagcaacaaccccagtcacgtgtcacacggaaggatcaacgtcctgct

SEQ ID NO: 500405 - DNA, 283 bp, Homo sapiens
acagacgttaccacagcccactatgtgaatgtactgttatctctgttggttaaaatatagagccaggtgtggtggctcacacctgtaatcccacgcactttgagaggctgaggctcgaggatcggttgagcccaggtgctggagaccagcctgggcaacaaagtgaaacctgtctctgcaaaaaatacaaaaattagctgggcgtggtgatgcacacttgtagttccagctacactggggctgaggtggagggtcacctgaaccggtggaggtcaaggctgct

SEQ ID NO: 500406 - DNA, 221 bp, Homo sapiens
ggaagaagctgttcacggagacccccaatctgtcggaaacgtacttactcatgcgaataccagtccccgtggaacgctctaagatctcgagcctcatccagacacactcagcggcgatccaggtccagaacccccctgataagccgacgtatgcccagatctcgaacttcaacagtcagccggaggcggtcaaggtccaggctttcagatgactcgacaaa

SEQ ID NO: 500407 - DNA, 331 bp, Homo sapiens
cggcacgaggccaggcgagagaaaatgccatggcaacggcatcaggatgctatgctgctcttgcactgaagatttaatgggagccgtatctgattacccgagctcaggcctgccctgccctgtccagtccagcccagcctggcctaccctacccagcctcttccccagcccagtccttggccattagcatatcaccagagaggtcagcactttacaattatccgtccagagggctggctggtgggaaggacttgccccactgttccctagaacacttgtgtttctgctgttgcaccaggttttattttaggttttgacgatttaggtgcca

SEQ ID NO: 500408 - DNA, 614 bp, Homo sapiens
  misc_feature (120)..(120): n is a, c, g, or t
  misc_feature (472)..(472): n is a, c, g, or t
ctggaatgtgctgtgtgactgagggtaagatcatctacctctctgagctttagggtcctcacctgaaccgaagattacatcactggtggcctcatggggctgatggagaggacacaaagntgtctctgtcatggactctgcctttggagagagggagaattccactggggtggcatcatcttcagcagcaacaaactctatctatctatctatctatctatctatctatctatctagtccatttatctatgtaatctatctagcttccatgtgctgagcttcacccagccagaccttgtcagatgccaattgacttatctccttacataagaacgtgtgtatgagaaggagctagactttcaaacaagtggcatggataggccctgagacctcatggagaacgagcaacggatggttattctgtacattcatatacccctactgtgcgcctagctttgagcgaggggatggngaactgcgggagctgccctggaacgcagttctcctatagagctgccgatgaagcttacatgcttcttttctgtcgctctgagatggatacacggtgaggatacccgcgcctgagcccgttggtgctattggccgttgctcag

SEQ ID NO: 500409 - DNA, 395 bp, Homo sapiens
gtcactgcgtagcggtgagcggggttgcaccactgcactccagcctgggcgactgagtggagcggaactctgtctcaaaaaacaaacagaggttttttaaaatcatcagctatcgtcagtgtcagtgtctgtcctgtgtggcccaagacaactttgctcctttaaatataggcagggacgtcacaggatgggatatccctggtttataccaagaaagagaacaccccacttttgcaattgcctgaaaagactaccatgccatctgaacaccttgtgatttctaacttctgtgctttttggtagcagtggactcccagggtgactctctgagggatgtggtaccctttggaaggaggttgcgggtcactacggatgatccttccggagtgacatat

SEQ ID NO: 500410 - DNA, 365 bp, Homo sapiens
  misc_feature (283)..(283): n is a, c, g, or t
tcacactatctgtgcccatgacagaactactgggataccgagaggcgtttataccatagccgccccgttttaagagtactgccccaagcactattgacccatcacaaactactggacccatcacaaactactggacccatcacaaactactggccagtagtttgtgatgggtgatctagatcactattccgtctctgctggggaagcccatcacaaactactggacccatcacaaactactggacccatcacaaactactggacccatcacaaactactgganccatcacaaactactggcgtttgtgaagtctcaacgacatcactatttccactcttctggggaagcccatcacaaacttctt

SEQ ID NO: 500411 - DNA, 412 bp, Homo sapiens
gcatttttatttccaggttaaaatgttagcacactaccctataggcatcagagaacatgaggggatttaaaacaattaaactagtcccagtatgaagaacggattagaaggagaggcactagagtcagggagacgaattaagagatgttctaacagtgttggcatttggtaacaagatctgcattagtgtgatctaaaggggagtgaaaagtagggatgagcatgaaattttcagccgaagattaattacatggaaggtcaggattgaaaatccagattttggagtcaagaggcaatacttgaaaccaagagaccctgccaaaggagagaggagggggctccagcgcaagctctgctgccccttggcaaggcagtgtgtgggggcgcggacggagaccgagacttcagcttc

SEQ ID NO: 500412 - DNA, 341 bp, Homo sapiens
  misc_feature (3)..(3): n is a, c, g, or t
  misc_feature (32)..(33): n is a, c, g, or t
  misc_feature (259)..(259): n is a, c, g, or t
ttngaaaacccgtttcaaattccagctcggtnnccccagtagtttgtgatgggtaatctagatcactattcgtctctgctggggaagcccatcacaaactactggacccatcacaaactactggacccatcacaaactactggacccatcacaaactactggacccatcacaaactactggacccatcacaaactactggacccatcacaaactactggacccatcacaaactactggacccatcacaaactactgganccatcacaaactactggcgtttgtgaagtctcaacgacatcactatttccactcttctggggaagcccatcacaaacttctt

SEQ ID NO: 500413 - DNA, 172 bp, Homo sapiens
tcggtaccggtgtcatcgatgcactgcaccagtcactcctatgctataaggctctgtacttctgtaaggtttttctttcacgtaagtttctctaagacggacaattgttcacattttaacatacatgaaattaggatgcttttttttttttttttgggaaatggagcctcgc

SEQ ID NO: 500414 - DNA, 412 bp, Homo sapiens
cttcagcctgtttagtgctctacaatcatcatattctctgagcatgcgtgataaattgtaggcatccacaatagatgtccagcaattatgtatctgtgactggccgctacatatgacagattcaaaatgagaaaattaattaccattctttgtatacacagatacttatttatgagtgacgtgcagttagttatacaatcagcctgggcgacagggcgactctgtctcaaaaaaaaacgtcatccatggtgaatgactgtacaaacggcttataaatacgtgtaatattaaaatatatcttaactgaaagttacagtgacaaaccaaataagttacagatttaatgtaaccaaaattcatgtacatggacaaattacgggacatttaatactgctggtgtaggggataacat

SEQ ID NO: 500415 - DNA, 219 bp, Homo sapiens
  misc_feature (137)..(137): n is a, c, g, or t
acattgtgaagtagtgcactacttatgaggatcgtgctggatacatcgaaaagtgctggacagatcacaaactactggacccatcacaaactactggacccatcacaaactactggacccatcacaaactactgganccatcacaaactactggcgtttgtgaagtctcaacgacatcactatttccactcttctggggaagcccatcacaaacttctt

SEQ ID NO: 500416 - DNA, 121 bp, Homo sapiens
gatctggaggagctctcatcatggtacagcagggcgtcagtttatacacagctcttgggacggtccgcaccggtgctcaccgtgtcgacggacacttgtaccagggaggcatgcaccgcag

SEQ ID NO: 500417 - DNA, 178 bp, Homo sapiens
cctgcttccaagtaggtcacagtgaccaccacggaaagggcaaagctccctgccctgtgccctagagctagtacagcctgagctagtagcaagtagaccctacataggtacataccactgaagagaggcctactatccagaccccaacagccactagtaggaggagaggaacacctaa

SEQ ID NO: 500418 - DNA, 822 bp, Homo sapiens
  misc_feature (397)..(397): n is a, c, g, or t
atggcacatgcagcgcaagtaggtctacaagaggcttacttcccctatgcatagaagagcttatcaccttatcaggatcacgccctcataatgcatattgcctgtatctgcatttccttgagattcctggtattgcccatgtgtcccatagatccacttcaactaacaaaagagcataacttgaattacttaaacaatctccagaacagcatcagggacaatatgaaaccgggcatgaacatatgcccttgcaccgccaatcatgcctagtcgcgtcaatcggtcggctcgccatcccttacgcatccttgacataacagaacgaggtccatcgatcgccatccccctataccatcaagtcgaattggactccaagtggttactgacaccctagcgnagatagcatccgaggtacgggtcggatcgtaaatcatatcaattgccgtgacagtacgttccgcacgccaatttagtatccttaggtaaaccccaaggtcggatcgtgacgaaacatcacatgtggaccgcttgtgagctaaattcggaagttagttagcttgcgctcgaatcttggaggatgccctcactcgacttacgggtaattagattgacactttatctacttccatcacagggacggttccgtctgcctaacttcctagtcgaaggcgtgttcttcaccccaaccaattggagggtgcctttgaaacagcaagcaattgcacattcttcccctgagaaacggattcataataacgcaaaaccaattttttcaacctgggttaatcaacggaaccggggggggttaataacttaaccggg

SEQ ID NO: 500419 - DNA, 151 bp, Homo sapiens
ggagtagttatatctaaggaataatcctgccatatttcttggctctgacctgatgggacgaagatgcatcttgttcccatcagttaaattaatttgcagaagaaacccttgccgactctactaatagccttgctgatgggacgaagatgcg

SEQ ID NO: 500420 - DNA, 761 bp, Homo sapiens
gcacgaggagcggcctcctcctccctggtggggcctgtctgggtgaagcccctctgttcccgcctgacttcagtgaaagctcaaggtgcacttggctgtttctacagcttcggagttcccagctctgcccaagttggtgccagcgagctgtgacctcagggcagtcactaacctgcccaggcgagtttccctcctgcccaattaccctagttctctgaccctccaggactgccacagagcaagatcttcactgcgccttctcttcactcccagtgttctttgcatggcctcagcatttattggagccgctgtctgattcattttggattcatctcgtgcactgtgcaatatgcagtggctcttcagagccagcacaatggaggtgacccttctccccgtgcaccttccagagattaacacgtaaacaaagaaataaacacagattccaactgtgatgcatgtggtgaagaaagaactggggcccagtatttgttgacctttcagtgttctgcactcccaagggagggccacgtggtggggatggaacacaggcatggacagtacgtaccttcctcctttagcaaacagggatgatgggcgcctgtgattagtccacacaaaagcattcgggagggtataacactcaaatgtaatattagtggcgtggcaagattcttccccattgatgaccattagtgtgctatttttgttttctctatgaagaagaaaattaaaatttttttcattgcaaaaaaaaaaaa

SEQ ID NO: 500421 - DNA, 283 bp, Homo sapiens
gggggggggggagccccccccccttttttccccccccccaggttttccccgggggggccccccgggggggggggggccccccccccccctttcccttgggccccccctttttttttcttttggggggggggggggcctttgggccctttttcccccctgggccccccccctttttggggggggggggggggggggccccgggggttttttttttttttttaaaattttccccctttttttttgggttgggccctttttttccccccctttttttttttgggga

SEQ ID NO: 500422 - DNA, 703 bp, Homo sapiens
tccaataaaaaaaaaaaaaaaaaaattaaaaaaaaaaataaaaaaaaaaaaaaaaaaaaaaaaaaaaaaaaagaaaaaaaaaaaaaaaaaaaaaaaaaaaaaaaaaaaacctggtgggccgcttgggccaagcggtttttagattgggccaggttttggatgggggccgaatttggggctaattgggccattcccccttatggggggcggtttaaaattaaatgggccgtggtttaacaaggtggggccgggaaaaccctggggtttcccaaattaaaccgcttggaagaaaatccccttttggcaagtgggggaattggcaaaagggcccgaccggatggcctttccaaacagtggcccaccctaatgggcaatgggaattggaaggggtaaattttgggtaaaaatcggggtaaaattttggtaaaatcagttattttttaacccaatgggccaaattgggaaaaaccccttataattaaaaggatttccccgaaatgggtttaagggtggcccaatttggaaccaggggcccattttaaagaaccggggcttcaacggtaaagggggaaaaaccggtttatcagggcaagggcccattaggggacctatcccctaattaaggtttttggggtccagggccccgaaaggccttaaaattggacccttaaggggccccccctttgtttgccggggccggcct

SEQ ID NO: 500423 - DNA, 596 bp, Homo sapiens
agaagaaacaggaatatagggagatgtccaggatagactgtttaaggaaataaagcaagatacaaaataagtgtctacagtgtgctgtactttgcataaggagggaaattaagattatatatatctgcaaaatgaaacactagaagcacagactagaaatgaatgaattgggggtgaggggcacccagcagtagaaatgacatgtctaaagatacttttcatacttttttttttgagaccgagtttcgctcttgttgctcaggctggagtgcaatggcacaatcttggctcactgcaatctccgcctcccgggttcaagcaattctcccgcctcaggttcccaagtaaccgggattactggcacccactgccacgcccagctaatttttgtatttttagttagtagagatgggtttcactatgttggccaggctggtcttgaactcctgacctcaagtgatccacccgcctcagccttccaaagttctgggattacaggcgtgagccaccgcacccagccatccaccttagtttccacatctgtaaagtgaggctgataatcaccttcctgtttggattgttgagagaaaacaaat

SEQ ID NO: 500424 - DNA, 126 bp, Homo sapiens
ggtctgcaactctagttctacgactatggacaccagcctttggttttccatctgttcgagatgcctcttctctgtctcctatcagatagaaatggcgtcctgtgctgctcgcttcatactagcaga

SEQ ID NO: 500425 - DNA, 370 bp, Homo sapiens
gttgaaaatccccctttccccccgggggggcccgcttgggaattattaagcccctggttgccttttttgtttttcccccctttattttctgccggggggtatgggcttaaagccccttttggattgatgaaaacccggatgggggcccatctttttttaaacccccatgcaaaaataaaaattcccttgttcaaagcttttttttgcttttggggttaaacctaccctttgaatggggagcggggggtgggggggcctttttaaaaccagttcccttcctgggaccgcccccaaaacccttttggggctaaaaagggggggaaagtctgggaaggctttttttttttttaaagttttcccccccaaccca

SEQ ID NO: 500426 - DNA, 149 bp, Homo sapiens
ctggtccctccttctttggttatgatggtgcagcctccccagccatgcagaaatggtcaagtccaatcaaacctttttcttttcatcaaatggcccagtctcaggtatgtcttaggaagtagtctcttggcttcggtctggtgaaagag

SEQ ID NO: 500427 - DNA, 415 bp, Homo sapiens
  misc_feature (2)..(2): n is a, c, g, or t
  misc_feature (43)..(44): n is a, c, g, or t
  misc_feature (247)..(247): n is a, c, g, or t
cntcatcagtcactcgcatcactgattgacccagagcaactcnnttgtcctgtaagctccattcattgtaagtaccctatacaggtgtaccatattttatcttttacactgtatttttactgtaccttttctatatttaagtatgttcagatacacaagtacttattgttgtattacagtcgcgtgcagtatttggtatagtaacatgccgcacaggtctgtagcattggaataataggatataacntgtatagctcataggtgtgtagtaggctatatacctaggtttttgtaagtacgctcttgtgatgtacaaacaacaacgaaatcacctaatgatgcatttctcagaacatatccctgtcatcagtgtatgattgtattgtattttcattgtgagtatcataaaatgcat

SEQ ID NO: 500428 - DNA, 175 bp, Homo sapiens
atctctgcccactcttcctctgcctcccacctcttcctctgcctcccacctcccaagtggctgggattacaggcatatgccatcatgcccggctaatttgtatttttagtagagacgaggtttcgccatgtggccaggatggtttcgaacccctgacctcaagtgatccaccccg

SEQ ID NO: 500429 - DNA, 190 bp, Homo sapiens
  misc_feature (48)..(48): n is a, c, g, or t
atcgagctcggcccgaattctaattacgcacaccaaccaaccaaaaancaaaaccaacaacaaaaaccaccaccaccaccgcagcagccaccaaaacctaccttgaacctatcccctagaatgcccctcacaacctcaccgcaggccccaggctctccgtgtccctctccattccctccggcctcccttc

SEQ ID NO: 500430 - DNA, 793 bp, Homo sapiens
taggctaggtacgaggctgggtggtgacggcctcaacgtggagcgatgggaggcttgagaagaagaagtatgaacgaggctcggcaccaactacatcacccggaacaaagcccggaagaagctccagctgagcttggctgactttaggcggctgtgcattctgaagggcatttatccccatgaacccaaacgacaagaagaaggttaacaagggttctacagcagcccgaacgtgttaccttatcaagatgacatcaggtttctcctcgcagcggaacccaatgttcaagcaaagttcgcgtgagatacaaggtgttcgtccggtagaggctccggaaggcttatgggaagagcgaagtggaacacgtgtagagcgtttacaaggacgaataagctccaactacaatagctcgaccacagtcatcaaggaacggtaatccctacgttcatgcggatagcccatgcagggacgcgtggcgagctgaatgccctcgtccaatgtagctgtccggtgttttccgacgccttccctgcgtgacttggctaagttgccatcgtgcagacgcattcaagctggtgccggcaggttctagtgtggagttcatgcactacagttatcgctgccgcgtgcccgtgcgcaaggtcttgcctgtccatcaaaggcatttactaccaggccgaggtactggggcagccatcgtgtggatcactccctatgccttctcccatgaccacccgaagacgtggactacggggtcatggcacttcagcgagttctacagcacgctgctgg

SEQ ID NO: 500431 - DNA, 425 bp, Homo sapiens
acagcaattcaacatcacaataaaaggattatacactagaatcacacgggatatattcctggaaggcaagaatgcttcactataacaacatcaatcaatgtaatatgccacagtgaaagacaaacaccatacaaaactcaacacccttttatgatttaacacaacactccctaactaggaatccaaggaacttacctaaacttaacaaagtccacacataacactcccacagctgacatcatactcaattgtgaaacaatgaacgcttactcttcaagacgcggacgacggaccgaataccttctcttcccatttctatcgcaaatagtgctgggagtcctagccataccaactcagccagaaacaagccatatcaggcatctaacttgaaaacggaagaagtgcaatcatacctctagcatata

SEQ ID NO: 500432 - DNA, 244 bp, Homo sapiens
  misc_feature (162)..(162): n is a, c, g, or t
  misc_feature (244)..(244): n is a, c, g, or t
gaccggtctgacagcttcctgaggtgatggtctgtggcctatggtgctgtctgtacacaatggggtgagtcttgtcttgttgtgggagagtctttgtgtcatggaaattgcgggtcttcaagctgtctcatgagtctattctcgggaaagtctgtttcattnggcaagagtcccctgtgctccctaggcacgacgtctatggtctgtggtgagagtatgtgatgtcaggacagctggctcgacn

SEQ ID NO: 500433 - DNA, 1008 bp, Homo sapiens
gccagcctggggtatacagcaagactctgtctccaaataataatacaaattaggctgggtgcagtggctcaagcctgtaatcccagcccttagggaggctgaggcgggctgatcacctgaggtcgggagttcgagaccagcgtgaccaacatggagaaaccccatttctactaaacaactacacaaaatcagctgggcgtggctggcacactgcctgtaatcccagctactcaggaggctgaggcacggagaattgcttgaacctgggaggcggaggttaccggtgagcccgagacttgtgccattgccatgccagccttggacaagtaacgagcaaaactctgtctcaagaaacaaaaaaacaacaaacacattaaaagggaaaatctttgacaacctttagtgagagagcaatcattcgttctacaccatgtgagaacacaccgcgtattgcgcacggcaggggcacacaaggagccatcttcgcgcgtgtcacacgtgtgtgacacgtttatcacacggtcctcgtggtgcctacactttcgcccgatatctcaaattgctgtcccttcggaggggggtgtcacctcattgcgcacttcctacgcgtgggcccctgaggatctgcaacccgcgtgtcaacacggtcttgggcccacacaccatttggtgcgccacctctcttttactacgacgatgtccatgagcaacagattactggcgtaaggggatcgtggggggcacacatgggtgcccacatcgtgtattgttataagctgcgctagtgtggaggccgatccagggagaccgacaaatacaagagggggccaatattcgagggaaacaaccactaaacttgtgctcgtccaccacgttgacgacaccgtgcgattcatcgcaacgactgtgctcctcacaggcgggaggataatatgcaaaaaaagcggttggttgtcccgcctggacgtgtggcccaatttggtgatacagaaatgcagcggaggtggc

SEQ ID NO: 500434 - DNA, 113 bp, Homo sapiens
aacctcgggagccgggagtattaaccctccgggagaccttaacctccgagagccttaacctcgggagccttaacctccgggagccttaacttgatgccagcacaccctgtctg

SEQ ID NO: 500435 - DNA, 943 bp, Homo sapiens
acttgtatattaaaaaaactcagtaagcagtaatttcaagaaactggagatagctagggatgatggctcatggctgcgattcccagcactttgggaggctaaggccagaggatcacttgaggccagaagtttgaggccagcttgagcaacatagctgtctctacaacaactacaacaaaggttggctgggcatagtaatgcatgcctatagtcctagctagccgtgaggctgaagcaatcctcccacctcagactctcaagtagctgggaccacaggcatgtgccagcacacctggctaattttgtattttttgtagagatggggtcttgccatgttgcccgggctggtctcgagctccagagttcaagcaatccacccgcctcagcttcccaaagtgctgggattacaggcatgagccactgagccaagacctttcctttccttttctttttcttctcttcttcttcttttttatatctggagaatggagtcctcgctctgttgccgaggctggagtggggagatgtaatctgggctcgctgaaacctcgggctcctggataccaagtgattctcctggcctcagatttccaaagtagctgggattcacagatggcggcccaaagaaggctctccgcaagattccagaagtggtctacttgaatccataagtactagggctcgtgagaaaaccctggaatcccagtgatggcgcgaaaggggttccaacggggtggcctggggaagcaaaaaatcatgtgtccggtggaaaactgggtggaatccattagagaacgggaaaaattttcggaagtccacagaggaagcgggactatagagaatcgtggagcatatctcagaagtgtgtccagaagcaatatgaaaaaggcacaggaatggactacaacgagaaaaacgatggtgtgaaaaaaaaaacttgaaa

SEQ ID NO: 500436 - DNA, 110 bp, Homo sapiens
aagctccattaaagcagggaccttgtctgttttttttgctggatctattccccacgctttatgatggtgcctggcccatagtaggccctcaataaacatttgttgaatta

SEQ ID NO: 500437 - DNA, 166 bp, Homo sapiens
cgttcagaggatccggtctagggtagaaactggtgtctggtcggagtgatctgtgagaaggcgtctgtcacgctgttatctcatgatgctgctgtaacagtgattttagtttttcatttctcaaataggaatactacctttgaattcaataaaattcactgcagga

SEQ ID NO: 500438 - DNA, 101 bp, Homo sapiens
cacaaacgttaccctggctatgaaggaaggtctggccactccccttccaccctcagctccacccagttcgcgagctgtgtggccaggagtgcaagttgggg

SEQ ID NO: 500439 - DNA, 578 bp, Homo sapiens
tgatcccttaattggtctacgatacgtatcagtatatcctaggtagagtgcctattatgggctccaggccgtcgagcccctggatcgccctccggagcacagaccacttctggagagctgctgcccagtttgaatgtgcctggagcgcgagcctcttccctgatatctcgattgtgagcgccttagggaaatccgcaggacccgggtaggagaattacaacgacgccacttgacaactcttaacagagatgcttcataacttagatttctgtgacatattggtgatcggaggggacttggacccaaggcaggagtgcttggagctcaaccacagtgagctccaacaaagagacctggatgccactaaattctactgcaggctactcccatctacggtgtgggctcccattgagccgctattgagcagggtgctacatcaaatccggataccgcaactggcgtccggcttccctttaggccccgcgttaccggattaagtgctcagaactcaatggggcgctaacactagcaatgagttccaacttggaggtcagcatcccgtcatcgaagaaccaatt

SEQ ID NO: 500440 - DNA, 329 bp, Homo sapiens
  misc_feature (135)..(135): n is a, c, g, or t
  misc_feature (208)..(208): n is a, c, g, or t
  misc_feature (230)..(230): n is a, c, g, or t
aagacagagtttcactcttgttgcacaggctggagtgcaatggcgcgatcttggctcaccgcaacctccgcctcccaggttcaagcgattctcctgcctcagcctccccagtagctgggattacaggcaggcgcnaccgtgcctggctaattttgtacttttagtacagacagggtttctccatattggtcaggctggtctcgaactncctacctcaggggatccaccgnctcaacctcccaaagtgctgagattatatgcatgagccaccgtgcccggctggcctcagcttttctatctggaacaagaggtggggcaggctgggcagg

SEQ ID NO: 500441 - DNA, 495 bp, Homo sapiens
agacacaaggctgagattatcaccaataacatccagacctcagataggagagggagacagtcctggggccacagagaagtgaaaaaaccagaagcagataataagagaatgggactttctatttatttattttgagagagaatctcactttctatctgcagtgcccctcccagcaatctgcccaggaccacactttcccaccaacttatggtttctacaacactggaaaaagtaagatcaaggtggacaaccagcttccctaccaccgggggttttctggcaggagatctatccctgcctcaacggacaggaagcatcaggaacacccaaagggagaaatatccctgaggacagccagaaacaaaggaagcagagaaggactaccatccccagtcctggaaactctgctccataaattagacaaaggagatgccatatcagagtggcagttcagcagcaccatgctgtggagattagttccacaggtacccgagg

SEQ ID NO: 500442 - DNA, 796 bp, Homo sapiens
tgtctgcacagctgaggcattttattttaccattaatttagaagtgagagaagggtcagtgtctctcccttctaaattaatggtagaataacatgcctcagctatgtagcaaagggaatgggtctgccagattcttccttctgtcagtaaaagctggcaagcaggaaaaacaaaacaaaaaaagaagaataagggcagggcgcccactcgagagagcagtagacccggcacgcgactcacacacagcaccctcacgccggccacacactaacacgcgcaccacacagcaccagggcgacgcagccaacacacgctctgcctacagcagaccaccgacggcgcgaccaccccacacacagaccgcccaagcacatcaataacaacacacttttccaccaaatctccaacaccaatgcctgacatccaactacaaactctactcaccatcacaactacacctcttcgccacaccctatccacccattcaacacatctacaccactatccctctcaccaaccctctaacaccaaatcactcgccgcaccacactctacttcacatccaagggtcacacgaccacccgcccacccactttgaacactcacttctccatcgacagcaatggtaacaagcaccacccatgtcagtgggcaccacccccaacctcggggcaccacacgaacaaaaccctgtactctgcacatacgcaccaccccacctccacaccccaccccgccacacacaccacacacaccacgccacccacgatcaaccgcacgacaacccgcacccgaa

SEQ ID NO: 500443 - DNA, 276 bp, Homo sapiens
ctctctgggttcacacaattcttatgcttcagcctcctgagtagctaggcctaacgggtgtgccaccgcaccaggctgatttttgtatttttagtagagatggggtttctccgtgttgaccaggctggtctccaactcctggtctcaagcgatccacctgcttcagccttctaaagtgctgggattacaggcatgagccactgcgtctggcatatttcttatatttttaatagagacgagggtcttgctatgttgcccaggcccgtctcaaactcc

SEQ ID NO: 500444 - DNA, 433 bp, Homo sapiens
actctcagcattttccagttcagttggtaacaatagcatccttgtaattattcaggattatagcccaggagtcctcttaaattcctctttttctcccacggtttagattccatctgttgagcaattaggctggctttcaacattatcccaaatccatcccttcacaccatctccattgtggccatactacttcaggccaccttcatcgctgtcctggatgacagtgagggcctccttacttgtttcccttcttatagtctgtacatacataacaatgataggattctgtaaatatgttattcctatgcccaatcctccacggccccccaggtcactgtgaattggctccagcattctcagataacatgaccttccttctgttcctcagacataccaggtacatatgtctggatactttggggaagttatacca

SEQ ID NO: 500445 - DNA, 193 bp, Homo sapiens
tctccttttggggatgctctttgctgtggtgcctcctgcatgatattagagaactcagctggagtgagatgtgatctcaagtcatataagatacatagtaggaactgagaaaggaattatcttgaataagaacccctccacccgtcagttctagatgaggctattggtgtatgtagctagttgagctgtgctc

SEQ ID NO: 500446 - DNA, 660 bp, Homo sapiens
  misc_feature (601)..(601): n is a, c, g, or t
taacttttaaaaacctggatgtttatttcccatcaaccattttcccatgctgcttaagagcctatgcaagaacagcttaaaaccagtcaggggttgcctcctacccatttcaggggcctgagcaggggagagctgcaaaaccagtctctccggtggacaggctagagcgcctccagtctctcacgtagggaattgtgctagaaataggcacaagagggcaccgtgtaccacctctctcgagaacccagtctctgtgcacacctctcgagggcgtggagttaagacagtgtgaacacctccgagagagagacggggaagacaagtctccacatctccacccctgtgagaaaactctctctctcctgtgtggtcctccaacgtgacgcatctctctcagcagacagcagacagaagaccctgtggtctcatctcttatattctcaaaactctctctctctccgagagaactcctctgtgtgtgagaagagtctcacgcagatctcacagcgcatgtgtatcctctccaccatgtgtgtgtgtgtgtctccacgcgggaagaacattgtgtgtgcgcccaccacgcaatgtgtccccacagaanacttctcgcccgaagcgccaagacatctctcaacacacaaattcataacccacacctgt

SEQ ID NO: 500447 - DNA, 137 bp, Homo sapiens
ttagaggttccccgggttaatctttacctggcgcaggcgcggccagtcgctgcagccagcctttgttgagcccccgctgggcatggcagcgcgatcgccgtttttctcgttgacggtatggctgtcgccgaactgcg

SEQ ID NO: 500448 - DNA, 212 bp, Homo sapiens
gtcagataaaggtaatcacggagatactaggataccctcataggtaaggtaccagtagaaatagtactaccaggcaaactgttccttcacgtagcctcgggacttgagagactagcataggccatcatagacatagaaggtagggcacatatctatgtctagccagctaccgggtagctataggcatagtaggaccatacctatactatggc

SEQ ID NO: 500449 - DNA, 229 bp, Homo sapiens
tcggtttcgcctcagagcgagtgttctgagggcacgaggatggatggcggaagggggagagagagagagagaatgatcttgcgagagagagcgcacgcataagagaaatcaatagggcgcatgtgccttggatgtgtcaatctctgaagtcacacaatgtcacttttgctttattctatccatctgaagagagtgactaaatccaggccatacgaagggggatggacac

SEQ ID NO: 500450 - DNA, 134 bp, Homo sapiens
  misc_feature (11)..(11): n is a, c, g, or t
tagaccgcttntgtgttcgagttctaaaaaggatgtattacagagggaaaacagtacatatcggaaaaagacatgctagtaacaacaaagaagcattagctgaaacattgataatgcctggttttatgtaaagg

SEQ ID NO: 500451 - DNA, 582 bp, Homo sapiens
tagaggatccccccttgcatggtgctgacaggcctcaagaaaggagaactagtaattgaaccgtttcatccaggcccatccccagatggatcatgattcgctggaatcgaagcgaccacgtctggaacaggtttctgatcctcatttccagcgtgtcagtgctgcggtttcgcctttagttgcacccgctgccagaagggttaggggcttctgcagatcgtaagaaggatccagcattcggaggcaaacttgatgctccatcctctccaattccggggcccccatgtggagttgatcaaaatgcttcaccttcaaagctctcacaggaagcgttaatacagagtatggatcgtgtagatcgagaaattgcgaagtagaacaacagatccttaaagctgaaatggaaacaacaacagcttgaagaagaggcaggtaaacctcctgagcctgagaagcccgttgtcccctcctcctgtggtgcagaaccaccgtaggtatagtccaagtgatttattgatgagacatcggcaaacaagcagaagacgctcataaaaattttggaaggtctttggccaaaaggtt

SEQ ID NO: 500452 - DNA, 793 bp, Homo sapiens
ggtgagctcagttcacaggtgccatggtgtgctatgtgtataccacagggctgtgatggagcctacgtaccagctgtttgtacgagacggcagtctccagccagtcctaaggcagaagtcctgtcgaggcatgatctggctagtctgggctccgtatatgtgcccgatggggagcactggcttatcctgcgtgctttccatgccactgagtttgtcgcgtagtggaaccctcggtcacacgagaaagctgcacatcgtcaactgttggtgcgaggtgcaccgttcaggtgggcattctctgatactgacgagctggccatggtctttgcttacctcaaggatgtggggatgtcatgctgtacagggactctgtggatggcttgcatcccggtcactcaacagtgatatctccgaggcagtgtgtctgacataggtcctgggagactcaacttggtgtaaagacgtgtgtggtcagcccatatagccctgttggcctgaattatagtgaagtgcccatacttcctatgcagccttgatgagcctgagagacctggccatgtgaggggcccgagctgtgatctgaacattgtgaatcacatgtaggtgaggacagctactgttctgtgttcctaggcaacatccctatcaaacgcacgggtcgtcaggcccaggcagctcacagcatgtaatgtaatgcagtatctcctcggtacgtagctgtggcctgtgtgcgggcaattggccgccccaggtggccctcaggatgctcaggcagggcctgacctgcccatgt

SEQ ID NO: 500453 - DNA, 178 bp, Homo sapiens
cgtaaagagcacgttacaaattacccagaccgatactagaatacttactggcgagttcatcattcatttatttttagagacagggtctctagtccaggctgaagtgcagcggtgtaatcttggtttactgcagcctcaacttcctgagctcaggtgatcctcccacttcaccctccca

SEQ ID NO: 500454 - DNA, 1045 bp, Homo sapiens
  misc_feature (332)..(333): n is a, c, g, or t
  misc_feature (371)..(371): n is a, c, g, or t
  misc_feature (498)..(498): n is a, c, g, or t
  misc_feature (530)..(530): n is a, c, g, or t
  misc_feature (532)..(532): n is a, c, g, or t
  misc_feature (547)..(547): n is a, c, g, or t
  misc_feature (554)..(554): n is a, c, g, or t
  misc_feature (578)..(578): n is a, c, g, or t
  misc_feature (613)..(613): n is a, c, g, or t
  misc_feature (628)..(628): n is a, c, g, or t
  misc_feature (648)..(648): n is a, c, g, or t
cgggcggggcgcaggcaggctgcacctcagagcggcgggagcagcggcgggtccaggaaacccctggggcgtacgggtggccccgggggggccgggggcggggaggcgggcggccggcaccgccccggccgacaaaagtcccttcagttcagccggctgcaggggaagtcccggcgcccggcgaaaccaccctcccgtgcagccgagcccagccgctctccggccgccgtccccggcggccccatgccccgatgccccgcgggggccatggacgaggggcccgtggacctgcgcacccggccaaggccgcggactcccgggcgccggctgcnntccgaagcgcccgctggcgcgccctccccggagcccgncgtccccgcggcgctgcgggccttgtcgtccccctggaccctctgcgcggcggtgcgactgccggcggtccccgggccccccacggctggcccggccggagggctttactaccccggagcttactgnctttgtaccccactcgggcatgggctccccgntnctctggtgaactggntacaccntatacccatgatgtgcccccatgnaacagcccctttctgctgaacatcgccatggcacncgtgcagatgagganggagacacgcctctcatatngctgtggtgcagggtaccatgcaggtgtgcaacggtggtaaacttcttccagcagtggggccaggagctccacattctaaaacaactacgggagacaccgttccacctggttgggataacgcacttaccgttaggagccaggcaatgggatacggtggtgccatgcccatgtgggctgagcgcgatggccagaagggcgccactggggtggaacacggcccgcttgcagggacccgtgggaagacacccgcgctggccaggggccagaataataggaccccgcggaggagacacggagaaacgcgagtagaaggggagaacaagcgacagcgcatacaagacggagacaggagaagaaagaacgcgcacacagcaagcagcacgcagatgaagagcg

SEQ ID NO: 500455 - DNA, 194 bp, Homo sapiens
ttagaatatcatgataaggtaacacttcacgcaacaggtatctctgtggccgttgcttcactattcctttggctgttgctggtttgttcttgacaatgatcgtgcgtaccatttctgttggtttgacgcacggtgccgatgcgctgctaaagttggtactatcgtgcaatttaacgttaccacttgattggtat

SEQ ID NO: 500456 - DNA, 96 bp, Homo sapiens
tggcgtccggggggtggtaaaagaaaagaaagcagaaggtttatcagggttttggcttcaggggcttaggacaaattaaaagtcacctctggtgcc

SEQ ID NO: 500457 - DNA, 286 bp, Homo sapiens
ggtgactctacaggatcttattctgcaccacagccgtggagcatcgtgactgtgcatatactggtggtcagattccctgatctctggatctggcgaattcaagtcgaactgtttacgcaaggttctctgggatcttctggaggttgccccctaagatttcccaaattgaaaaggcacccggtcaaaaccttttcctctttctggggcaaccctctcagggaataccaacggcttccatctggcagaaaaccagggaggctgctttttcttttaccccttgagtcgg

SEQ ID NO: 500458 - DNA, 962 bp, Homo sapiens
  misc_feature (109)..(109): n is a, c, g, or t
  misc_feature (132)..(132): n is a, c, g, or t
tataaatttattcatgtacaatttggttacttgaatgttaaagaaaacatgttttgactatgggagtcaactcaacatggcagaaccattttgagatgatgagtacaancaggtaggtgaaacagcttaagnaattccaaaaaaaaaaaaaaaaaaaaaaaaaagaaaacaaggtggggttggggcccttgggcttagaggggacataccccggggggattagaaaggggtgttcacaccctttgcgggcaaaaacgcgggcttgggagagcgtgtgtgggggagcgatgtataaaagaggagggtgggccccttttattcttgtgtggggaacaacaccttggggggtgtaaaaacctctccaaaagagagcgccgattgagggtcgtgtgtgagacaccagaagttgggcgaggacggctgggggggggagcccaagcgcccctttctctcccccaattttcctcattgtgtgtagaatattctctccatataataaaacccggggtatattaaaagaatatattatgtgcgtagccgcatggtgtagccacaggagctttcattcaacaggggcgggggggagcacggggggggctgttacgtcttcgagcaaaacaacttttgcgacaaagagcgacagaggtttttggagagaaagatttttggagggggacggggaacacgctgtggcgcgcagggtttacccacggtggttattccctaaccaggctctccgacaatattttgcaaccgcgtatttataactagaacgggtagaattttccagcaggggcgcccaaagtattttttaccacagacacattggcttgtgacaacatttggggaacccgttctaaattttttccccaggcggttaaccttataggtagagaaatatactttgagcggttcagggcaccacacagttgacaataacgtgccctggttatccccttcat

SEQ ID NO: 500459 - DNA, 468 bp, Homo sapiens
  misc_feature (2)..(2): n is a, c, g, or t
  misc_feature (112)..(112): n is a, c, g, or t
gntcgacatcaaaatactataaatacatatttctatctataggaaaaaagactagaagagccataaaatatcaacagtcattgcttctgagtagtgggacttcaaatgaatnttaatctattttggacttttctgtatgatccaatttttctacatagtcatacaacagaattgatattaaaaacagttttggttgggcatggtggctcatgcctgtaatcccagcactttgggacaggtggattgcttgagcttcagagttcgagaccggcctgggcaacatggcgaaaccccatctctacaaaaaatacaaaaattagctgggcatggtggtgtatgcctgtggtcccagctacttgagagactgaagtagaaaggatcgcttgaggctgggaggtggaggttgcagtgagccaaggtcatgccaccgtgctccagcctgggtgacacgagtgaaacccctttaaa

SEQ ID NO: 500460 - DNA, 165 bp, Homo sapiens
gatggtggttgtaaggtgaaaacgggtaactcaaaggtaaaaagccaagatggggaaggccattgaaggccaaacccgttacgtgagaggaattgggacggtatttcccatctgtagatgtattagacgaaaggagatgtaacagaggaagtagtcagagtgcta

SEQ ID NO: 500461 - DNA, 591 bp, Homo sapiens
tggctgaaggggatactcacctggctgaaggcctgactgtgattccccctacccccacaaggcgatttttgaccccctgagggctgctctagagtgactcaggcccctgaagctgtcccagggaggtccccgctgcatcccaccacccaagctgtgcctcatggatgtctgatgtttatgcagccctgcctgaggcggcgctgcatgctgagagacctggggtgccaggactgcttactcactcttcctgtgaccttgtgactgtgatgttgtactgagcttggatgctgatgtctgcttggattttgtcctgctgaccttggtggttgtgaactgagttgccttgcagttccctgaccagctatttgggagatgctgtggctgtggctgcactgacttggatggatgactgacagtggtcaaagatgttcattctgtggtgacacagcctacggcagctgctgcgtggatgtgctgggtgctgagcaagctggagctcatggctctcatacatttttggccctgccgtgcttaaggcccctccatgccctgcccacttgcccggtttgccttttcgttgcttttcggttc

SEQ ID NO: 500462 - DNA, 154 bp, Homo sapiens
tagctgacataatcatccagtccagtgtgcagtcaggcgtaatgaacatctgcatgtagccactatagacaattatgaataaataatagtgataggaacactgtgtacatttttagtgtgcacatttacatttctctgggctatatttatacac

SEQ ID NO: 500463 - DNA, 226 bp, Homo sapiens
gattacaggatctccagaggagtggggcggcttgcttcccgtgagctcttggtctactggggagagctgcaacccagtgatgggtgggtgcagaggtcccatgggaggtggtctgcagccccatcccaagcatggccctgggggccggatggttggccatggtaggactgggcccaaaagctgggtctcttctcgctgttcccctcctctctgctcctggggtgtc

SEQ ID NO: 500464 - DNA, 619 bp, Homo sapiens
  misc_feature (11)..(11): n is a, c, g, or t
  misc_feature (166)..(166): n is a, c, g, or t
  misc_feature (177)..(178): n is a, c, g, or t
  misc_feature (192)..(192): n is a, c, g, or t
  misc_feature (205)..(205): n is a, c, g, or t
  misc_feature (212)..(212): n is a, c, g, or t
  misc_feature (233)..(233): n is a, c, g, or t
  misc_feature (240)..(240): n is a, c, g, or t
  misc_feature (294)..(294): n is a, c, g, or t
  misc_feature (296)..(296): n is a, c, g, or t
  misc_feature (302)..(303): n is a, c, g, or t
  misc_feature (309)..(309): n is a, c, g, or t
  misc_feature (311)..(311): n is a, c, g, or t
  misc_feature (333)..(333): n is a, c, g, or t
  misc_feature (351)..(351): n is a, c, g, or t
  misc_feature (358)..(358): n is a, c, g, or t
  misc_feature (366)..(366): n is a, c, g, or t
  misc_feature (368)..(368): n is a, c, g, or t
  misc_feature (370)..(370): n is a, c, g, or t
  misc_feature (372)..(372): n is a, c, g, or t
  misc_feature (374)..(374): n is a, c, g, or t
  misc_feature (377)..(377): n is a, c, g, or t
  misc_feature (380)..(380): n is a, c, g, or t
  misc_feature (384)..(384): n is a, c, g, or t
  misc_feature (387)..(387): n is a, c, g, or t
  misc_feature (392)..(392): n is a, c, g, or t
  misc_feature (406)..(406): n is a, c, g, or t
  misc_feature (415)..(415): n is a, c, g, or t
  misc_feature (418)..(419): n is a, c, g, or t
  misc_feature (421)..(421): n is a, c, g, or t
  misc_feature (426)..(426): n is a, c, g, or t
  misc_feature (430)..(430): n is a, c, g, or t
  misc_feature (432)..(432): n is a, c, g, or t
  misc_feature (437)..(439): n is a, c, g, or t
  misc_feature (444)..(445): n is a, c, g, or t
  misc_feature (451)..(451): n is a, c, g, or t
  misc_feature (500)..(501): n is a, c, g, or t
  misc_feature (504)..(505): n is a, c, g, or t
  misc_feature (508)..(508): n is a, c, g, or t
  misc_feature (513)..(513): n is a, c, g, or t
  misc_feature (519)..(520): n is a, c, g, or t
  misc_feature (530)..(531): n is a, c, g, or t
  misc_feature (618)..(618): n is a, c, g, or t
tattattatcngttttctacaacacgtagagttgtcaaatagcttaaagacaaggacaagtatagacccttctagaatcagataactcctagaagggtcttctagacaatctgtagtgaagttaagtaataccttcaagatttcacaactgtaaactcgatctggnattcaaaccanntctatatgtttctntaaatccaggctnttttttntgtatcaagaagcttttggantggaagngtgtttttcagcaggaattgtggtattggccaaccatcaccccatttaattaanantccctnncctcangncctacagcaatgtactgaggancttcagaccctcaattanccatttnccatcttnananantnttntcnatgnttnaagtnttcccttggaaatnttgaagggnttnnancttantctnanccatnnnaaatnnccaaanagtctcaagattcccactgtatcctgtgccttggagcaggcaaggagannatnncanccctngccccnntcacttcttnnctttggcagttccgggacaggacgctggtacaccggattatcccttcatcgtgtagccgcttccagacttctctctccagcttgaant

SEQ ID NO: 500465 - DNA, 175 bp, Homo sapiens
ctagcggatcccttccacggtagatttatacctaaacagacagatgacttcaaaaaagacttttgtgcctctctgtgtatgcttatatctgaattgacatttttttcctttaaagccaggcagtggttcatgccagtaatcccagcactttgggacgccaaggtgggcaaatcta

SEQ ID NO: 500466 - DNA, 279 bp, Homo sapiens
  misc_feature (171)..(171): n is a, c, g, or t
taccgtctgttagaagaggcctccaagaaaaaagataaaggacattcatcttcaaagaaatctgaagattctctacttagaaactctgatgaggaagaaagtgcttcagaatctgaacattggaagggtccactaccagagtcagatgaaaaatcacaggaagaagaattngatgagtattttcaggatttgtttctatgagacgagagagagaagccttcgctccttaatgtgaaacttcatgaagttctaaacttcatgcaatttgaaattccatat

SEQ ID NO: 500467 - DNA, 241 bp, Homo sapiens
  misc_feature (133)..(133): n is a, c, g, or t
accttcttctctaccagttctctgccttccacgccgaaagcttaggactctgtagagaagttgtgcttcagaatctgaacattggaagggtccactaccagagtcagatgaaaaatcacaggaagaagaattngatgagtattttcaggatttgtttctatgagacgagagagagaagccttcgctccttaatgtgaaacttcatgaagttctaaacttcatgcaatttgaaattccatat

SEQ ID NO: 500468 - DNA, 120 bp, Homo sapiens
ccaagatatgaggaattgagctaaaggacagtattccagttactgaactttcagacaagtggacctttatgaaagtcatgatctaacgttctggacaggtttctgtctatgtggtgaaca

SEQ ID NO: 500469 - DNA, 224 bp, Homo sapiens
aaacagcatgtgttttatctcacctggtcccctagaggtgatcgggcaagaccgcgcagtcgtcctggtattcacaccgtccgtccaaatcagtcgactgaagaacaccatcaaatctttgaaacaacagaagaagagcaagtggaacatcagctggaagaagtaacgtgatttcgtttcctcgcgacatgactgctgagtttggggggcactcagacatagag

SEQ ID NO: 500470 - DNA, 160 bp, Homo sapiens
catagccatacttgagctgtattggtgggcagcacctccgcagaatgcaatggtgtaagactatggatgttttttaaactttggcacattgatctatctaaacctggcggagagaattctccccacactgtctcatggagagactccaaacttgcagatg

SEQ ID NO: 500471 - DNA, 1613 bp, Homo sapiens
taaaaacagtctcactccggtcacccaggctggaggccagtgttcacgaatcacagctttacgtggtaaccctcaaacctcctataaacctcaagcagatccctccgggccctcagccttcccaagtatagctaggacttacaagcatgtgtgtgccacccacactggttttcattttatataaatttttgtgtggtagcaagtgggggctctcggcatagtgttgtgcccaggcgtggctccgtgaacatcctgtggccctcaaggagaggcccaataaatgtgaagtgaacaacgagcttaacagaatattaacatatacagtgcacacttataaaccgctggtgtgtgtgcaccctttgtgaagacattaatgtatacacccccatgtggatctcaaaacaatgagaaagtgcctattaaactctttatagcccaaaaacagtggacactaatattaacccccgtgtgtgtcctcaaaaagtgtgggctaacacacacacatattttgagagatatctcaacatgtgtgtgtgagatgcccacatgtggaaccgttttgggtatcttaaagggggagagaagatatccaagtgcgcaagagtgaggagatatgtgtgccgcacagtgtgccaccacaacttcccgataatataacatctgtgggaggagcgtagaggcgcaggccctcacaagagaggaatgtggggcgccccccaggagcaaggcactcccaacaagtgagtgcgcccagaaatatgctctagaacaacagcatgtgaacgacaatcgtactgacaacaaggaggcgtgcacaaatccggtgggacaaaaaaagccgcacaaacaagaagcattccgcggaggatatataaaataacggcaaaaataaaccatgttgttatatacaccaccaaaaacaggggagacaaaaaacaccccgtctggcggagcaaacagcacaaacacgaagaagagccacaattcccggaagaaacacacctgggttggtaataggtggcccccacaacgaatcacaacgagtagtaatatactggcagtggagacgaggaccccccggtatgtgggtggcacaacggcacacacactatcggaacaccacaagtgaggcaacacacacactttatcaattataggagggcgcagagaaaatcggcaccccagtaggtggcagcccattgcggagggtcacacaagcaattacatacaagaagacaacacacaaagggaaggacactctaccaataggggaagaactgcgaggagttacaacaagaaacaccagcgtagtagacaccaaacacatcctgtgtgcgctctacacacagcctccttagaaaaagcggaccacaaggaggaagggccgggcaccacaacgtaacttgctagaagagcgtcctgcaacacaacaaggcgccaacacagacgaggaagctaaccaccgaccacaagagccggagcggaaagataaaaagcaccaacaacagataagaaattgcgagagacagacatacaaaagtaacacaagccaccgacaaaaatgagtaaagaacagagaactcacgtccgcggccaacaacgacgtgcatgca

SEQ ID NO: 500472 - DNA, 1107 bp, Homo sapiens
  misc_feature (157)..(157): n is a, c, g, or t
  misc_feature (196)..(196): n is a, c, g, or t
  misc_feature (201)..(201): n is a, c, g, or t
  misc_feature (204)..(204): n is a, c, g, or t
  misc_feature (247)..(247): n is a, c, g, or t
  misc_feature (341)..(341): n is a, c, g, or t
  misc_feature (348)..(348): n is a, c, g, or t
  misc_feature (390)..(390): n is a, c, g, or t
  misc_feature (415)..(415): n is a, c, g, or t
ggtattcgggccatttcgcggatgaagtgcctctgatactgctctgccctagcgtagactcgtgaccttgacagaaggtcgtaggtacacgtgcgcgttgcctacgctttcattgctagcgacatagcatatcgctctattctacaagaagacgaanattagagatatgttgtgtcccacgcgcccctcattaacnaggcnacngcccaagcgacaccggcatgccttcaatatgggcttaagcatnaactcgtccctcatacgcacggtatcgcgatgagcgcaagtgcacctacctctgtcagagtagtggatatctccaaacacggaaccagacctgntgaaacntccgactgaaggtgcagcagcatcgacgtgcattcatgatgntccttgacaatgaatcctctggacntcaatcatctagatactccaccaaacacttccgtgtatgcaaccacgcatttggcaagactcggaaatatgccctgagaggttgttcgcgagaaaaaggatagcacagcagccataccatagcaggttccctacttcggataactataggacaaagctcacttctcaacctgtgcattggttgctacatggccagagggtaaaaagtagaaggctagttgtaacctggcctcccgatcataggcatacgtgtacgtcatgcggctcagtactcaagtatgaacggagtgtaggcgcctgaattaagaccttgcgcacgaactggtgcattggcccaaacttgcccattgggttctgggaaatcgagtgctagcgcgttacgtaaacccatccatgggggtgaaagaagacccagtgccctgggataaaggcttgatgaaccaacttccatctctgtggcgaaatggctactgtggcccatggaaatgatttttcccttgtgacacttggttgtgggcatgaagtctcccattagataggcttcaggcccggagtttatgtcccagccgaaggaacccgaagttccagaacactcccagtgtacacataatggcggaaggagagagaggggcacatccgctaaaggaagtgtactactacaacatacgcatggcaagtgcacacgcggcccgg

SEQ ID NO: 500473 - DNA, 281 bp, Homo sapiens
cgtgggactctacagaggtaaatcagggtatacactgaatagagaaccatatggtgcaaatcctacaggacgatcttttcgctgttcgaacagaataaagagtatcaggtacccttgtgacgataatgtacagtagttcccaaatcactgtcgactagcggtgagtgtaaaaaccttcttggtctctggctcacatatggtgggatgagcaaggagtatatgcacctcttcattccatgacttacctgagggttgcattgattagggcatcatgtggttcc

SEQ ID NO: 500474 - DNA, 488 bp, Homo sapiens
gtcggccgagtttcctgcccaactaaaaaaacattgagtacttttagcatatttcgaccaagcaacaagcttagggggggatttttattacaagcatgaggaacgccgtatggcctttcgcccatatataccctgggtatgtatacttgcaagtgttaaaggttgccatcggttgaaaccataagtgtctctggccatcaaagtgatcttgatcacagcagtgcttttgcgaaacaattatttattggctgaaagagctcttctgaactgcgtccttctaatttttgctcagaatagaatggaacaagtttaaattccacggaaatatgaaggcacttcctttttttttaagaaggaagttgctagacgactccttcatcacactcacttaaagcactgagaagagtatctgcaaataaaaggtgcccaaccttttaaaaaaagaaggaacataccctttgctgctccagagtaggcctatcttttta

SEQ ID NO: 500475 - DNA, 101 bp, Homo sapiens
tgagtcggtaccgttgtgccttcgcaaagggaatgtatatattacacatgaaaaatgaaaatggtaacagagtttcagaaagcgagcagcggttacagggc

SEQ ID NO: 500476 - DNA, 151 bp, Homo sapiens
caatgggaggtggagggacaggctcagcctcctcattgtttaaatgaggcctaaatgtgtgaagtgcgatttttgcttttgtgtaccccccccaccccattaccacaactgcctttgtgtgtttgtgtcaataaaaaaccaaaccctggga

SEQ ID NO: 500477 - DNA, 179 bp, Homo sapiens
gtatctagaggatcccttcgactagccgacagtacaaatgaagtcgacctgagggattttaaaaacaacaaacaaacaaacaaaaaacacaacacccaagcctccttctccagtccagaaggagagcgaaaggttcactgtccagtccactaagacagcacctgtcgggctagtcgggg

SEQ ID NO: 500478 - DNA, 252 bp, Homo sapiens
ccggacactgtcccctcgatcgttttagcgcgaattctgtcgagcgggacataactgcacactgtcaaagtgctccttatcatgtttacggcttcgatcccggtcccgtgtccgtactcgtagtcatagtacctgccattttgcaaaaatgtcccgtccatcattccgagctcgatttcatccgtaggacttgtgtgtccagtacgtgttccgccatgggtatcctctctagtctacctggcgtcgtgctca

SEQ ID NO: 500479 - DNA, 333 bp, Homo sapiens
atctgaggatccccctccagtaatgtgtgcccaccagaagtatgtccgacaagcctggcagaaggcacgacatcaagtacaaccatggagcagccacacggatgggtccaggaaggattgaaagccagagaaccgcgaaagccaagatgacagatgttgatcgtttaacagttatgaacgcgaagtaaattgaggaacagaataatcctgaatgaagtctacaagcttcaactcgcagctctcctgagagcttctcccaagtatcgcgggagccggtcgtggcggccgctacgagcccccgggcttgggctgccctgggcacacattatggag

SEQ ID NO: 500480 - DNA, 1349 bp, Homo sapiens
ggcacgcaagctgctattcctggggctctgatcacggctgtctatttatagcgctgggcgggagccgcctcacatacgacacgcacgagaggctgccctgctgcaatgtcacctgtcgtcactgcctctgcacgctgcaggcacctgcccactaccgcagcaggactgcaggggccttgcgccccaccagcgcacccccacggcccttgcgccgccactgctctcgcacccctcggcacaccacgtcgccccggccacactggcgccagccacccacggagccccccgtgcgcgcgcctcgccgctcccctgcaaccctcggcgccgccgacctgcacactccccctgctgccgcaccccgcccccgccgctgcccccgcacgcctgagcccctctcgcgctcgcacctacccctctcacgcccctgcgactggccccaccccgcggctgcgctccacgccccgccgcctcccaacgccccaccctcactgccccatggccccgcacactgcggccgcatctctgccctatccgccgcaccctcctgcagcctgcgatgcgcctgcgcacctgctgcaaccttcccaccacgccaactcccccaccgccctccacccctggcccgcgacactcctcccctgcgcgcgacccacacctcttccacagcggccctggccctttctccgcccccatcgccactcggccccaccacacatggcgctcacttgcccgctgcaactcgcgccctcgtcccacgtcccccctctcgctctcatcccctgcccctgcttacccctcccagccccccctgggccgcggcgcacggctgcttctccccccccccggcggcccccccggcccccgcggccctccttcgctcccgccccacgagcgcaccccttctctacacgcccttcgaccgcaacgccacaccgcactcccgtccctcccccgcgacccggcgggccgtccccctcccctatcccccctagccgccactccaccccgcccttggccccggacgccagttcggggccccccttgacgcccacgacgcgaagcccacgccgagagccccaccaggggcccacaccggacgcacagcacgcgaacgccaccaacctaaccttacgagaccacgacccggaacacggaccaccgacgcccggcacaccccctaccacgccgaacgtaccagcaccgaacccgacgcaccttaccccccgacgaccgcactgtgggaccgttcaacactctacaaccggacgaggacacggactacgagcctccacacactacgaacgcacacggccacgcactaacaccccggcgcccgacttaacagactg

SEQ ID NO: 500481 - DNA, 565 bp, Homo sapiens
tcccggggccgtctgcgggtaatgaccgcctggagccaagaccgagtgaaagaatgcataacatccggggagtgcgcctgccccccggcactacttcggggcatccgccggcaccggcgacctgtctgaccatcatgacatcatctccatgaagctgttccagctgatggtggagcacacgcctgacgaggagagcatcgactggtccaagatcgagcccagcgtcaacttcctcaagtcgcccaaagctcccccgtttcttctcccccagacaacgtggacgaccccacggggaccttccgcagcgggcccctgacggggtggcgggtgttcctgctgttgctgtgcgctctcctgggcatcgttgtccgcgccctcgtgggggccctcgtgttccaaaagcggcaggagcggcccaaggggttttaatgagtggagcctccgccggggcctgcccctgggcccaggagccggggtgaactttttttgtgttccgggattatgggagaggggcaccccgccgtgatttcttaaatggtttttattgtttattaaagtattttca

SEQ ID NO: 500482 - DNA, 682 bp, Homo sapiens
  misc_feature (44)..(44): n is a, c, g, or t
  misc_feature (64)..(64): n is a, c, g, or t
  misc_feature (66)..(66): n is a, c, g, or t
  misc_feature (69)..(69): n is a, c, g, or t
  misc_feature (73)..(73): n is a, c, g, or t
  misc_feature (76)..(76): n is a, c, g, or t
  misc_feature (78)..(78): n is a, c, g, or t
  misc_feature (83)..(83): n is a, c, g, or t
  misc_feature (89)..(89): n is a, c, g, or t
  misc_feature (115)..(116): n is a, c, g, or t
  misc_feature (126)..(127): n is a, c, g, or t
  misc_feature (132)..(132): n is a, c, g, or t
  misc_feature (143)..(143): n is a, c, g, or t
  misc_feature (149)..(150): n is a, c, g, or t
  misc_feature (154)..(154): n is a, c, g, or t
  misc_feature (170)..(170): n is a, c, g, or t
  misc_feature (188)..(188): n is a, c, g, or t
  misc_feature (350)..(350): n is a, c, g, or t
  misc_feature (423)..(423): n is a, c, g, or t
  misc_feature (470)..(470): n is a, c, g, or t
  misc_feature (506)..(506): n is a, c, g, or t
  misc_feature (513)..(513): n is a, c, g, or t
  misc_feature (538)..(538): n is a, c, g, or t
  misc_feature (605)..(605): n is a, c, g, or t
  misc_feature (675)..(675): n is a, c, g, or t
gccccaaagccaaaaaagccaaaaattatttagagaccaaagtnaattgatcaactcatgaatntngtnatangcnanaaatnaatatnaactattaaatacaatatagaaaagnncacagaatcnntgggncagaggggggngggggnngttncagtttgctgcattcnagtttgttatcttagggnaacaaactgaggagtcttgtggtccctctagacccctagatcacttcccagtgcatatgagtcttcccccataaggcaccttgtcgcaagcattaagatcggctccatgttcggccagacactccacgatgtcgtggtagcccctggcagaggctgtcaggnggggcgtctctccttctcggttcttgatgttcaagttaaagccggcttcacaaagggctttggccacagagtnatagccgtgccaagcagcacagtgcaggggggcttcttcttccttgncctggatattgggatttgagccgaagctgcacagtnactgagncacgtcagcatggccatagcgagcngccacgtggagggccatctctccagacttgtctttcacatccaaagggcatttgttctcactgaganattttcaaggtatcgacgtggccatgccgagcagcccagtagacggcattggacccgcccttatcctggncatcgat

SEQ ID NO: 500483 - DNA, 175 bp, Homo sapiens
tctttcgccaggctgtattgtgctgttggtttggagcagctgctgtgttgcacctgctgttgttgctgcttgcgttgccggagttaagggcaacgtggcagtgtgccgtgggctgggctgaattccctgctgagccaatgttgaaaccggagggttgggccgtgcttccaccagt

SEQ ID NO: 500484 - DNA, 453 bp, Homo sapiens
  misc_feature (6)..(6): n is a, c, g, or t
  misc_feature (216)..(216): n is a, c, g, or t
  misc_feature (262)..(262): n is a, c, g, or t
  misc_feature (269)..(270): n is a, c, g, or t
  misc_feature (321)..(321): n is a, c, g, or t
  misc_feature (326)..(326): n is a, c, g, or t
  misc_feature (328)..(328): n is a, c, g, or t
  misc_feature (342)..(342): n is a, c, g, or t
  misc_feature (427)..(427): n is a, c, g, or t
  misc_feature (443)..(443): n is a, c, g, or t
ccaaancccagggaagtaagatgtaaattgaagaagcctcacacgtaaaagaaatgtattaaggtaggtaggagctgcagttcaagaggaagacacttgctgagtgaaggaaatgaatctttgactgaagccgtgccagaagccaggggaggcccatcccccaccagccagcggtttcctggagagggtccctcagccccacccaccatcccaagngctttctctccaaggcctatccaggaagccagttagtaaacttccnaatttcnngagtcaaaaaacatgagcgcaactcttggaagggacaattaagacagaccnacaancnagaaaggtctaagnaatggttaagttttcaggaatcagcaactttttgaccctcaatctttagagaggctaaaattcttcgcagaaagaagaagaaagnaaggaacaaaaatctnaaaacttgaa

SEQ ID NO: 500485 - DNA, 162 bp, Homo sapiens
  misc_feature (2)..(2): n is a, c, g, or t
  misc_feature (122)..(122): n is a, c, g, or t
  misc_feature (124)..(124): n is a, c, g, or t
anttcggcacaggtggggattgaaaagcacctccacccctaccctagtgatgtcccctgaggacccgggtgatagtacagtcaatattgtcagtactttgctctgattgaagggtgtagaancnagttaccaaaatttctatttcaaaggaaaccaaacctt

SEQ ID NO: 500486 - DNA, 207 bp, Homo sapiens
catgaccattgcttacgatagaagagatcaaacttgtgagtaagttactgtgtgagttcgcttgctttttttgatttttttatgagacacaatcttactctgtcacccaggctggagcgcggtggcaccatctgggcccaccgtagcctctgcctcctgggttaaagtaattctcctgcctcagcctcccaagtatctgggattaca

SEQ ID NO: 500487 - DNA, 1057 bp, Homo sapiens
tcaaacacacttttattttcttttttccctttcccttcacattacagaacttcctccacataccacatttctggcagctataaagctcactgtgagtgtgtggccgggtcaaccattttactccctaaaacctcgtgtgtgacatctcaaaatatgacagtgtgttattatccataaaaattatttcactaaagcccagcggctattattaagcctttagaaccctgtgtgcaattaacaccactataaaagagaaggcacaagaacccccatccctacagtgttgtggaatcgagggtgttctcaacgcggctcccatactcgtggcgaacgtgtgtacacgtggtgtctacaaggggccagacagaagagcaaaagaggcagatatacttctcagagaggacacgtgaaccccatattgactcgtgggacagcccacgtatatagtgtatgtgtgtaaaccccaaaagtgtctctagtgtttacccaaacaaccacactttatctctcacagagggggttggttcctctcaatatataatctctatagaagatgtgtgtagagagtcgtcccaagactgtgttttcttcaccgaacaaaaaagtggacaaagagaaacagtgaacacaacacacccaacaagaacaattttatcaccataccgtggggtgggggaacggatatatatccccataaccttccaatttacctatatgtgtgacacgcggtgttgctgtggtgggaaaatttttggagagaaacattttacacctattgcggtgttcacccacaaaaaaaaaacaatacgttgtggtacgttccaacggagagataatctcacaacttcatcccgagtggagaaaccatttttattactactacagaggcgatttgtgggaggccagcttgagaaattaccccaatgattagaacaactttcttttgggcagcaaaatctttccacaaaacgcgtgtgtagcatcaaccaatcgttctttatattacacccccctatgagtgttggttcttgtgtggttatagaagcggaagagagca

SEQ ID NO: 500488 - DNA, 155 bp, Homo sapiens
agaaacccataatatataagagaataaaaacatagatatactatttgtatatctgacttcttgttagctctatggctatgtgtcatgatcagtggtcccatgaggacacagtggcactagtgggcaaagtttctcctctgcctgcgaacctttta

SEQ ID NO: 500489 - DNA, 969 bp, Homo sapiens
gcctagcagcccacctgctgccgccggctatgttaccatcacaccccgggaggagccgcagctgccgcagccggtcccagtcaccatcaccgcaaccatgagcagctgaggccgagacccagcatgctgatgtgtccacaccacggtgtgacgcacgaccctcatccgtagctatcatcatatccgctagtgcctcggcgacagacggcatctgagagataaactatgtatacactgctgcgctcagctatctctccactaactctcgactctgcacgaccggagtcaatcggactgtcctttcacggctgagacgtcaccgcaacgatgattacgtggcacactacaagaacactgcacatccccgtcggttcacagacactgctcatagacttactaacgcgaccgattgacgacctagcagacgcctactcaaccagtactcctggtccacacgcgccgcacacgacttccggcatatcaacgccagcaacagtggctacagaccttcacaatcaacaccaaccaccaacaccggcaaccattctaacatttatcacgagatagctcagaaactcaagcgtgagcacgcgactctgaccgccaacttccacagactctctcgacacacataccggtaccaacaacagtggagtagaacacttagtgccgaagcctccaagagctttactaacgaccgtgcgccgcgcagccagcgcattagtcaagacttctttccgcacattgacaccacaaggcgcatccacatacacgaccctccgtcaacgagacttagagcccgacagccgcgcttcgtccaaacgcacattcaatgcagaagaagacctactctagacgaggctctaacacagctactcaactcgcaaccccgcttcccgagacaatatacgttacaacgacttactgataccggagatcgactagcatcaacaatctacaagtctacct

SEQ ID NO: 500490 - DNA, 912 bp, Homo sapiens
actctcgttctcgtgttttctgttgttttgttttgtttctttgttggtgaaagagacagaggggaggacgtagcgattagtgggccaggggagggaggaagggggagggagcagagggggaggcagtttacgacggtgccatgcccccctctctggggcccccctgtttcgtcccgtgtgtatggcccacgcgagagtgtccttgaaaggcttaatatcgcggtgtcataatggtgcttccccccggtgacgcagtcgtgtagcacatgttggccagactggcctcttttgagacctgtctccgcacccctccggggtattatgttggacgctcgccccctcgcgcctagtatccgtcggtgttcaacgcgcactcgggggggttcacccaaggggccgcgccatgcagtgttgggtacaggtttgctcctctttgccccttggggtctatttccgggacttcattcttcttcttgtattccgccagataaatctgtacgccccgatacaatggaaaagaccatttcaaacggttcctttgtcacgtacaacaaagccgttggcgcccccccacgcaagtgtatctagacaccatggtacaaagtagtagtttccccaatttttcccacaaaggatagtccacacgctagctggagcccgcttatcccccgataggggcttgggggatacgcagtggtggcgctccaccgtggctttgtgcccacgccgcgaatgaccccctcgctcttcaataataatgacaggaaggtatacaccactgtgtcaattttcattgtgaatatgcggagaatgagtctcccctagggggcgagacacagcgctaatcacatctttcatgtatctgaaaataagagggacccacacctgtctcatcaatagatacaagaaaat

SEQ ID NO: 500491 - DNA, 340 bp, Homo sapiens
  misc_feature (224)..(224): n is a, c, g, or t
  misc_feature (244)..(244): n is a, c, g, or t
  misc_feature (296)..(296): n is a, c, g, or t
  misc_feature (331)..(331): n is a, c, g, or t
  misc_feature (338)..(338): n is a, c, g, or t
ctcagcctcctgagaacctgggattgcagcctcccgagaacctgggattgcaggcacctgctgccatgcccagcgaagattttgtatttttagtggagacggggtttcaccatgttggccaggcgggtctcaaactcctgacctcgtgatccacccgccttggccccccaaagtgctgggattacaggggtgagacaccacgctcggcctttatatatattttnagagagggggtctcattttnttgcccaggctggtcttgaactcctgggctcaagcaatcttcccgcctcagnctctcaaagtgctggggattacaggcaatgagccnaccgtgncc

SEQ ID NO: 500492 - DNA, 160 bp, Homo sapiens
gaagaaaggcgaagaaattgaacctcgcgcaatagatatagaacccaagggagagactgaaaatttataacccagcataatatagcaagggctaacccccataccctctgcataatgaattaaccagagataactgtgcaaggagagccaaagctaatga

SEQ ID NO: 500493 - DNA, 241 bp, Homo sapiens
caaaaactcctatgggcaagtagctaacgcagtagtagagtcttcaataaatccaagaatatacacctactgacaatttgaatacagatagcccccgactatccctaattaatcattacggcggtcctaagaaaccaacaaaatagaaccgcacgtcctaatatcaattattccatgctaatgtaataccgagcaaaggcctgctttgaacactctaatattttacaaagtaaaagtcctg

SEQ ID NO: 500494 - DNA, 262 bp, Homo sapiens
gtgtcatgcaaataactccagcagttatgacattaaaacatcaatatcaggtcggacgtggtggctcatgcctgtaatcccagcacttggggaggccaaggtgggcagatcacttgaggtcaggagttcgagaccagccaggccaacatgatgaaaccccatcttgactaaaaatacaaaaattagccgggaatggtggtgtgcacctgtagtcccagctacttgggaggctgagtcaagagaactgcttgaacccgagggg

SEQ ID NO: 500495 - DNA, 196 bp, Homo sapiens
ccgagatggcgccactgcactccagcctgggtgacagagcgaggttctgtctcaaaaaaaaaaaaaaaaaaagaaagaacccaaggtgttgacggtagatggggagtatttaagggtttcccctctctttatctgaattggtcaacaattttcttaaacaaacacgttattcctggtgtcactcagacacaggtag

SEQ ID NO: 500496 - DNA, 318 bp, Homo sapiens
atgcaataacctcccccccgtgggaggcggtgcggttacacacgatgccgcgacgcgtcgaggcgtctcgtagtcaatttttggagcacaaccagcaaccatcagagcgccaccaacaattgccgtgaaagaatttagaggcgcaatcgccttcatatctgtgccttctggctagcctttgtagaatatatattaaagtatatggaaggttgagcgctcctgcaatcgcatgtccctcatggacgtgcgcaaagatcgttggcatcaacattagaaaggcgcgattggaggccggtatcttcaggaggttattggcat

SEQ ID NO: 500497 - DNA, 296 bp, Homo sapiens
taccacttgcaccttacgtcacagcatctttttccaaaacaattctaaagttctcaccatccgatgtgtcatacccaagtattggtggtttttggatctgtcctccatctacttcgttgagactttacccattaatttccagagtatattcataagcaaaaacagtgatagcgtctatatttatggtgcgctttagtcttagcagctccaacatagaaagtatctttgcccacgtaatatgaacatccacgtcttttcttatctcttcctttccatctacatatacaactcgttag

SEQ ID NO: 500498 - DNA, 196 bp, Homo sapiens
tattctctgttgagctctacttgtggtcattcccgacctacctcccctccaggctggtctcaaaatcctctgacctcgggtgatccgcccacctcggcctcccagggtgctggggttacaggtgtgagccaccatgcctggccaagatggtgtttatgttaagctattgtgcaaaaaaaaacttttgtaaagaaaa

SEQ ID NO: 500499 - DNA, 584 bp, Homo sapiens
  misc_feature (10)..(10): n is a, c, g, or t
  misc_feature (432)..(432): n is a, c, g, or t
  misc_feature (448)..(448): n is a, c, g, or t
  misc_feature (465)..(465): n is a, c, g, or t
  misc_feature (471)..(471): n is a, c, g, or t
  misc_feature (477)..(477): n is a, c, g, or t
  misc_feature (491)..(491): n is a, c, g, or t
  misc_feature (505)..(505): n is a, c, g, or t
  misc_feature (514)..(514): n is a, c, g, or t
  misc_feature (550)..(550): n is a, c, g, or t
cgcatgctgntggtcccagctacttgggggactgaggcacgagaatcgcttgaacctgggaggcggaggtttcagtgggctgagatcgcgccactgcactcggacctgggcaacagagtgagactctgtctcaaagaaaaaaaaaaaaaaaaggcaatgaccaacatggagaaaccccgtctctactaaaaatacaaaattagctgggcgtggttgtacatgcctgtaatcccagctactcgggagactgaggcaggaaaatcgcttgaacccaggaggcggaggttgtggtgagccaagattgtgccattgcactccagcctgggcaataagagtgaactccgtctcaaaaaaaaaaaaagcaaaaatatcactacttgaaggccaggattccagtatctgctttaatcagttcttttgcctgccccaaanttacattatgacacantgggacacctgggctgncggganttttantaaaggatgatcgnccctcttatgaganttagtttanagataagcttatttaaacgtaaaggtatgtttttanctaatttatgtaattcaccccaaaaaccacaatt

SEQ ID NO: 500500 - DNA, 463 bp, Homo sapiens
  misc_feature (69)..(69): n is a, c, g, or t
  misc_feature (73)..(73): n is a, c, g, or t
  misc_feature (82)..(82): n is a, c, g, or t
  misc_feature (87)..(87): n is a, c, g, or t
  misc_feature (95)..(95): n is a, c, g, or t
  misc_feature (150)..(150): n is a, c, g, or t
  misc_feature (159)..(160): n is a, c, g, or t
  misc_feature (162)..(163): n is a, c, g, or t
  misc_feature (171)..(171): n is a, c, g, or t
  misc_feature (182)..(182): n is a, c, g, or t
  misc_feature (190)..(190): n is a, c, g, or t
  misc_feature (195)..(195): n is a, c, g, or t
  misc_feature (199)..(199): n is a, c, g, or t
  misc_feature (215)..(215): n is a, c, g, or t
  misc_feature (265)..(265): n is a, c, g, or t
  misc_feature (274)..(274): n is a, c, g, or t
  misc_feature (320)..(320): n is a, c, g, or t
  misc_feature (322)..(322): n is a, c, g, or t
  misc_feature (343)..(343): n is a, c, g, or t
  misc_feature (346)..(346): n is a, c, g, or t
  misc_feature (451)..(451): n is a, c, g, or t
cagtaattcagacatatctcaaatgttacattgatgtcatcaatattacaaaaaaggaaaaaaaaagtnagangcaacactnaagancaccaganacccagcgcacacctaaagtagaccatgcttctttccttccactgccaggttatngtcccgggnngnnccccaccncctcgctttcntcctccgntttcnctangcagtctcgtgggggnatctaggctttgttgtcgctctcctccttctcgaactccccttgttcgtnggcggtggngtcctggtactgttggtactcggacaccaggtcgttcatgttgctntnggcctcggtgaactccatctngtncatgctctcgctcgtgtaccagtgcaggaaggccttgcgccggaacatgggcgtgaactgctcggagatgcgcttgaacagctcctggatggccgtgctgttgcngatgaaggtggc

SEQ ID NO: 500501 - DNA, 181 bp, Homo sapiens
gtgctgcggtcgactctagacggactccccgcaatggtcctgtcggttacggcagtccacgtatctggtacatagaccattggccttatatgggcaaatgtaagtggtttctatgaaacaaacatatttagttcactattatatagtggggttatattaaaaccaaaaaaaaaaaggggtc

SEQ ID NO: 500502 - DNA, 146 bp, Homo sapiens
aaaaatccctgaagtcttttcgaatgtgcaatgtatgacctgtgctcttgaaatacacttttcaggaaatcagcacaatatctaatttcccctacccttttcgtgcctaccctctctgtcactaaaattcaaatgagctattattg

SEQ ID NO: 500503 - DNA, 1100 bp, Homo sapiens
ggtggtctcctgtagtcccagctactcggggggctgaggtgggaggatcgcttgaggccaggagttcaaggttacggtaaagctataatcatgccactgaactccagcctggacaacaaacccagaccccatctctgcaaaaaattaaaaaaaaaaaaaataggcattgatggtggtcctcctgagtagctggaactacaggtgcccaccaccatgccttggctgattttggtgtttttagtacgagacggggtctcactatgttggccaggctggtctcaaactcctgacctcaggtgatctgcctgcctcggcctcccaaagtgctgggattacaggcctgagccaccacgcccagcctaattttggtatttatgggtagacacagggtttcaccatgttggccagttggatcttccaatttcctgacctcaagtgatcttgcccaccttggcctctcaaagtgctgggattacaggcgtgagccaccaatgcacagactcttttatgaatatataatactatatatactattatggggaaaacaattgtggagtttctaacaacctctgtgatacatctcacaggcgtgggaacgtgtcgaaagggcgacagtgaaactcttcacaggtacaaccatctgtggacacacacctacagcgagcagcttctccaggggtcacaacagggttgataacacccgcggggacaaaaagccacccaccataaaaagaccagccaggggagcaacacacaccagaggagggtggaccaccaccgagtgaacacaacaccaacgaccacaaataaaacggaggaacatattggccgagcaacacaaacgcgggggggctacccacgaacaactagtggggcgaaagagacagtgaaagagcaaaggcggggagcaacatgccgctgaggacgcccccaggagaagtgtgtggggggaaccaagcgcgcgggaacaacacagtgagaaaacacgcccacaaaaatgcagtgggcggacaactcgacagagaaaaaaatgtcaaacacgagggacatgtggaggcgagcaagcggcgggtgtgcaacccaacagcgagacacaccaa

SEQ ID NO: 500504 - DNA, 769 bp, Homo sapiens
ctagtagaggcccgtgtatggaggccgggacggagatgggtgtagtgcgtgaccaggcctgagctccctgtctctcctcagtgacatcgtctttaaaccctgcgtggcaatccctgacgcaccgccgttgatgcccaggatagacaggtcgatcctgcgaagctccaactacttccttaagatcatccaactattggatgattatccgaaatgtttcattgtgggagcagactaatgtgggctccaagctagatgctaagcatatccgcatgttcccttcgatgggaaggctgtggtgctgatgggcaaggaacaccatgaatgcgcgaaggccatccgagggcacctggaaaacattaccctagctctgggagcaaactgtctgcctcataatccggggcgtaatgtcgggctttgtgttcaccaaggacggacctcactgagatctagggacatgttgctggccatataatggtgccagctgtctgcaccgtgtctgtgctgcctattgcccctactgttgaagttcgacgtgtgctcagcctccagatacactggtctcgtggcccgataagacctcctttttccaggctttcaggtatcaccgatctagaatctccaggggccaccattgcacaagtcctgagtgtatgtgcagcttatcacgcctggagactaagtgggagcaacgaagccacgctgtgacatgtcacattcccccttctccttgggcgtcatccgcaggtcgcctgggcgttaaacttaggtg

SEQ ID NO: 500505 - DNA, 183 bp, Homo sapiens
  misc_feature (21)..(21): n is a, c, g, or t
  misc_feature (163)..(163): n is a, c, g, or t
aaccctgacgtcatgacgcantcagaaagtgcagagatgagtcttcctcctcagaagcatttggtagaattccatagagcatgtctgtgagtgactgatcccacatgtatgttactaagccccaaacgaacttcaaactggtgtggtgcacgtgcctttattnccagctacccgggaggctgc

SEQ ID NO: 500506 - DNA, 276 bp, Homo sapiens
cctttttttttttgggccaaagtgagggggttccacccagggggaaacaacccaatcctttttttccttgttccaatgggggaaaaaaaacccaggacccaaggtttttggcagggggtttgtaaatttccaggggtcccacccccccccccgggcccggccccaacttgggtagtttttcctgcatggggaaccggaatttttggtttgggggttggattttcccctccccccccccctgtcccttttgggaaaaaaaaaaatttttaaggccca

SEQ ID NO: 500507 - DNA, 175 bp, Homo sapiens
  misc_feature (107)..(107): n is a, c, g, or t
  misc_feature (175)..(175): n is a, c, g, or t
ccttctgagcctgttcataccatccgtactgtttcccatattggccaggctggtcttgaacttctgacctcaggtgatccgcctgcctcagcttcccaaagtattgngattacaggtgtgagccactctgtacctgaccagataatctttaaaaatctcctcaaatctaccgtgn

SEQ ID NO: 500508 - DNA, 144 bp, Homo sapiens
tacaggatctcttttcagaagacataacacttagctgaattttgacatgctgggcacgggaatgagatttgaaaacattgcgtgtgtcaggttgtaagtcttgagcaggtccttgagaaaagccctccaccagtgctccatctt

SEQ ID NO: 500509 - DNA, 371 bp, Homo sapiens
cgtgcagattagcatctgggccactgccgaattcatgtcctggatgtgtgagggattgcatcatgcacacgtggaagcacgacgaagggcaaagagatgacatcgaatgcaagatgacgcccacaaagaatccagaagatctcagatggtagaggacagaggtctacgtcgactgctgttagttgctcaggtatccatcctgtgttccctaatctccggatttctgatccaagagtctttgagagctatgtcctaggccatccttgcatctagaaatggaaaccatgggtgtggcaccaggcatggtcaaccctgcagtgattcagctgcacaaaggggtagtccagagcttagatagctgtctgatgtgg

SEQ ID NO: 500510 - DNA, 436 bp, Homo sapiens
agtcagctcggtaccttccaggttgattgcaggcatagtaagaagctggctaaaaccaccaaaagcaagatggcgacaagaggacaagagtgacctctggttgttctctctgctacactcccaccagtgccatgccatggcagcttacaaatgccatggcaatgtcaggaagttaccctatatggtctaaaaagaggaggctgctgggtgcggtggctcacgcccgtaatcccagcaccttgggaggctgaggagggcggctcatgaggtcaggagatcgaaaccatcctggccaacgtggtgaaaccctgtctctactaaaaatacaaaaaattagccgggcgccgtggcaggtgactgtaattccagctactcaggaggctgaggcaggagaatggcatgaaccaggaagcggagcctgcaatcaagcctggaa

SEQ ID NO: 500511 - DNA, 682 bp, Homo sapiens
ctatggaggaaagagatccatctcacagcttggccacctgaacaccctggggacagctgaccaggcgtctgggctagtagtctaatctggcagggtggtgtcttgtgaatgggaaggactgttaaatccagctgccagacacccctggacgggagaaggagagacggttggaccaccatgcagcggttcctgcagtgtcctgatgcttctagctgcacgatacgtggtacgtgctgagtggccacccatcaggccccgttgagagccctcaccagatgaggagaaacgtttgagtggtggagctgcacaattctcataacgggcccagtgtatccccgacggcctcagacatagctgcacatgaagatgggacgagagacgcgtggtcagcattcgtccaaaggcgctacggcacggccgtgcggtgtggggcgcacaacaaggagcgcgggcgccgtgcgcgcagaatctgttcgccatcacagacgagggcatggacgtgccgcttggcctatggatgagaagtggtctaccaacgagcgtgagcactacaacactcagcgccgccaactgcaagcccaggccagatgtgcggcactacacgcaggtggtatgggccaagacagagaggatcggctgtggttcccacttctgtgagaagctccagggtgtgaggagaaca

SEQ ID NO: 500512 - DNA, 167 bp, Homo sapiens
  misc_feature (124)..(124): n is a, c, g, or t
actcctactgtgaggtaacttgacggacgtactgctaatgactttagcgtacgctgggtagtggtttacctccaccctcaacacggccgtgctaatgactggactaaagactgtgacgacgacntgacggacgaccggactaaccgctctagatgacggtgacacga

SEQ ID NO: 500513 - DNA, 580 bp, Homo sapiens
ggtgagcaaaaggatgttgtgagccagaccgagtccctcagagctgccgttcatcaacttacctgcaggccgatgcagtgcgggaggaatcatcaacgttggccaaccctggctccaatgcaggtcggttgtcctgtgtccttccattcacatgtagcacccacaggtggggcatgatccaggtaggtgggcctactcatgtggtgcccactagatctgggccccagaggtgggcaagacggggcatgtttggacagaagtcagttagagcacatggcggcggggcgccatcacccatgctgaacgacgaacccaggggaaccgctagagaacagaaggtgtaagcactggagttatcaaagataagggcccacagggggttccctgtatataagtgaaaacgtgaacaacctgttaggttctgtaacagttagaacattagttcgttgtgggacattttgtctttggtttggggggacttgattttgggcttgaggttctttagacatttgtgggactcgtttgaagggattctctccaaaattgggaaggttggaagtttgttgaggggggttgaacg

SEQ ID NO: 500514 - DNA, 106 bp, Homo sapiens
aaatgcacacaagattggccaaacacacgttttcaagtagtgggtttccttcagagcatgccagtagtggataagtttccctagaaagtcgaaggagattacgaat

SEQ ID NO: 500515 - DNA, 691 bp, Homo sapiens
  misc_feature (309)..(309): n is a, c, g, or t
gctcttccgccagtacctgcgtatccgcacatgtccagcccaaggcctgactatggagctgctgtggctttctttgaggacgacagcccgccagctgggcctgggctgtcacgaaagtagaggtggcacctggctatgtggtagaccgtgttgacactggccaggctacctaactccatacagcgtcatccatcacatctttggcttcaatcttctctcgacaagcggtagtgataggttgcgcatgtgcgttgcacatggtagaaccatatggaaagtcgactgcatcacccgtgttgcatgagtccnttcacacggcatatcttgagtggtctacgatctatgccacgggtgcccaggacttgaagtgcggtcagcattccagtacctggaagtctgtgacggcaggctgaacgtgtggacgggccatccggtttccccaggaaccatccacatgaccttgtgtgcctgatgaggacggtcgggggtcaccaagggcatggagctgttcgtgcagcggcctgagttccacgccctgagggcaggctttgccctggcatgagggcatagccaatcccactgatgccttcactgtcttttatagtgagcggagtccctggtgggtgcgggttaccagcactgggaggccaggccatgcctcacgcttcatggaggacacagcagcagagaa

SEQ ID NO: 500516 - DNA, 229 bp, Homo sapiens
gacaacctaattacgcaaggttagaccatgtaaaagaagaaaaccttctttgaatattctatagatattaattaagtcacaataaaatcttatcaacattgtagttggattttttttacggtgaaataacaagaaggtcaatgaagactggtttcttagcatgtttgaagtagtgacaaaagtctcaaacataataaatattaatatttagcactgactggcagccaac

SEQ ID NO: 500517 - DNA, 324 bp, Homo sapiens
  misc_feature (27)..(27): n is a, c, g, or t
  misc_feature (32)..(32): n is a, c, g, or t
  misc_feature (156)..(156): n is a, c, g, or t
  misc_feature (163)..(163): n is a, c, g, or t
  misc_feature (222)..(222): n is a, c, g, or t
  misc_feature (241)..(241): n is a, c, g, or t
  misc_feature (279)..(279): n is a, c, g, or t
  misc_feature (319)..(319): n is a, c, g, or t
tgctggaaaactgaccttgcatcttgnaaagnaaaagactccaggatgaccttctcccagaccacccagaccccaagatggtgatgctgctgctgctgctttccgcactggtctggacctcttcggatgacggacaaagggacaagacatttcatncttgggnaagtgaccccaatcctccggtgcaggagaattttgacgtgaataagtatctcgggaagnatggtacgaaattgagaangatcccaacaacctttgagaatggacgctgcatccagnccaactacttcactaattggaaaacgggaaagattcaaantgtta

SEQ ID NO: 500518 - DNA, 835 bp, Homo sapiens
tggttatgagctcacgagaagcacgtggactcctagatttcgcatatagatggactaacgatcgagtgtaacttgcccgattctcatcctctatacccttattagtatcccagaccgctactcgtttcaccttttagtcccaccgtggcgaagagggtgagataagcctcgggtgatacgcatctggagggccaagaaggctcgattcatttgctcgtaggcgagttcatgtatccgattcctgctatgacccgcacgaacggtgacatgacacaggcagcgagattgtagaacggccggcgtaggactatgtcattcaggtgagcacagtaactgtcgtgatcatcaagaataggcatagatggtcatttatcagcttagtcaccacttatactctcctcggaatattctcgcaccccccggtatgcgcgtgcatacgcggaagaacctgagtttaagggagcatttgtctacccgctgtggagtgattacataagattttcccctgtcaaatgtgagcccatcacgtgacatgtgctgatggggccgatctatttgtcaagacagttgcacaacgtttgcatcggtccgcaccgggaggtcagtgtgtcctcctcgtcgacattgagattcgatgatcccaatacgtagatggtattcctacttgtgtaccgtggggaaactacgtgatttcaggaatagtgccttgagctcggttttgtgtcagcatctctgctatctataaccaccatatggagcaggtccaatgaaggaagcatggggttacccggaatcgtagtccaatggagtcgtcggtggttatcttgatcacagg

SEQ ID NO: 500519 - DNA, 308 bp, Homo sapiens
tttatcaacatctttttcccccctttccccggggggccccagtacaatgtttcaggagccccctttgccccggttttccgcaaccccggaagccctacctctttttctttgggaaagggttaaggtacacccccgctgtgcccccctctttcccccaaacccccgcccgtgtttttgtgggtaccccgtccccgaaccccccttttgggttgggcccccttttaacccccgggtaactgtccagtcctggtggggacctccggtttttctttttaaaatgccaaataaatgtttttttttaccatgga

SEQ ID NO: 500520 - DNA, 849 bp, Homo sapiens
tgcagtggctcacgcctgtaatcctagcacttcacgaggctgaggtgggcggatcacttgaggtcaagagcctggccaatgtggtggaaccccgtctctactaaaaatacaaaaaattagctgggcatggtggcagtcgcctgtaatcccagctactctggaggctgaggcagaagaattgctcaaacccaggaagcggaggttgcagtgagccgagatcataacactgcgctccagtctgggtgacagagcgagactccatttcaaaaaaaataataattgtaaaataaattaaaaataaataaatgaataaaattaatgtgattcaacataaaaattactaaaaggctttttttttttttttttggcttcgtggaacaaaccaccttgatttctgaagcactcttttgacacaaaagggtgagattcacctggggcccctgtaaacaaaaccgagaaggagaacttcgggctctcccgaccaggcgggactttcaggagccggatttcaaaattccagaaaatggggacccttataccaactgacgatttctccttccttcttgaccaactgttcgcctttccactctactccggtggcgttcccacatcctcgtcctctcacacgcttcgggggcacccctgggggacgcccctcttaggaacaagcgatcccgcgggtctccggcttctcccatccggtccgcgtggaggaaaacgcaccccgcatcttttctgcacacaagcgaagcccggagtcttcgtctccctctgcggttttccccttaaagtccttgggggggcgacaccgcctcctgctaacggcggggcgcatctccctgggtcgac

SEQ ID NO: 500521 - DNA, 176 bp, Homo sapiens
cgagtcaggttcaaggactggattataccataaactcacagttaggatgcaggaaaacaaacctgggggtgggaaagtgtgggtttaaaagccttttaatagttgacattttactaaatgcatttcagcagttattacaaagagaggagaacgacagagagaaagagaacgaaagg

SEQ ID NO: 500522 - DNA, 206 bp, Homo sapiens
cttttttgccccccccccctggggccccaaaaaaaggttttttttttagaaagggtttttggtggcggggggccccctttaaaagggggaaacctttttaagtttttcttaaaggggtttttcccccggggggccccctgggtttttttaaaaatggggtttttttttttttaaccccggtttttaaaaagttttcccgttgggga

SEQ ID NO: 500523 - DNA, 349 bp, Homo sapiens
ccacgggcctcaaaagctctccaaatatccatttgcagattctagaaaaagagtgtttccaaactcctcaatcaaaggatagtttcaattctgtgagatgaaagcacacatcacaacgaagtttcttagaaagcttctgtgtagtttttatgtgaagatacttcacattgcatcacagtactcaatgggctcagaaatatccccttgcagatcctacaaaaggactgtttcaaaactgctcaatccaaagaaagtttcaactatgtgagatgaatgcgcacgtcacgaagacgttcctcagaatgcttctgtcttctttacatgtgaagaagattcctatttcaccata

SEQ ID NO: 500524 - DNA, 175 bp, Homo sapiens
atcacgagtagacaggatggtcttgatctcctgacctcgtgatcgccgcctcggcctcccaaagtgctaggattacaggcatgagccatggcgcccggccgcttctcggtcttgaggtgcttttttttgagacagagtcacccaggctggagtgcagtggtgtgatctcagctca

SEQ ID NO: 500525 - DNA, 635 bp, Homo sapiens
  misc_feature (187)..(188): n is a, c, g, or t
  misc_feature (497)..(497): n is a, c, g, or t
aggggaagctatcacaggacgtagcgcggggcactttgtttccttgcccctccgaagctcactgttgcaaatacccccaagcctttgctctaggccagatcttgtttggtgcaggtgatggagaacacagatgactcgggcatgggtcttggagatcttctgttcaaattttagggcggaggctganncacagagcgcccacgttagagaggggctctgatagagagctaggaggcccgttcttgatcattgatccattgcagtccaaacttgctggcctgaccacaaggtagtgtctatgaactcacaggcagcctagactcatccacatgtagacttttgtcccgcaatgaaggctgaggagcggcgcctcaatcatgacaccgatagccctccccccctacatcccatttttggttatagggctagtttccaaatatggctaacctcgaaagcaaaggggacaaagaacataaaccaaaccctagccacaaaantttcaaagaaagctccacattctgaaacccgggacttcttctaaactgggaaagtgcaagaaactctctcctgtagcccgcggtaaccccgccaaaaaccttgaaacatttataaagttaaacgcggccaaaaagcct

SEQ ID NO: 500526 - DNA, 241 bp, Homo sapiens
aaaattccaggggccccccccgggcccctttttttttatttgggggtcttttttaaaaaaaaacccgggggggggggatcccttggaaaacccggggtgaggggaaaggggggatgccccacttttggggttttgggtcccggtcccgggggttatgggggatttcccccccccccccccccttttttttttttttttaaaaaaaaccaaaatgggaaaaaaccccaggggcccgggccca

SEQ ID NO: 500527 - DNA, 353 bp, Homo sapiens
accccccccctaaacccgggggggcccttaattttaaaaaaccggtttttagtttccccccgggggaaaaagaataaaaaattgttgggaattttaaaaacccgcccccgggaaaatgggcaaaaattttgttttaacaaaggggcccattttttttggcccccgggttttaaaaaaaaaaaaaaaaactttgtttttgccgggggggaaattgggggggggccaaaaaagcaaaacagcaaattgggttttcccttttggtgttttttttccccgccaaaattaaaaagggaggccttatggaaaagggcccattaaaaatttttggtgggttttttaattaaaaacttgga

SEQ ID NO: 500528 - DNA, 102 bp, Homo sapiens
tccgagaggtagatgattgagtacagagttgaaattctatgtcattacgcagcaaacccgtccttaagtcagttaggattgaagtgccctggtggaaaagta

SEQ ID NO: 500529 - DNA, 1449 bp, Homo sapiens
  misc_feature (951)..(951): n is a, c, g, or t
  misc_feature (1070)..(1070): n is a, c, g, or t
caatagcaatattggggaaaaagagtcgggggacaagacacccgagagcaacgttgggtgtgtagggcggaccggaccgggcggggtggtcgcccgcacccagaatggttggaaccagcaccaccgggtgtgggagaggaccccgaagggcctctcccccgtgtggttttctccacacagcggggatcacaacgataagttgtatgggccggccgaacaggagaagaatggggcaacgaacagggtgccagcgaaatttgctcggggaagggtgaagaatttggaataaaccacccgacgagacgcggcttttcgcccagagagaacttttgtctgggattaaagcccccggaatgtgggcccacagacccgggtcgaaaatttagttgtgctggaggattccccggcgtttgagaaagaccttggggtgggggcagataaaggaagtccccctacccccccgggggctgttaccctttggaggacaattttgtgcgaaagagggtttatatttttaaaagccgctcggaggaataaaatttcttgttgggcgttatattatatttcgtggtggcgccacaaaaagccgtggtaaagcccggtcacagatgttgtaagccttttgtcctgggagattttttcacaagaggtagaacacccgctgtgaaggcgtgtaacacgtggggaagtccctcccacttttagccggccccaatgtctgtgttggataaagaaatggtcacgcacatataaagggagttttcccccctctctgtgagagaccacatttcccaccgtgcccctcttgtgtgcccaccacaaaaagagatgggtcttttcttgcgccaagagacgtgggagatccccccgcgcgtgggaccacaataagggatttttaagacttgtgtcgaaaaatggtttcacgggagacttctacaagacgagggcttnttctgcagaagagaagtcccgccacgaatggcgtgaaaaattttctttctaaaggagggatatcatcccctatgtgtactcttgtggtgaagatggggtgcacttccacgaggactatngagttgttaacatgtctgactacacaccccactgagagaagaccgcccttttttctcacgaggggagtgaataaagcgaccccaattgtaaaaagagtgttacgcaccgcgagaggagtttgtcttgcttttataagaattagcaccactttgtgctctgataacgaacgagattccctctgaaaagggggaaaatgacagagcaacccagtatattctgaaaaggtttattattccacccaaaatgcttttaaattgttataatgtttctgttataaaaaaggaccacctttgtaaaaattaccgcttaaagataatttttttaaaagaagaaatgatttaatgaattttgctttttaaaaaataaattgggggatta

SEQ ID NO: 500530 - DNA, 257 bp, Homo sapiens
aacgccagcggcagaaagagctgcagagcaaataccgacggccgcggggctctccaggcggagagggcacagggcacctggacgaatttgacttatgagaccaacactacacttgaccctgcacggaatccacactctgcctggactgactagactgcttagcagctgaccaccctggaacctgtgagggccaaacagcatagcgaagctgagctgtggacctctcggtcaaatctgcgtctgcgagggccctgtgc

SEQ ID NO: 500531 - DNA, 271 bp, Homo sapiens
  misc_feature (13)..(14): n is a, c, g, or t
  misc_feature (198)..(198): n is a, c, g, or t
  misc_feature (208)..(208): n is a, c, g, or t
  misc_feature (232)..(232): n is a, c, g, or t
  misc_feature (250)..(250): n is a, c, g, or t
cgtttccttaagnnatattctccagcaagccgggcccgagagctgccaacgaggcctcggttgaatacctgcaagaggtggcccggatccgcctctgcctcgacagactgcagatttcctctcggagcctgagggaggccagagatggccaaggagaagcagtgctacctgcagcaagtcaagcagttctgtatccgngtggagaacnactggcaccgggtgtacctgggtnggaactcatcagccagcnggggattggagttcgttcatg

SEQ ID NO: 500532 - DNA, 937 bp, Homo sapiens
  misc_feature (494)..(494): n is a, c, g, or t
gagagcttcatctacccttccatgtgctggatccgggactctctggtcagatacatcaccaacctgggcctcttcagcctggtgtttctgttcaacatggccatgctagccaccatggtggtgcagatcctgcggctgcgcccccacacccaaaagtggtcacatgtgctgacactgctgggcctcagcctggtccttggcctgccctgggccttgatcttcttctcctttgcttctggcaccttccagcttgtcgtcctctaccttttcagcatcatcacctccttccaaggcttcctcatcttcatctggtactggtccatgcggctgcaggcccggggtggcccctcccctctgaagagcaactcagaacagcgccagggtctcccatacagctcgggcagcacctcgtccagcgcgcatctaggctctcacagcccatcgtgcccatgtgatgaagcagagatgcggcctcgtcgcacactgcctgtggnccccgagccagggccagcccaggccagtcagccgcagactttggaaagcccaacgaccatggagagatgggccgttgccatggtggacggactcccgggctgggctttgaatgggctggggactactcggctctcactcagctccacgggactcagaagtgcgccgccatgctgcctagggtactgtccccacatctgtgcccacccagctggaaggcctggtctctcccttataacccctggccagcctcatgctggggggcaggcctggatcttgaggtctgggccaccctaatcctgtgccctgcctgggaacagaaagggcccatggcctgctctcgaggaccccgaggccccggcacccgggcttaaccccgtggaccagggaagggccgcgacactagcaaaccgggagagcctgccaacacacagccactggcgcc

SEQ ID NO: 500533 - DNA, 756 bp, Homo sapiens
cggcttgtgtattgagtctgtggccgacttcgtgttcctggtctctgcagcagccgtgatctgcttacgtgtgagtgtcttatgggtatgtttgtgccatggtgatgcctgaatatcaaacatcttcagctggcagctcccaccaggacttatctcagaaaattgcttgatctgcctggtgcctggagctaggcaacgggtgtgtgactaacgaaattcatgcaagcatggagagctgttgtggaaattgtgtgaaagttgtactgtggatgaggatgtacgtacattgttcagatgttggtatgtggctgaaatcaatgacaatttaatgggatgctttagatcagtgcattaatggcgctgcaagaggagttgcgttcatggcgcagccgtgtgttagctgcatgtcatcctcgatgcttcccttatgccctggcatggataatgaatagataaagaggccgggcgccaagtctcatgccaatgcttgttggcaaatatgcgtatcgtgatagcatggtgcagatcatattagtcaccatggacctacagtgctttctcaagattcaggggctctttttgatatacccagtagacaagtttgtatgcatgagccggcgtgtcctaaagtggataagggagaatatctctgcaatggaggaaactggcactatatgtctcacctgaatgctggtggagcttaaatattgacctccattgcatacacggctgaattgtggctttgcttgattcaca

SEQ ID NO: 500534 - DNA, 473 bp, Homo sapiens
  misc_feature (41)..(41): n is a, c, g, or t
  misc_feature (309)..(309): n is a, c, g, or t
  misc_feature (374)..(374): n is a, c, g, or t
  misc_feature (388)..(388): n is a, c, g, or t
  misc_feature (430)..(430): n is a, c, g, or t
  misc_feature (469)..(469): n is a, c, g, or t
ggaagcaggcgggcaacaccctcagagtccctgtgtatgancaccagagaaaaatgatccttggaggtaggagggagccaaagattgtgagaggacgagtggcctctgcaacggatcattgaatactatggtcctgccacttgggcagaggatggttcatggggttatcgcactcccatatatatgccaaatagagcgattagactacaagctgttctagagataatcactaaccaaactgcctcagccctagaaatgctcgcgcaacaacaaaaccaaatgcgcgcggcaatttatcaaaacaggctnggccctagacttacttatttaggcaggaagagggttgcgggctgtgggtaagttttaacatcttnccaatttgcttgtntttaaccttagggcatttattgggagaaggaggttttttggnaattcggttttcaaaaccttcaggaaaagttaggccccntgtt

SEQ ID NO: 500535 - DNA, 155 bp, Homo sapiens
gctatgggacggcgcggactggagcttccgcgcggtggcttcactctcctgtaaaacgctagagcggcgagcttgttacctgcgtctctgacctgagcagcgacaggggaaagcggcgagactgactgcaccgctacaccatccagtcgccagct

SEQ ID NO: 500536 - DNA, 854 bp, Homo sapiens
ctgggtgtgctcctgtgctcctgcgtgtgcgtgacagagtgctggctggctggctgtgcatgaagctgtgctgtgcgtgctggctgtgctggctgtggagccgagtgaggaggttcctggacgctgcttaggaacctggggactcagtgagtgccctgcgccctgagctgctcagctccagagtgcgtcatggcttgagtacgtggaccctcctgcaaagacctgaccaacaacaatcacccttgaatgatctagaacatgctcaagtctggcctgcaatggaatgacatccccagcgaacaagagtgacggagatcactactggcatgttgcctggtttagcttccttggagagccacaacaagctggacaaagacaacctctcctacattgagcacatctttgagatctccctgccgtcctgacctactcactactggtggttgactacagaacccgttgtgctgaagatctctgagtgaggatgatgctggacacgcaagctaacccgtatccccagtgccaatgaatgtacaaagacattatccggcagccctctgaggacgagatcatcaaatttggctcccccaccgaagaactgcctgagcaaggggcgaggacgaggcaggcaggttggaccttcatcagaccactcacttcccccatcctccaggagcacggggccacgggcacgccaccatctaccacttactaacctggttcctaacccccttactgtgctgcgtgtgtgtgcgtgtgccgcacgcttctgtgctgttcgctctatattgtctacacccactctagttcctcttcttaagggccatggggggtcaggcgcttaggggatgtgg

SEQ ID NO: 500537 - DNA, 235 bp, Homo sapiens
acccggtgaagtagattcctctctggacattatacatcactgttaatgcttctctcatcaacctttcaactatctttatctctttaattactgcagacgagctgataccgaggtgactacagccgatttgccccctactgaagcgacgcgagacccctgcaaatgggacagccccccagctcatgaggcctggctattgcaatatttactagtagaggaactctatagcaagatg

SEQ ID NO: 500538 - DNA, 275 bp, Homo sapiens
  misc_feature (11)..(11): n is a, c, g, or t
cccccccctancccccggggggggggggggtttttttttaaaaaaaaccccctaagggtccccctttttttttttggggccccccgggggggtttttttcccccttttttttcccgccccccccttttaaaaggggggcccccttattttttcccccccttttttttttttggggggggggggggtccccccccccccttttttttttgggggggggggggggccccctttgggtttcccccaaaaaaaatttctggggtttttcccccccccca

SEQ ID NO: 500539 - DNA, 303 bp, Homo sapiens
ttgcgcagcaaacttaatggctcatctaaacgagctagaatctaactccggtctgttatgttcacaccgataatcatgtaaattagatgataatgtcgtcttatacaatcagcaatcccccctctaccaaggctgtgccacaattctctaaaccagtggttaacaaacagacctaatcatctgcatcacccatgaagttccttagggtgcagatttccaggaccttcccgccacctacctaagtcagtatatctgagtttaggtttgggcgtctgtaattttatttgattgtttaacctctgg

SEQ ID NO: 500540 - DNA, 124 bp, Homo sapiens
acctgggaagaaggcctgaaaaaccagcttagaggagacacccattctcttagaggtgcctggggtatctgaggcagaagtggtagcagcagactccttatgaggccaccggggattctttaga

SEQ ID NO: 500541 - DNA, 318 bp, Homo sapiens
ggggggttttttttcccccccgggccttaaaaaatggtttttaagggggggtttaattattttttcccccccccccggggggggcttgcccccctgggggaattttcccaggcccccctttttgcccttttttaaatttacaagccccccccccccccccctttggggggggggggttttccccagttttccctttaggggttttttggccccctttttcaaacccccccccaggttttcgtggcggggggtccgggccccccttggggtcccccctagggttttttttcccaaaaaaaaaagttttttttgggggga

SEQ ID NO: 500542 - DNA, 400 bp, Homo sapiens
  misc_feature (165)..(165): n is a, c, g, or t
cccaggcagtggctgggaagtgagggagagaagcgaagagctgcgggtggtggtggcgagccctgaataccacgacaccgcagcgtggacctctgcagcggggataccatccacaccccagagccgccacggcataccccccttccggctcgtggggtctccctngaatttcctcctcagctgtggccccctggggttccttggcttctcgtcgttctcttcccttccaattccattcatcttgaacactctctggagatctattgatgctatccctgacaaccaaaagtttaagcagttgcagagggagctctctcaagtgctgagcccaggggcagatctacatccagcctgataactaagccgatccaggtaccctgcctgagagccgcgagaccct

SEQ ID NO: 500543 - DNA, 126 bp, Homo sapiens
ttagtgatagctcacagcctggggatcatctacagagatctgacagctgagaacatactacctggatagaagaggggcacattaagatcacagatattcggcctagagtaagcgcaggccatatga

SEQ ID NO: 500544 - DNA, 220 bp, Homo sapiens
ggccctttttttaaaaataaaaatgggggttatttttattttttttttgtaaagtgatttttggtcttctgttgacattcggggggatcctgttttgccctgggtacaatgtgagatcggggggttttcctaatgttttcccgtggcttggggattgtacacgggaccagctcccgtaatgcattgcctgtaacaatgtaataaaaagcctcttttttta

SEQ ID NO: 500545 - DNA, 984 bp, Homo sapiens
gcccggcactccccgccaggtcttgctgccggggtcttggctgacggggaggccagtcctggtgagggaggctcaggtctgcgcctctccctcaagaagaccccggactccccgacaggccaggtgcggtggatgggccaaaggccagacccacatccttgcccgtcgattgtacctagctatcccctatcggaggtaagggctatcgcggtcgtggaccagacttgcagatggagacagacccccgagacacgagccccgggcccccggcttctgtctggacatgcaatcgagcctagattaatctagcatttacagaagaaaagcaaagaacaacgagagcaagaaacggttctcaaaaccaagaggcagaggacgagcaaatgcgaagagacagtgacacagaaacaagggaagcaagacagacagccacgcagaacgcaacactcagaccagcacggggacagacagatgcaccacgaacagagaagacagagaaccactccaaatcgaagacggccccaccatgaaaacacaggacggagacaacaaacccggaagagagaacacaggacagtacccgagcgagagaaaaacaggcaagcaaaggcggcggagagggaacaagcgaataaacagacgcaagccggaaccgcgcgatgcacaagacgcgcgaaccacacgggaggagggcaaccgagagcccacacgaccccccgtcagaaagagacagagcaaccaggcaacagccgaacaacacaacacaccaaacaagaaacaaaacaacaacggaaaaaaacccacacacgacaacaacccgaagtgcaacagcacgccacgaaagcgcgcaaacagcgaaatcgacaaaacgatcagacgtacaaaaaccagcagcgaacacacagcgagcaccaccagccagagcaccaggcccgagaacatggcaaaaaccaggcccgggccagacaccggacacctacgcgg

SEQ ID NO: 500546 - DNA, 906 bp, Homo sapiens
  misc_feature (267)..(267): n is a, c, g, or t
gatccgctcgcacttccaggacgtgttccgtagtggtgcggggcacacacaccctgcacgccacacgatccgacccgtacagggtggctcgtgagccgcagccaggacacccctgccttcgggccagctctgcctgctggcggaggccccgttcgcaggcaagcgcactgacttccgggagccttccatgccgtggtcgcaaagcgctgaaatggttgcagccaggcggtgcgggcacgcgcgcgcagtgtcccacggccatggtcncacgactgccaccccgcctagcaggtcaccatgtacagtcatcatggcccaacagaccgaaggtgcaccacgtacgatcgtcctggcactcggagcttcgacagactatcgaggcatgtcctcccatggtgtgggaggcgcacgggcggcaccctcggggccccacggcgccgagctgcaagggcagcgggctcactggtgtggggagtgcgcgcggtgcccggggcgcgggtcgccgccggggctcaggcgagcggcccgaaggcatcgaggtgccctgcctgctgggcatctcggcgaggctctggtgctggtggcgccggcgacggcgcgtgtgttccaattgcgcctgtcgcgacgtgctggcgctggatccttctccgagcagcagctggacctgtaccacggcgcggggaggcgatcacgctgcgcttcgacgggtcccccgggcaaagccgtgggcgaggtggtggcgcgcctgcagttggtgagccgtggtgcgagacccggaagttgggtgccccgaggaaggtcaggacggctgggttcgaggtggaccgcgagggattcgacgcacgtgggagggttccaattcggcgaaagggggctttggggccgggggacccacctggggtgtgg

SEQ ID NO: 500547 - DNA, 217 bp, Homo sapiens
taattattcgacgtaacaatggtggagttggtaggtgtgcccaggtcaagatagtggggctaggctgcagctgcacagctggcagacaatggggtacgcactagggtgacagcatggactgtggaaacgaggaggacagatatagcgtcatggcgaagacaacgaagcacaggaccatgcctaacagcactggaagaaggagctgacgcttccctca

SEQ ID NO: 500548 - DNA, 1189 bp, Homo sapiens
gacgcggacgtggtcgcaggcggcaacgtaacttgatcgtagcccgtggaagtggtgtgcgcactaagtcacgagtcgttgtattgcttgcttgcacgacacgtgttgtttgtgccgccccccctccttactctctgtgggtgagtgtttttttcctcccctgcttcctgctcgtcgtaccactcttgttgtggtgcgcagaggatctccgtttggactactctagtcggctctatagtggctctacaattgttgttgctccgggatagtatatcttcgtcctgttgggaccctctgcctcggacggccttctactcctgtggaggccgcgcttccaagcgttgtcccggaattccttttctcaggatccggggtggggacgtttccacccgattttctgtgaccctgtctactgggcacagattgttccggctctaggcttctgctgagaaatgtccactttcttaagggccccttgagattgggcccacgaggccgcttccgagcccgtgggcccacgtgggcctttaaccacaatgtcgccgtgtcgtgggtccgcggctggcgagtacatggatgctcgtcacagcccagcggccctcagtgtactcccctctgacgcacgttgccccccccatatttgtcacacacacacacacacgcacactactcacactccgatttgacgttatccaactcccgcccttgcccctgatggctcccttggggtttgcctgcccccccccctgggcccccgagtatggcaccccggacacagcccaccggtggaagtcactttctgaatatggagttggccattggaagcttattctttttgttcacctggagagagagagaactggttaccggtaatctgtgtctattatctgagttttttttattggtcttgtggtctttttaccccccctttcccctccctcccttgaaggctatcccctctgggaaggctggtgccccactgcccccttatcacggctcacaccccacgtctgatcacggctgagttttgtaatgtatctattctgttataatgcttgtttacttttaactaatcacgatctttttaccacgtatccactttattattgtaattgctttttatgagaaagaattttattagtacatgtttatatatgccacccatttaaatgtataaattagtgtaaga

SEQ ID NO: 500549 - DNA, 2703 bp, Homo sapiens
  misc_feature (2288)..(2288): n is a, c, g, or t
  misc_feature (2295)..(2295): n is a, c, g, or t
  misc_feature (2308)..(2308): n is a, c, g, or t
aagcggcacgaggctcgggttgtgccaccgctggactcccgtgtccctccgcgcaggcgggcggccccggagcgctggtgccggcagaggcggcgacggtggcgcccctcctcatcatgaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaaggagctgcgacaattcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcacgctcccaacacaaggtgggcagggaggcaccattcaggaacctggaccaaagctgacgaggctgggccaagccagggatggggccacagccagaaccccgagccctacttccaggttctggttagctcagccccagcccagcccagctgctctgcccagagctgggtgagtggggagacacctcagagccccgcaaaacccactgaccggaggcaaaaggcagtggggctgggggtagttttccatggtcacagagaactagtggtggctctgagaaggggaggacctctgggctttgattccatctccttgtcttttttctttgtttttagagacagggtcctgctatttcccaagctggagtgcagtggtgcgatcatggctcactgcagcctcgaactcctgggctcaagcaatcctcctgagtgatcccatttcttaatcagtgtagccccaagaaggctggggctatttaccagggtagaaaaaggagcttacctcccacctttggtcctaagtccctgccccctccccttcacaccataactaggtaacagtttgataactagggaagaaagcagaacagttaagcagccgccacatccccgctggctgggggcctcactccaggaaggggctggactggctgtcctttccagtggcctggctccgctgtgtggatggggagatcggggccagagcaaaagggggaaaanaaccccnccccctttggggnggttgaaggagcagaaccctggtgaggaagctccagtcctgctctctacccagcccatcttgcctccatggtgcctctggaggcctctgggcctcctctaacaggggctggtgggcaccaagagccaatggagtagacccctggctggtaagggccaagtcccaccggttgcttctgggaaggggtttctaacactagtctgtgtgctgtggttcctggggtgccctccactgccctctgttcagtaacagggccttgctaatcgggttgtcactcaacaaaagtgctttggatttaagttactatcctggctttgcccaacctcagcaacctgtaagactgataatgaaataaatcatgttaatcctaaaaaaaaaaaaaaaaaaaaaaaaaaa

SEQ ID NO: 500550 - DNA, 518 bp, Homo sapiens
  misc_feature (1)..(1): n is a, c, g, or t
nccggatcttatggcgctggaaaagggggcagaggtagtgtagcctcagaagaagaggcaggcccaggtacagagccatccactccctcggggcggagagtggcctaaccagccagtgctgagcagacatgagtagctacaggaggggccaggtgggttgatctctaagctgcaaaaacttgtgctgtccttgtgaggtccctgcctgtgactggtggcctggttgccttcctgtgcccagaaaggaagggggtattggctcctcccaagacacgttccctttactccactccgtacctgtggattctcccatcaggcaatctggttctcctcttaaggccagatgaagatgttccctataaaagattaccaagtaaggtaagtgatgtgaaatgctcctgtccctggccctaactcctttcctagacccagccctggatcaggcaggtgttggatcactaccccaatactttaccacgtaggtttagtttaccctatttccctttaccagaggcttg

SEQ ID NO: 500551 - DNA, 449 bp, Homo sapiens
gtatactaccctcccagactaaatcaggaagaaatagagactctgaacagaccaataacaaccactgagattaaaacagtaatttaaaagttggccaaaaaaaggtccagaaccaaatggaatcaaagccgaactccatcaggtagttcaagaaaaattggtacaatcctactgaaactataccaaaagatagagaaagggaatcctttttaagtcattcaatgaagccattatcaccctagtatcaaaaccaggaaagggcacaacaaaaaaagaaaactatagaccaatgtccccgaagaacacagatgcaaaaatcctcaacaaaaaactagctaaccaaatccaccagcacatcaaaaagataatatatcattgtcaagtgcgtttcataccagagatgcagagatggcgtaatatatccaagtcaacaaatgtgatacctccta

SEQ ID NO: 500552 - DNA, 3034 bp, Homo sapiens
  misc_feature (221)..(221): n is a, c, g, or t
aagcggcacgaggctcgggttgtgccaccgctggactcccgtgtccctccgcgcaggcgggcggccccggagcgctggtgccggcagaggcggcgacggtggcgcccctcctcatcatgccgtggcagctgtggcttggcccagacacagagacccccacctccaaagaggacgtccttagtaggtgccaagcattattagagtgaggccagtcccagaancggaggctcctggcgcgccccgcatgcctccagcacgtttacctttccgaagtggcaggaatggggaaagcgcacgcttaggagagcttcagacaagcttccctcttcctcctccacgaccagaagcggaaaggtgctcccggaccgaaagggaaagaaggtccagcactgccccgcttgggaaggcacccacaaccagtctagggactaggggtaaggccggcggggagcccgcgaatgacctgggctgacatctcttcccctccttacacagaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaaggagctgcgacaattcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcacgctcccaacacaaggtgggcagggaggcaccattcaggaacctggaccaaagctgacgaggctgggccaagccagggatggggccacagccagaaccccgagccctacttccaggttctggttagctcagccccagcccagcccagctgctctgcccagagctgggtgagtggggagacacctcagagccccgcaaaacccactgaccggaggcaaaaggcagtggggctgggggtagttttccatggtcacagagaactagtggtggctctgagaaggggaggacctctgggctttgattccatctccttgtcttttttctttgtttttagagacagggtcctgctatttcccaagctggagtgcagtggtgcgatcatggctcactgcagcctcgaactcctgggctcaagcaatcctcctgagtgatcccatttcttaatcagtgtagccccaagaaggctggggctatttaccagggtagaaaaaggagcttacctcccacctttggtcctaagtccctgccccctccccttcacaccataactaggtaacagtttgataactagggaagaaagcagaacagttaagcagccgccacatccccgctggctgggggcctcactccaggaaggggctggactggctgtcctttccagtggcctggctccgctgtgtggatggggagatcggggccagaggcagaaccctggtgaggaagctccagtcctgctctctacccagcccatcttgcctccatggtgcctctggaggcctctgggcctcctctaacaggggctggtgggcaccaagagccaatggagtagacccctggctggtaagggccaagtcccaccggttgcttctgggaaggggtttctaacactagtctgtgtgctgtggttcctggggtgccctccactgccctctgttcagtaacagggccttgctaatcgggttgtcactcaacaaaagtgctttggatttaagttactatcctggctttgcccaacctcagcaacctgtaagactgataatgaaataaatcatgttaatcctaaaaaaaaaaaaaaaaaaaaaaaaaaa

SEQ ID NO: 500553 - DNA, 309 bp, Homo sapiens
cacgacggtcactcgacgtataatatgtgttaggacatgagactagagactggccgatcatataacagatacataaaacaaaaataaaaataaaaagcagagagtacctatggagagagtagaagtcctgctatcctaggtgcacagtgctctatgtaccctaaaagaggaaagaaagatacacaccacgagaatagtagtaggaagcaacagtagcaagtagtagcaaagcaggaaccctacaagcctagtactacctagggcatccatacgcaagtatagctatgtactaagtactagtacctctac

SEQ ID NO: 500554 - DNA, 338 bp, Homo sapiens
gcctctacccggcccccgggggcctgggattgtttccgcccctgggcctaaaaaactgttctttatgggtggttttgatgattgtacacctcagcccgggggtgccctccccccctggggaattttgccaaggcccccttttatgccatttttaagacctaaaggtacctgcccccccccctttggaaggggggtgttttcccccagtttccccttcaggggttccctgccccccttgtcaagaccccccccagagtttccgtgcaggggattcaggccccccctgtgggtcccccatagggtttttttcccaaaaaaataaagtgaatttggggtga

SEQ ID NO: 500555 - DNA, 2920 bp, Homo sapiens
  misc_feature (221)..(221): n is a, c, g, or t
aagcggcacgaggctcgggttgtgccaccgctggactcccgtgtccctccgcgcaggcgggcggccccggagcgctggtgccggcagaggcggcgacggtggcgcccctcctcatcatgccgtggcagctgtggcttggcccagacacagagacccccacctccaaagaggacgtccttagtaggtgccaagcattattagagtgaggccagtcccagaancggaggctcctggcgcgccccgcatgcctccagcacgtttacctttccgaagtggcaggaatggggaaagcgcacgcttaggagagcttcagacaagcttccctcttcctcctccacgaccagaagcggaaaggtgctcccggaccgaaagggaaagaagaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaaggagctgcgacaattcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcacgctcccaacacaaggtgggcagggaggcaccattcaggaacctggaccaaagctgacgaggctgggccaagccagggatggggccacagccagaaccccgagccctacttccaggttctggttagctcagccccagcccagcccagctgctctgcccagagctgggtgagtggggagacacctcagagccccgcaaaacccactgaccggaggcaaaaggcagtggggctgggggtagttttccatggtcacagagaactagtggtggctctgagaaggggaggacctctgggctttgattccatctccttgtcttttttctttgtttttagagacagggtcctgctatttcccaagctggagtgcagtggtgcgatcatggctcactgcagcctcgaactcctgggctcaagcaatcctcctgagtgatcccatttcttaatcagtgtagccccaagaaggctggggctatttaccagggtagaaaaaggagcttacctcccacctttggtcctaagtccctgccccctccccttcacaccataactaggtaacagtttgataactagggaagaaagcagaacagttaagcagccgccacatccccgctggctgggggcctcactccaggaaggggctggactggctgtcctttccagtggcctggctccgctgtgtggatggggagatcggggccagaggcagaaccctggtgaggaagctccagtcctgctctctacccagcccatcttgcctccatggtgcctctggaggcctctgggcctcctctaacaggggctggtgggcaccaagagccaatggagtagacccctggctggtaagggccaagtcccaccggttgcttctgggaaggggtttctaacactagtctgtgtgctgtggttcctggggtgccctccactgccctctgttcagtaacagggccttgctaatcgggttgtcactcaacaaaagtgctttggatttaagttactatcctggctttgcccaacctcagcaacctgtaagactgataatgaaataaatcatgttaatcctaaaaaaaaaaaaaaaaaaaaaaaaaaa

SEQ ID NO: 500556 - DNA, 168 bp, Homo sapiens
atagataaaaaaagagaaaattaaatctcatgtatgcacagaaggaaataaagagtagaaatcaaagaaaataaaagtagctaaaaatatagtagtagataacaatcaatgaaacctaaagctggttccttgtgaattttgatattatgataaatctccagccagaca

SEQ ID NO: 500557 - DNA, 505 bp, Homo sapiens
  misc_feature (220)..(220): n is a, c, g, or t
  misc_feature (245)..(245): n is a, c, g, or t
  misc_feature (272)..(272): n is a, c, g, or t
  misc_feature (337)..(337): n is a, c, g, or t
  misc_feature (359)..(359): n is a, c, g, or t
  misc_feature (375)..(376): n is a, c, g, or t
  misc_feature (391)..(391): n is a, c, g, or t
  misc_feature (395)..(395): n is a, c, g, or t
  misc_feature (422)..(422): n is a, c, g, or t
  misc_feature (443)..(443): n is a, c, g, or t
  misc_feature (459)..(459): n is a, c, g, or t
  misc_feature (475)..(475): n is a, c, g, or t
attttttttctactgccgtgttgtctagtccatgctggtgaactcatcaatgcaattttctttaaaactctgtgggccctatatcagattagtccaacccattagaacaaaagcaacttctataaatattgagacattccctttctacctttggctaagaattggggtgctatagataattcccaaaagattatctagcctacagggccgatgaggtcanagctctgaagtcattctaaagtctntcacaaaggatcttacagcctttgatntttatttactcactcctgggacccactgtttttactgttgggcacggttccggccttttctcatnctttttccctgaagatccattntatgatgtggaaattnnctctttgcctggcangttnattgggggtgtggggttaccccgatancttcgtaaatttctcggtaantctattggggtcaatnaggctggttcttcccntggtggtggaatattttggttttcccgcct

SEQ ID NO: 500558 - DNA, 2612 bp, Homo sapiens
gtcggggcccttttggaggaagtttcttgcaaacgaggacccggggctccggggtcgacttccagttttcttgaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaaggagctgcgacaattcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcacgctcccaacacaaggtgggcagggaggcaccattcaggaacctggaccaaagctgacgaggctgggccaagccagggatggggccacagccagaaccccgagccctacttccaggttctggttagctcagccccagcccagcccagctgctctgcccagagctgggtgagtggggagacacctcagagccccgcaaaacccactgaccggaggcaaaaggcagtggggctgggggtagttttccatggtcacagagaactagtggtggctctgagaaggggaggacctctgggctttgattccatctccttgtcttttttctttgtttttagagacagggtcctgctatttcccaagctggagtgcagtggtgcgatcatggctcactgcagcctcgaactcctgggctcaagcaatcctcctgagtgatcccatttcttaatcagtgtagccccaagaaggctggggctatttaccagggtagaaaaaggagcttacctcccacctttggtcctaagtccctgccccctccccttcacaccataactaggtaacagtttgataactagggaagaaagcagaacagttaagcagccgccacatccccgctggctgggggcctcactccaggaaggggctggactggctgtcctttccagtggcctggctccgctgtgtggatggggagatcggggccagaggcagaaccctggtgaggaagctccagtcctgctctctacccagcccatcttgcctccatggtgcctctggaggcctctgggcctcctctaacaggggctggtgggcaccaagagccaatggagtagacccctggctggtaagggccaagtcccaccggttgcttctgggaaggggtttctaacactagtctgtgtgctgtggttcctggggtgccctccactgccctctgttcagtaacagggccttgctaatcgggttgtcactcaacaaaagtgctttggatttaagttactatcctggctttgcccaacctcagcaacctgtaagactgataatgaaataaatcatgttaatcctaaaaaaaaaaaaaaaaaaaaaaaaaaa

SEQ ID NO: 500559 - DNA, 2496 bp, Homo sapiens
aagcggcacgaggctcgggttgtgccaccgctggactcccgtgtccctccgcgcaggcgggcggccccggagcgctggtgccggcagaggcggcgacggtggcgcccctcctcatcatgaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaaggagctgcgacaattcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcacgctcccaacacaaggtgggcagggaggcaccattcaggaacctggaccaaagctgacgaggctgggccaagccagggatggggccacagccagaaccccgagccctacttccaggttctggttagctcagccccagcccagcccagctgctctgcccagagctgggtgagtggggagacacctcagagccccgcaaaacccactgaccggaggcaaaaggcagtggggctgggggtagttttccatggtcacagagaactagtggtggctctgagaaggggaggacctctgggctttgattccatctccttgtcttttttctttgtttttagagacagggtcctgctatttcccaagctggagtgcagtggtgcgatcatggctcactgcagcctcgaactcctgggctcaagcaatcctcctgagtgatcccatttcttaatcagtgtagccccaagaaggctggggctatttaccagggtagaaaaaggagcttacctcccacctttggtcctaagtccctgccccctccccttcacaccataactaggtaacagtttgataactagggaagaaagcagaacagttaagcagccgccacatccccgctggctgggggcctcactccaggaaggggctggactggctgtcctttccagtggcctggctccgctgtgtggatggggagatcggggccagaggcagaaccctggtgaggaagctccagtcctgctctctacccagcccatcttgcctccactgccctctgttcagtaacagggccttgctaatcgggttgtcactcaacaaaagtgctttggatttaagttactatcctggctttgcccaacctcagcaacctgtaagactgataatgaaataaatcatgttaatcctaaaaaaaaaaaaaaaaaaaaaaaaaaa

SEQ ID NO: 500560 - DNA, 106 bp, Homo sapiens
agcaaccccaggcagactgagtgaggagcgccagcttgctccttagaaaccttgccctccctgggagtgatggtaatctcttcttgaatggatttatggtcctttg

SEQ ID NO: 500561 - DNA, 2318 bp, Homo sapiens
aagcggcacgaggctcgggttgtgccaccgctggactcccgtgtccctccgcgcaggcgggcggccccggagcgctggtgccggcagaggcggcgacggtggcgcccctcctcatcatgaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaaggagctgcgacaattcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcacgctcccaacacaaggtgggcagggaggcaccattcaggaacctggaccaaagctgacgaggctgggccaagccagggatggggccacagccagaaccccgagccctacttccaggttctggttagctcagccccagcccagcccagctgctctgcccagagctgggtgagtggggagacacctcagagccccgcaaaacccactgaccggaggcaaaaggcagtggggctgggggtagttttccatggtcacagagaactagtggtggctctgagaaggggaggacctctgggctttgattccatctccttgtcttttttctttgtttttagagacagggtcctgctatttcccaagctggagtgcagtggtgcgatcatggctcactgcagcctcgaactcctgggctcaagcaatcctcctgagtgatcccatttcttaatcagtgtagccccaagaaggctggggctatttaccagggttaagggctcccggagggttaagggctcccggagggttaagggctcccggagggttaagggctcccggagggttaagggctcccggagggttaagggctcccggagggttaagggctcccggagggttaagggctcccggagggttaagggctcccgggggttaagggctcccggagggttaagggctcccggagggttaagggctcccggcgggttaagggctcccggagggttaagggctcccggagggttaagggctcccgg

SEQ ID NO: 500562 - DNA, 160 bp, Homo sapiens
gcaaacccactccaccttaccaccagacaaccttagccaaaccaatttacccaaataaagttataggcgataaaaattgtaaacctggcggcaatagtatatagttaccgccaagggaaagatgtaaaaattataaccaagccataatatagcaaggact

SEQ ID NO: 500563 - DNA, 135 bp, Homo sapiens
ggagtgacagagagaagggtggttacggagaatgaagaaagcctgaagtataaggaatctcagaccatttgtcattgcgagtggcaaaagttgtctaagtctctaagtatattgaacatcgaaagtgccatttat

SEQ ID NO: 500564 - DNA, 1985 bp, Homo sapiens
aagcggcacgaggctcgggttgtgccaccgctggactcccgtgtccctccgcgcaggcgggcggccccggagcgctggtgccggcagaggcggcgacggtggcgcccctcctcatcatgtcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcacgctcccaacacaaggtgggcagggaggcaccattcaggaacctggaccaaagctgacgaggctgggccaagccagggatggggccacagccagaaccccgagccctacttccaggttctggttagctcagccccagcccagcccagctgctctgcccagagctgggtgagtggggagacacctcagagccccgcaaaacccactgaccggaggcaaaaggcagtggggctgggggtagttttccatggtcacagagaactagtggtggctctgagaaggggaggacctctgggctttgattccatctccttgtcttttttctttgtttttagagacagggtcctgctatttcccaagctggagtgcagtggtgcgatcatggctcactgcagcctcgaactcctgggctcaagcaatcctcctgagtgatcccatttcttaatcagtgtagccccaagaaggctggggctatttaccagggtagaaaaaggagcttacctcccacctttggtcctaagtccctgccccctccccttcacaccataactaggtaacagtttgataactagggaagaaagcagaacagttaagcagccgccacatccccgctggctgggggcctcactccaggaaggggctggactggctgtcctttccagtggcctggctccgctgtgtggatggggagatcggggccagaggcagaaccctggtgaggaagctccagtcctgctctctacccagcccatcttgcctccatggtgcctctggaggcctctgggcctcctctaacaggggctggtgggcaccaagagccaatggagtagacccctggctggtaagggccaagtcccaccggttgcttctgggaaggggtttctaacactagtctgtgtgctgtggttcctggggtgccctccactgccctctgttcagtaacagggccttgctaatcgggttgtcactcaacaaaagtgctttggatttaagttactatcctggctttgcccaacctcagcaacctgtaagactgataatgaaataaatcatgttaatcctaaaaaaaaaaaaaaaaaaaaaaaaaaa

SEQ ID NO: 500565 - DNA, 403 bp, Homo sapiens
agggattaatccgggaacaggctttcctcagagacaggcctcaagttcggaggggcaagcccatacatctggtaagcagacttctagcaggtacctgatgactgcgggaggaaggggatgcatgggtgtccccatctgtccctggtgagaagcaaggctagctctgccttccacatgcttctcaggatgccaagaggcctaggaacccagaaacccccttgtgaggagctgtgtactgctggggtgcagggcagggcatagctcctgccccctggcctaggcatgctgcttgctcggccatccccagttcctcctctaccccaacgcttgctggcttaggccttgccctggaacatggaggccctgcccgggcctggggcctagtccagcagccaccaaagtc

SEQ ID NO: 500566 - DNA, 235 bp, Homo sapiens
cgatttcccatacagagtactcccacgcttcacttctttgatcaccaccactgagtccacctcacacagtcccccaaggcttcacttctgtgatcaccaccacgaggggatcacctcacacagtactcccagttttcacttctttgattcgccaccactgaagaacacctcatacgcgtactcccaggcttccgcgttcatcgactcagaagcagacagaggaccactctcacag

SEQ ID NO: 500567 - DNA, 2148 bp, Homo sapiens
aggctggtcttgaattcctgaccttgtgatccacccacctcggctcccagagtgctgggattacaggtgtgaaccaccgcacctggcctgagaattttaactttttattgctctaaagttgccattagtttgaccaactaaccaatgaatgagctgtagtgggttgctggagaggtgatgcttagtgtccgagtgttttgcactgggcctcggtggtcctggtggcggatgttggtatgcccctgctcccctgccctgactgcacccgttttctcccggcagtcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcacgctcccaacacaaggtgggcagggaggcaccattcaggaacctggaccaaagctgacgaggctgggccaagccagggatggggccacagccagaaccccgagccctacttccaggttctggttagctcagccccagcccagcccagctgctctgcccagagctgggtgagtggggagacacctcagagccccgcaaaacccactgaccggaggcaaaaggcagtggggctgggggtagttttccatggtcacagagaactagtggtggctctgagaaggggaggacctctgggctttgattccatctccttgtcttttttctttgtttttagagacagggtcctgctatttcccaagctggagtgcagtggtgcgatcatggctcactgcagcctcgaactcctgggctcaagcaatcctcctgagtgatcccatttcttaatcagtgtagccccaagaaggctggggctatttaccagggtagaaaaaggagcttacctcccacctttggtcctaagtccctgccccctccccttcacaccataactaggtaacagtttgataactagggaagaaagcagaacagttaagcagccgccacatccccgctggctgggggcctcactccaggaaggggctggactggctgtcctttccagtggcctggctccgctgtgtggatggggagatcggggccagaggcagaaccctggtgaggaagctccagtcctgctctctacccagcccatcttgcctccatggtgcctctggaggcctctgggcctcctctaacaggggctggtgggcaccaagagccaatggagtagacccctggctggtaagggccaagtcccaccggttgcttctgggaaggggtttctaacactagtctgtgtgctgtggttcctggggtgccctccactgccctctgttcagtaacagggccttgctaatcgggttgtcactcaacaaaagtgctttggatttaagttactatcctggctttgcccaacctcagcaacctgtaagactgataatgaaataaatcatgttaatcctaaaaaaaaaaaaaaaaaaaaaaaaaaa

SEQ ID NO: 500568 - DNA, 306 bp, Homo sapiens
gctgctagcggaccttcgtaatatgtacacacctaaacagacctttttcaagataatgactgactctctccaggatcatttaaattccaaagagaactacctacaagttaattctgtccctgatcagtcattctccctagcaatcatttattacccctcatctaatctaatcccaaagcctaaatctaataaaatacttctaaaatctgcgaccctaatggcctcccacactcaagcattccacttactttgtactttagagaggcctaaattttgttacactagaggcacagctaatagatgttt

SEQ ID NO: 500569 - DNA, 2149 bp, Homo sapiens
aagcggcacgaggctcgggttgtgccaccgctggactcccgtgtccctccgcgcaggcgggcggccccggagcgctggtgccggcagaggcggcgacggtggcgcccctcctcatcatgaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaaggagctgcgacaattcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcacgctcccaacacaaggtgggcagggaggcaccattcaggaacctggaccaaagctgacgaggctgggccaagccagggatggggccacagccagaaccccgagccctacttccaggttctggttagctcagccccagcccagcccagctgctctgcccagagctgggtgagtggggagacacctcagagccccgcaaaacccactgaccggaggcaaaaggcagtggggctgggggtagttttccatggtatggtgcctctggaggcctctgggcctcctctaacaggggctggtgggcaccaagagccaatggagtagacccctggctggtaagggccaagtcccaccggttgcttctgggaaggggtttctaacactagtctgtgtgctgtggttcctggggtgccctccactgccctctgttcagtaacagggccttgctaatcgggttgtcactcaacaaaagtgctttggatttaagttactatcctggctttgcccaacctcagcaacctgtaagactgataatgaaataaatcatgttaatcctaaaaaaaaaaaaaaaaaaaaaaaaaaa

SEQ ID NO: 500570 - DNA, 1922 bp, Homo sapiens
aagcggcacgaggctcgggttgtgccaccgctggactcccgtgtccctccgcgcaggcgggcggccccggagcgctggtgccggcagaggcggcgacggtggcgcccctcctcatcatgaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaaggagctgcgacaattcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcacgctcccaacacaaggtgggcagggaggcaccattcaggaacctggaccaaagctgacgaggctgggccaagccagggatggggccacagccagaaccccgagccctacttccaggttctggttagctcagccccagcccagcccagctgctctgcccagagctgggtgagtggggagacacctcactgccctctgttcagtaacagggccttgctaatcgggttgtcactcaacaaaagtgctttggatttaagttactatcctggctttgcccaacctcagcaacctgtaagactgataatgaaataaatcatgttaatcctaaaaaaaaaaaaaaaaaaaaaaaaaaa

SEQ ID NO: 500571 - DNA, 674 bp, Homo sapiens
  misc_feature (93)..(99): n is a, c, g, or t
  misc_feature (106)..(106): n is a, c, g, or t
  misc_feature (108)..(108): n is a, c, g, or t
  misc_feature (110)..(110): n is a, c, g, or t
cagcctccgacccaggtggtctggagcctgccgggagagtggtggcatctgagaggctggtcgtggactgtggttgggggaggtgggagctgnnnnnnncgtgtgncncntctcctgtgccggcgtgggcatcccccggggcagtggaacgcgggcgctcctccagcttccgagtccagccagcctggcgcggggcgcccccgagacacccgaggagtccgttcctccctggttacgtggactgtggatgctggtctcttgtggcctcagcgccgtgcggaggttgaatgcgtacctgcggaggtcgcatcgcagtgccgtgagcgaggaggaggaagggccatgagccgagtcttgcaggaatccgatgctccaaagctctacactcaagggtggcccttgggttagggtgaagatcccctgtctttatcctagattccacaccttggtgtgggttactgggtgcaggatgaactgtcgctcgagaggtgctggaggtagtcggttgcgagggtgcgggcatgtgcgaggaggccatgctggctgtgctgcacacggtgcttctgcaaccggacacaggcaagttccactacaaggaagtgagggccacctactccattggcaccgtggggcacccaggattgttgactgtgacttcatcgattcacttatgg

SEQ ID NO: 500572 - DNA, 435 bp, Homo sapiens
catgaaaatgttttgtgcttcatactcacaagtgcaattgtgttaattctgcaaaatttgccgcataactctgcctgtattcttagcatttttcctttgagagatttctcagcacatcatctttggactatgtggaattggaaatttacttagagtcaacaacaagtacaggaaagtcagttcttagtcaagagttaggtttccaaagacagtggataaaataaaaaattaacatttgatgtacagttaagattatacgtgcaaatcccctcatcattcataaagtttagcagtcagtcttaccgtggctcaccaggtccaatccatacttcttcctccacgattggagcagagggtgattttttttctgagcaactgatgaagtcatttagagaccatttgcagtagaaaccatgtgtactagagaccaatcat

SEQ ID NO: 500573 - DNA, 581 bp, Homo sapiens
tggggctggagcaatcctcccttctgtgcctcccataataaagtgctgcgattacaggtgttagccactgtgcccagccgccaaatttttagctttttaactcgtaataacatggcttcacaagcacactgtagagctgtacctttttttttgagacagagccttgctctgtcacctaggcttgagtgtactgccgtggtcttgactcgctgcaacctgcgcctcctgggttcgcctgattctactgtctcagactcctgagtgtcttaatttgcagacatctgccaccaggcccaggtactttttgaatttcagactagaatgaggagtcctgttagtctggatgcaggacgatcaggactgcactacggttgcctgccgcagagtcatactgtatcactttcttccatcagtttagcggccgccacctatattactcctgctgcactaatctattatgcggcgtgatatcctagttcccttcctttatctggattctatatatcgcgtccgctccattaacagcccagacctacacctccatctgggcaactggggacgtttactcacctctcttgtcc

SEQ ID NO: 500574 - DNA, 495 bp, Homo sapiens
  misc_feature (37)..(37): n is a, c, g, or t
  misc_feature (62)..(62): n is a, c, g, or t
  misc_feature (65)..(65): n is a, c, g, or t
  misc_feature (68)..(69): n is a, c, g, or t
  misc_feature (72)..(73): n is a, c, g, or t
  misc_feature (75)..(75): n is a, c, g, or t
  misc_feature (90)..(90): n is a, c, g, or t
  misc_feature (96)..(96): n is a, c, g, or t
  misc_feature (98)..(98): n is a, c, g, or t
  misc_feature (115)..(116): n is a, c, g, or t
  misc_feature (168)..(169): n is a, c, g, or t
  misc_feature (182)..(182): n is a, c, g, or t
  misc_feature (188)..(189): n is a, c, g, or t
  misc_feature (213)..(213): n is a, c, g, or t
  misc_feature (215)..(215): n is a, c, g, or t
  misc_feature (217)..(217): n is a, c, g, or t
  misc_feature (258)..(258): n is a, c, g, or t
  misc_feature (279)..(279): n is a, c, g, or t
  misc_feature (490)..(490): n is a, c, g, or t
tccaaaactttgaaggctttaagcgttaaagtgggtntggggcgggggggtgtggggttccntcnttnnttnncncttcctgtggggttngttggngngtccccggcgggggggnnggccccgggggggtgggggggggggggggccggggggggggggggcgggggnntccccggggggtnggcggnnggtgtgggtgtgagcgggggggcngngnccccttggggttttccgggtgggatggggagtgggaacgangcattcctgtgtagtcttcanccaattccaagtcaagtagaggcagggaaagcagggtgacaggccgggtgtgcggaaaggagaagcgggtcttctgggtccctgtggtcagggagaacccgcttcctcagctcctggacgaagcttcaatgatttcctctttcactttctgcaattccttcttcacctcttccagaagctcctgtttcaccctctgtaggtccgagtaatnactgg

SEQ ID NO: 500575 - DNA, 150 bp, Homo sapiens
tgttacgatgccagtaccgatctaaaagtatctccagtgaatatggctcatcatccattatactttgcatggcatatatatcactggcaagactcgggtccttaaaacggaaagcagtccttgacctcgaaatgctgtaagtcatgtggc

SEQ ID NO: 500576 - DNA, 193 bp, Homo sapiens
  misc_feature (168)..(168): n is a, c, g, or t
ccttcattaaaagtatcatttacaggtattgacattcacagggagtatactaactaaacctagactggagaaatgcataaattcacgctttgcaaccctcatcccacccccgctgcctcttggcctctcctgtgaacacatccttcccctcttccctctgcttcctantccatctttcactgctggttcttcc

SEQ ID NO: 500577 - DNA, 342 bp, Homo sapiens
cacgattctttgctatgtagcaatagtaactgcaacagagtatgagagtcaaagatatttgtatcaatatgaattgagattaattatccaaaatatttcaatcatctacagaatagatgtttgaaagttcacaatactctggaataaaatattttctacataatgtaaagcaaagcattatttgcaaacgtgtaaatacatattgtcccatgagaggttttccattataacttcagagtaattaaacatacaaagaccaatcccttgctaatctttctgttcaaattgcttaattatgagagcttctgtgttcattgtaagacagaaagataagcgggtacc

SEQ ID NO: 500578 - DNA, 653 bp, Homo sapiens
tgcgtgtgggtagatggatacagaatgatctcctacccacacctccagccagaaggaattattcagactgtggagggggagaagggagaggatgtggccagggacgaggggtcagggagcccagaggatgcagcaggactggctgtaaggattcaatgctggaaatggaaagcactgtatgaattttaagcagcaaatgaattaaaactgaaaacttagatggttgcaaaactgtgggagggctggagaagggcagtcaggggcagccctggactttggtttggaaggtcatgcctgttgatatgactcagatgtgcggaagctgctgctgccactggaattgccacatacctgtgaacctggtagagcagatgctagggccgctccagctgcagctcggtggctaccacctctcttcctccttccccacctcatgggggcatgtttacctatagaacctcattcatagcccagatcctagctgcaaaggagtctgggaaagatgactgcttagctttccaacttccctctgacagaataagattcttaacctgggagtgagtgtcccagaggcccaggagagcactcagggcccctccaagaacctgcctcgacattcaaccagtaggccaaaccctaggggcttgcttgta

SEQ ID NO: 500579 - DNA, 822 bp, Homo sapiens
gagagataccagatccagtcgtacgatgattgccacaaaggaaatttattagaaagagaagctaagcaccatgatttagcgctggaaaggataacgcctaggtactgtgacaaatgcaggttgtgttacgatcaggactacacatatctgtaaactgttaaaccccaccgccttgaagcaggaagaagaagaagagaaggaacaacagctgacagtctaaaggttgtatagcaagaagtcctagacaactgagaacccgtttttctggatgggtgctgtcaatgctccgtccctaaagtcaggaagtagcttgctagtaagacactacctttgaaagtcctttgtgatacgtggacgagatgcccctggggcagctagaacgccatacacattcaagggcaaagcgagtgaagtggtctctgtgctcccaaactacaatcatctttaattcaggagataacgggggtcataaggactttttagatccattacacacagtactctggaaaggactgtcaatactgtgaaagagaaccccaagagagaacattatgaacagtctggaaggaatgacttatgccatgcccactgaaaatgcccatcatggttacagaaaaagctgtgaaaggccaagcaagcccaaaacaaaaatccgggggcaggggaacacccggcgccgactgttggtggccataactttcataggattacaaaacgaaggtcacatcaagggacaatcctgaaacacgatgtgcggactgtgggcaaaaaaaagtgggggtgtgcacagggcgtcaagacacacttccagcagccaacaac

SEQ ID NO: 500580 - DNA, 1021 bp, Homo sapiens
tgtgttatttaccgactctaaactaagtccaagaaacagaactatatagcagaatacatgcgcacgcgctagcgctttaaacataatttctaaattcgttccctccagtgctccgaccacaagtatttgtaattacaaattgttgatatttcacggtccatcgctccactcccagtgtcaattacccctccatccgggattgtacacagctcccaacactcggttggcgcgctcaaaagaatgccgtggtccgtgatgtcccacagggcaagttaactcatgcagccgccccagctatttctcctacctaggggccgccctcgggtttcctcgaccacccaagtgtcgtccggctcccgattgcgccccgtgggtgctctggttgcttcccagggcacgcccctggtcagagccatctggtgtttcacactctcctccaggtggccatagagagctctccccgtgcttggttgcagggttctagcccccttcacaaggcaggggggctcctttctttcacacaagaaggcggagtgtgccgccccctgtatgtggtcgccttcgctcgctctttcaaatggtcagcaagccttgaacccccctcctggtcctcctggtcgcgcgccccatttacatatgtgtgacgcaatgttttctccccggccattccttcaggagggggagtatgtgagtgggcttgcgtactccgagaaagtacgccgctggccctgtctttcgccgccttctgtatggccccccggttatcctcctctctcgcgttcagcttctctctattgcgcgccttctgggtgacccctctcctcagctatgcatcctgggtgttgatgatgtactccctcttttaggatgacccacaggggatccagaacccccacgcatgcgccttcctcctagccagcccctgtttctatggggggtagtcagggaggggccacacacattttggggggaaggtcggggcacacccaatacaagcaggaacccccccgacatgaacaaa

SEQ ID NO: 500581 - DNA, 774 bp, Homo sapiens
gatttgccgaggacaccaaggggctaagtctccgagagtgcgaggggacaaatcgcgccaaaatggtcagaaaaaccaagggccacatcgccaagcagcaagtagccgaggacaccgacggcgacaaaatccggcctcaattgggtgagcacccccggggtgctgtagatgccccacgaaggggcgccacacccgcgtgcccactcttccatgggaagccccataaaggaggggccagaggccgcgcccaattctgggagagggatctctatacacgccgagcggggccagccaacacgcgctatgatcacgcgacgtgaacacggccggcgaggagaccatcgtcctcgcaaggcaaccctcgctagtaaggctcgcctcctcaagtccccgctggttccaggcctgttgctcagcagtcgcactcacacagggtcccacagaccatgccacgaagagtcggcggaagtgaatacagagggtcacaagagaactcttctgagagagtagtactccggatctcacagaagtagtctccagcaccgtccgccgcgcccacaggaggggtaccaccccaggtgcaatcctgctcgagtccatgggcgcccgggcgaggccacaaatggtcctctccaggggacagcagggagcgacaacctggcatcgcgctttagagcgcactgagccaccaacgggcccctcggtgcacagcctctatgtggcagtgttagacgagaagaaaaaaaaacaacacggccacaacaatgccagaca

SEQ ID NO: 500582 - DNA, 658 bp, Homo sapiens
  misc_feature (619)..(620): n is a, c, g, or t
  misc_feature (647)..(647): n is a, c, g, or t
ccttgaaagcaaaacctttttggacccccaattgttcccggggccccccccgggggagagagaaaacccccccgcctttaaaaaaacccttttttcccccccccccggggggttttgggggttttttttttttaaacaccgggggtcttttttaaaaatttcggcggcggtgttttttttggggggggggcgccccttttctttttgggaggagaaaatattccccccccccccaccccccccccgggggggggagggagggagaaattttttgtgtgtttcccccccccccagggggaggtgttttttttttttttggtgacaaccccccccctcccccccccccagaggaggggggcccccccctcattatttttttttttttaaaaaaaaaaaaagggcggcgggggtgtttttgtttcccccccccccccccttttaatttttaaatataataaaaaaaaaaaagggggggggggggggggaccaccccccctccttctcttttttttttgtgggggggggggggggggagggtttttttttttttattataaacaccccccccccccctcttttttttttgggggggggggggggggaagaaaaaaaaaccccnncccccccacaattttttttttgggggntagggggggag

SEQ ID NO: 500583 - DNA, 933 bp, Homo sapiens
atgtggtataacaacagtgctggccccttcttgctgactggcttcttgggctcagaggcagttcactaccggatctctatgtccttctttgtcatctacttctccatcctttttggaaatggcactcttcttgtcctcatttggaatgatcacagcctccatgagcccatgtactacttcctggctatgctggcagacacggaccttgggatgacattcactacaatgcccacagtcctgggtgtcctgctgctagaccagagggagattgcccatgctgcctgtttcacccaatccttcattcattcactggccattgtagaatcaggtatcttgcttgttttggcctatgactgtttcattgccatccgcacaccactgaggtacaactgcattcttaccaattcccgagtgatgaacataggactgggggtactgatgagaggttttatgtccattttgcccataattctttcactctactgctacccatattgtggttcccgtgccctcttgcacacattttgcctccatcaagatgtcataaaactcgcctgtgctgatatcacgtttaatcacatatatccaattattcagacttctttgactgtctttttagatgctctaatcatcatcttttcttatatactaatccttaagacagtgatgggcattgcgtctggacaagaggaagctaaatctctcaacacttgtgtctcccatattagctgtgtcctagtatttcacatcactgtgatgggactgtcattcattcacaggtttgggaaacatgcacctcatgtggtccccattaccatgagctatgtccattttctctttcctccattcgtgaatcctatcatttatagcatcaagaccaagcagattcaaagaagcattattcgcctattttctgggcagagtagggcttga

SEQ ID NO: 500584 - DNA, 296 bp, Homo sapiens
ccagaagctgactcttcccttctgtgtactctccctaaatctggcagtttataaatacttaaattaccccagtgtatattttaaaattcagttttctttttcttcttttagacggagttacgctcttgtagcccagggtggaatgtacatggcgtgatctcagctcaccacaacctctgcctcacgggttcaagcaattctcctgcctcagcctcccaagtagctgggattacaggtatgcaccatgcctaattttgtatttttagtagagatggggtttctccacattggtcagg

SEQ ID NO: 500585 - DNA, 183 bp, Homo sapiens
agggggcccccccccccccccccccccccccctccccctttgggggggggggggccccccggggggggccccgggggaaagcccccccctggctttgggcccccccccccaaggggggtttttggggccctttttttttaaattcgggcccgttttggggttttttttccccttttaggggga

SEQ ID NO: 500586 - DNA, 820 bp, Homo sapiens
agtatgtgctgactctaaaacgttcggagctccgtgaactcagacatcatgaattgcgtttctttgtactatggatattgaagtctctactttctatgctcttctattatgcctctcaatcaacatgtgtagcatagtgttcagttgacctaacatgcatcacacatgcatgccaatcattagcatgtaagatgattccgcagacttattgtctcacacatacctgtggaaagttgcagagtgtcgctgtctacttaattaatccaaagtgagactaggatctacattcacttagtgcatgcactttccttacaatcaagacttaaagaaaacgacaacatcattcaggacagctcatcaactagactctgatttcaatagacgagatcctatacatcaactcttgatatcactccactgtaatgtagatctattctaggaagcaaatacttaatggactgagacgtcgtggcttaaccttcgaagttcacaagcgaaacatgatttagacgtacatggatggaaaactactgcaaggcgactcaggatatattaacgatattgtactcaagcataattcgtaatatcttgcatagcataactagtgtactcttcacaattattgatcaacgattcgtttataccttgacatactaggaatgagtttgacccaagacattgaaagtgagcagctgccatgcgaacccttgacaattgaccacggtgtcaaatcctctgtatatcactggaaaagaattcgtcatggacattgacacatatggcgacatactcagactatgccttactctataaatccttg

SEQ ID NO: 500587 - DNA, 177 bp, Homo sapiens
cgagccggtaactagtacggcgcagatgctggactatcggcttaggcaggtcagaaaggtccagggctctgagaagggagtgtgagccacgatgcgatcctaatataacgcggtatagctagcgcgctatagagcaagatagaggcttggataacaggtagaacaatagaaaacaac

SEQ ID NO: 500588 - DNA, 263 bp, Homo sapiens
caagtcacaaacagggccttgtctagagctgacattgaacacagatgggtgcgtattatttatcttctggatggcagagaatagtaacagttcggagcaccaatgggaacattgcttcctgagagttcaatcagcaacaaagttgcatgggtgagctaagtgtgtatcatgcgaatatgttatattagcggacattaatacaaatctagagtgcgacataacatctttgaattttatattctcacttaacaaatattggacta

SEQ ID NO: 500589 - DNA, 1063 bp, Homo sapiens
ctgttcgcctccgtgctttagcacgtgctacactcctctcagcggcgctaggggctgccgctcagcttcttcaactcacgctggcacacaccttgtactagctgaacactgtctctacactgctgcggaaacactcctgccttacgacaacatctaccaaacgtacaactcgctgctcctctctcatagcccgggaagtggctaccagagcagcaaactggcacaccttagacttcggcaaccaacaagtcctgtaaaccgtggctctggttgtgccacaagtggaacacctggcatgcactacaggacgcctgcaagaacggccccacagaacgcggcactctggtgcgctggcgttacttctcacttctggcctggtggggccaacatctttcttggcgtgcaacacttaccacactgcggtcgcgtgctgcgggctcgacaaccacggactcgcactctcacaccttacacctcgctcttaccacggcacccaaaccaaccaacacaacacacacaacacaccacacacacccacaccacacttgtgcgctcgggcacacgcgcccacagacgacgcccctcacagacagacacgggcttctacagagcaccactctccggcgtgaggaggcgcagcggggcgcccacaaagtagcgcaaaaagacagcaccacgtggggccacaatacccggtggcccacaaagagagagaaccactccgggggcgacaacatccgcagaccaacgaacgggcgcccggcgcgacactcctcctcccacacccagccaacatatcacaaaacaaaaccggcggcgcccgggggggggggaccaacaccaccggcagacagcggttgttgtgtgagagacgaaaaaatctcaccacaaagagtggggggagccgtgcccggcagggcagagcgagcaacgactacacagaggggggagagcatgatacataacaacacgagggggggacggctcacagaggcgaaaaggcctcagaagaaaataaaaaatacgcggaggcgcgaaccagcggagggaaggagaggaggaa

SEQ ID NO: 500590 - DNA, 846 bp, Homo sapiens
gcctggggcgagagcgggtggctgagccgggacctctcgtgagtatctcggaacccgaggagaacgcggcgtccggggctatggctgtgactctggaccacgagcgcttattatcggacgagtgaggagactgtagagtaatgggcggaaaggaaaccgcactgagtatgccaacagtcgatgccatggttcgtatcgaggtagggtgtggagtgaagaaattgtcttattgccaagattcaaagcgtggtcctctacagactatggctctttgagttagtgaactaacctgatacctatcatgtgtctctctgtgtgatcgacaaagatcaatcttctattgtggccagcgatacgtacagaacgtggagttcttgaacagcagagttggccaaccaactaaggggccaagtgagaactgctgaagtggcaggcccctggccgagtcacacgtggctcggtacgagtaaaggaatgacaaggtaagtaacgtagtacggcttttgatcagaaccactgcagttgaaggcccagttaaaagcatagaaggcgaatgaatgggcgggagaggatggcgacggtgtgcagggaagggacaccatttccctggtagcagttgcatggaaggccgctcggcaatggacttggctcaacaaaagaaggctttggacgggaatagataatcggcgcagtaagtggtgatatacgcatcgctgtgaaccggagtgctgggggagccccacggctaattgaagagaatgccatggcaagcatcatttctgacgccttccaacggtattcttcctggaaccgtagtccaaggaaagacttggatgccggtgacaa

SEQ ID NO: 500591 - DNA, 1696 bp, Homo sapiens
aagcggcacgaggctcgggttgtgccaccgctggactcccgtgtccctccgcgcaggcgggcggccccggagcgctggtgccggcagaggcggcgacggtggcgcccctcctcatcatgaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaaggagctgcgacaattcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcacgctcccaacacaaggtgggcagggaggcaccattcaggaacctggaccaacctcagcaacctgtaagactgataatgaaataaatcatgttaatcctaaaaaaaaaaaaaaaaaaaaaaaaaaa

SEQ ID NO: 500592 - DNA, 312 bp, Homo sapiens
tctctagtcaatgttgacattagcatagagttttcgtacaaaggcacttgttcccatgtaaccaatcgctccacacattatccccaaggctgagctaaataccgccgtatatccaaagtaaaatgatgaccgaaataagccatacatctttgctgtgaaaaaataggtagtaaaaggaatacatgtgaacatagattgcagttgacgcagcatgcagaggttgcagtgtgctgagactgcaccactgcactccagcttaggcgacagagccagactgtgtctcaaaaacaggaaagaaaacaaaagaaaatt

SEQ ID NO: 500593 - DNA, 703 bp, Homo sapiens
  misc_feature (86)..(86): n is a, c, g, or t
  misc_feature (96)..(96): n is a, c, g, or t
  misc_feature (99)..(99): n is a, c, g, or t
  misc_feature (105)..(105): n is a, c, g, or t
  misc_feature (108)..(108): n is a, c, g, or t
  misc_feature (134)..(134): n is a, c, g, or t
  misc_feature (138)..(138): n is a, c, g, or t
  misc_feature (144)..(145): n is a, c, g, or t
  misc_feature (147)..(147): n is a, c, g, or t
  misc_feature (149)..(150): n is a, c, g, or t
  misc_feature (162)..(164): n is a, c, g, or t
  misc_feature (167)..(167): n is a, c, g, or t
  misc_feature (172)..(172): n is a, c, g, or t
  misc_feature (174)..(174): n is a, c, g, or t
  misc_feature (177)..(178): n is a, c, g, or t
  misc_feature (180)..(180): n is a, c, g, or t
  misc_feature (182)..(182): n is a, c, g, or t
  misc_feature (184)..(184): n is a, c, g, or t
  misc_feature (193)..(193): n is a, c, g, or t
  misc_feature (200)..(202): n is a, c, g, or t
  misc_feature (208)..(208): n is a, c, g, or t
  misc_feature (218)..(218): n is a, c, g, or t
  misc_feature (222)..(223): n is a, c, g, or t
  misc_feature (230)..(231): n is a, c, g, or t
  misc_feature (233)..(233): n is a, c, g, or t
  misc_feature (237)..(238): n is a, c, g, or t
  misc_feature (242)..(243): n is a, c, g, or t
  misc_feature (247)..(247): n is a, c, g, or t
  misc_feature (250)..(250): n is a, c, g, or t
  misc_feature (254)..(254): n is a, c, g, or t
  misc_feature (257)..(257): n is a, c, g, or t
  misc_feature (260)..(260): n is a, c, g, or t
  misc_feature (262)..(262): n is a, c, g, or t
  misc_feature (265)..(265): n is a, c, g, or t
  misc_feature (267)..(267): n is a, c, g, or t
  misc_feature (269)..(269): n is a, c, g, or t
  misc_feature (272)..(272): n is a, c, g, or t
  misc_feature (274)..(274): n is a, c, g, or t
  misc_feature (281)..(281): n is a, c, g, or t
  misc_feature (283)..(283): n is a, c, g, or t
  misc_feature (286)..(287): n is a, c, g, or t
  misc_feature (293)..(293): n is a, c, g, or t
  misc_feature (295)..(295): n is a, c, g, or t
  misc_feature (301)..(302): n is a, c, g, or t
  misc_feature (304)..(305): n is a, c, g, or t
  misc_feature (308)..(308): n is a, c, g, or t
  misc_feature (310)..(311): n is a, c, g, or t
  misc_feature (314)..(314): n is a, c, g, or t
  misc_feature (317)..(317): n is a, c, g, or t
  misc_feature (320)..(322): n is a, c, g, or t
  misc_feature (324)..(325): n is a, c, g, or t
  misc_feature (327)..(329): n is a, c, g, or t
  misc_feature (331)..(332): n is a, c, g, or t
  misc_feature (339)..(339): n is a, c, g, or t
  misc_feature (341)..(341): n is a, c, g, or t
  misc_feature (343)..(343): n is a, c, g, or t
  misc_feature (354)..(354): n is a, c, g, or t
  misc_feature (362)..(362): n is a, c, g, or t
  misc_feature (364)..(364): n is a, c, g, or t
  misc_feature (370)..(371): n is a, c, g, or t
  misc_feature (375)..(377): n is a, c, g, or t
  misc_feature (388)..(388): n is a, c, g, or t
  misc_feature (392)..(392): n is a, c, g, or t
  misc_feature (399)..(399): n is a, c, g, or t
  misc_feature (403)..(403): n is a, c, g, or t
  misc_feature (409)..(410): n is a, c, g, or t
  misc_feature (415)..(415): n is a, c, g, or t
  misc_feature (424)..(424): n is a, c, g, or t
  misc_feature (431)..(431): n is a, c, g, or t
  misc_feature (437)..(437): n is a, c, g, or t
  misc_feature (439)..(439): n is a, c, g, or t
  misc_feature (442)..(442): n is a, c, g, or t
  misc_feature (449)..(449): n is a, c, g, or t
  misc_feature (459)..(459): n is a, c, g, or t
  misc_feature (461)..(461): n is a, c, g, or t
  misc_feature (466)..(467): n is a, c, g, or t
  misc_feature (469)..(470): n is a, c, g, or t
  misc_feature (472)..(472): n is a, c, g, or t
  misc_feature (475)..(475): n is a, c, g, or t
  misc_feature (477)..(478): n is a, c, g, or t
  misc_feature (481)..(481): n is a, c, g, or t
  misc_feature (483)..(484): n is a, c, g, or t
  misc_feature (489)..(489): n is a, c, g, or t
  misc_feature (520)..(520): n is a, c, g, or t
  misc_feature (527)..(527): n is a, c, g, or t
  misc_feature (531)..(531): n is a, c, g, or t
  misc_feature (533)..(533): n is a, c, g, or t
  misc_feature (543)..(543): n is a, c, g, or t
  misc_feature (550)..(551): n is a, c, g, or t
  misc_feature (555)..(555): n is a, c, g, or t
  misc_feature (580)..(580): n is a, c, g, or t
  misc_feature (598)..(598): n is a, c, g, or t
  misc_feature (608)..(608): n is a, c, g, or t
  misc_feature (613)..(613): n is a, c, g, or t
  misc_feature (696)..(696): n is a, c, g, or t
agccagttcgaaccccgctcccgctccgcttcggttctcgctccttcggcccttgggctccaaacaccagtccccggcagcgcgtngcgcattgcntcnccccgncancaggatgccgggaaccgagaaggatngagnggaggnngngnntgggaagaagannnagnagaanangtnnanangngggtggaangaggagnnnaagtgngtgaaggaanaganngggaagnngnaganngagnngagngangggnggnggngnagngngnggngnggggggngnagnnagaagngnaggtgnngnnagngnnagnagnggnnnanngnnngnnagaggcngngngggaatgtgtncgtggcgngngagtgnntggnnngtgagagcgtnaagngcgggtncagngatagnnaagcnattgtggangggaacntgaagngnatnttgggtntggtgtggangntgatnntnnantantnnatntnnatgcncgtgtgggaggatgaaggggatgatgatgcnaagaagnagangngaaaggaganggtggtnnggtngattgagaagaagatggggtagttngggatgaggaagtttaangagaagtggnagagnggaaaggggtgggaggggtggtagagaggtgtggtggaggtgtgtggggagagtgggaatggtgggagggggagaagggtgtngataatg

SEQ ID NO: 500594 - DNA, 1694 bp, Homo sapiens
aagcggcacgaggctcgggttgtgccaccgctggactcccgtgtccctccgcgcaggcgggcggccccggagcgctggtgccggcagaggcggcgacggtggcgcccctcctcatcatgaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaaggagctgcgacaattcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcaactgccctctgttcagtaacagggccttgctaatcgggttgtcacccaacctcagcaacctgtaagactgataatgaaataaatcatgttaatcctaaaaaaaaaaaaaaaaaaaaaaaaaaa

SEQ ID NO: 500595 - DNA, 188 bp, Homo sapiens
  misc_feature (165)..(165): n is a, c, g, or t
atgtgaggcttttgtggaactccatgtgcagaaattggacctgccatgtgaaatttacctggcagcaaaatgatggcacatctaaggaaaaggcccaggctctagaagacctggctggtaagacgccagcattaaataccaaaatagcctgcaaatctccacaancatgacccatgtggacaccccag

SEQ ID NO: 500596 - DNA, 274 bp, Homo sapiens
gcgccttatcctggacccgatgcagaaggaccccacgaggacaacagcgaacacttaaagaatcctgtaaatagcacagaagatccagaagctgatggatgtgggtctgcttgccacttcggtgatgacttgttcatccccccgttcccttcgccctcatgtgaacaagaggacgctgggaccgcggcgacgccgcacggcgcgcacaggggacgacccggggcacagaaggcctcatctctctatatttgtccataaccccggggccgagtca

SEQ ID NO: 500597 - DNA, 1316 bp, Homo sapiens
ttccagtctcacccttttcaaacctgctctccacccagtgccatgatacagccacgacatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcacgctcccaacacaaggtgggcagggaggcaccattcaggaacctggaccaaagctgacgaggctgggccaagccagggatggggccacagccagaaccccgagccctacttccaggttctggttagctcagccccagcccagcccagctgctctgcccagagctgggtgagtggggagacacctcagagccccgcaaaacccactgaccggaggcaaaaggcagtggggctgggggtagttttccatggtcacagagaactagtggtggctctgagaaggggaggacctctgggctttgattccatctccttgtcttttttctttgtttttagagacagggtcctgctatttcccaagctggagtgcagtggtgcgatcatggctcactgcagcctcgaactcctgggctcaagcaatcctcctgagtgatcccatttcttaatcagtgtagccccaagaaggctggggctatttaccagggtagaaaaaggagcttacctcccacctttggtcctaagtccctgccccctccccttcacaccataactaggtaacagtttgataactagggaagaaagcagaacagttaagcagccgccacatccccgctggctgggggcctcactccaggaaggggctggactggctgtcctttccagtggcctggctccgctgtgtggatggggagatcggggccagaggcagaaccctggtgaggaagctccagtcctgctctctacccagcccatcttgcctccatggtgcctctggaggcctctgggcctcctctaacaggggctggtgggcaccaagagccaatggagtagacccctggctggtaagggccaagtcccaccggttgcttctgggaaggggtttctaacactagtctgtgtgctgtggttcctggggtgccctccactgccctctgttcagtaacagggccttgctaatcgggttgtcactcaacaaaagtgctttggatttaagttactatcctggctttgcccaacctcagcaacctgtaagactgataatgaaataaatcatgttaatcctaaaaaaaaaaaaaaaaaaaaaaaaaaa

SEQ ID NO: 500598 - DNA, 1201 bp, Homo sapiens
aagcggcacgaggctcgggttgtgccaccgctggactcccgtgtccctccgcgcaggcgggcggccccggagcgctggtgccggcagaggcggcgacggtggcgcccctcctcatcatgaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaaggagctgcgacaattcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgctaaccaggatgggtgggatggatgttcatacctggcttttcttagcgcggtcagacctcaccaatatagtcgagcctataattcttaccaaggacctgagcagcgctagctccgcagtttcatagtcatcgcccacaagtcctg

SEQ ID NO: 500599 - DNA, 949 bp, Homo sapiens
aagcggcacgaggctcgggttgtgccaccgctggactcccgtgtccctccgcgcaggcgggcggccccggagcgctggtgccggcagaggcggcgacggtggcgcccctcctcatcatgaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaaggagctgcgacaattcgtccctggggatgagcccagggagaagatggacttggtcacctactttggaaagagacccccaggcgtgctgcattgccaacctcagcaacctgtaagactgataatgaaataaatcatgttaatcctaaaaaaaaaaaaaaaaaaaaaaaaaaa

SEQ ID NO: 500600 - DNA, 402 bp, Homo sapiens
ctagaggatcccgagaagaacagaaggggatcagggtctggaaaggccttcggacagaatgagagaggaattttctaaactccagaacaagacaagctgacagtgctggaaggagacattctggatgagccattcctgaagagagctgcaggacgtctcgggcattaatcaaccgctgtattcatggatgtcttcggtgtcactcacagagagtctatcatgaatgtcaatgtgaaaggtacccagctcctgttagaggcctgtgtccaagctagtgtgccagtcttcatctacaccagtagcatagaggtagccgggcccaactcctacaaggaaatcatccagaatggccatgaagaagagcctctggaaaacacatggcccgctccatacccacacagc

SEQ ID NO: 500601 - DNA, 459 bp, Homo sapiens
gtacattcaaaagactcaggttggaaatagacttcttggttaaaaaaaaaagaaaaaagtatcaccaaaaggtcctttttaaaaatgaggtttatttcaaggctactcagctcctaaaagacctgcatatttaccttttacttccttcctccaggttttacctcccaagatcaggaatttcaacaaccccccaagatttcagactcatttcttattgggttttaaacgacaacaaagaacaaaagccagaccacgacaaaactcacaaagcaaatcacacagttgtgggattcagcgccacccccgcgcgttacatttgggcaacataaccaggattcctttcaacagacgcttctggaaaatgctgtagtattcctaaatgaaggcccctggttttttcaagcctcaaaatcacctactcaaagaagcagactcagaaccccaggtttatagaccttg

SEQ ID NO: 500602 - DNA, 956 bp, Homo sapiens
aagcggcacgaggctcgggttgtgccaccgctggactcccgtgtccctccgcgcaggcgggcggccccggagcgctggtgccggcagaggcggcgacggtggcgcccctcctcatcatgaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaaggagctgcgacaatgtaggtggcaggttggggccttataagcccaccttgctgggcacagggtgctgcgggcaaggacatcattgtactcaacggtgggccgaagcgcggaggcagaagaggtccctcacggggcgggcagccggctcccgtggttcctggggtgggcccttggaccc

SEQ ID NO: 500603 - DNA, 707 bp, Homo sapiens
agtgagactccgtctcaaaaaaaaaaaaaaagaaaagaaaataggctttactgggctcacagttctgcatggtatacagaagtgtagtaccaaaaatcttctccgggtgcggcctcaggaagcttacaatcatggtgaaggcgaaggcgaaaaaggtgaattcacacagcaagagttaggagcaacagagagaaggttggttggagggtcccagactttttaaacaaccagattctcattgttgacactatttgagcaagaactcactttaccaccaaggggagtggtgctaaaccatttcagtgagggattccacccaagtgatcccgttcacctcccgccaggccccaccttccaacacgggggagttccctatttcagctatgagaaattgggcgggggcacagcaacttcccaaacctattattaaggagtctatagtcacaaagaaaacagcaaaacacagtaggccaagttttggcccatattattggacacaatcttaagtaaacctctaaaatcaactttcacaaacagtattggcaaaccaattttcaacaaacgagtggaacctaatattgcaaagacccaagatagtcccaacaaattacaattttataagaaataaggccttagaagcagtgtcgtccaagtggaaattaaaaaagccttaataagtggcatcaactggcaacgagggcaaaggt

SEQ ID NO: 500604 - DNA, 104 bp, Homo sapiens
gtgttggcaaacgcagttaataaagcaatgttttctgtgcatagggagccctttgcactcctcgtgtgtggcaaacgcagttaataaagcaatgttttctgtgc

SEQ ID NO: 500605 - DNA, 706 bp, Homo sapiens
ccccccctgtgggtggtcgctcccgccagactaggggtttctctcgtcgggagtagtcagttccggcccctattaacggccgtgttctgcgcctttgtgagggtttcctctcacgacccggtggggttcccccccgtcctgtctctttctccctctcggagggtcccttgtgcagcctctgtacccggggaggttatccgggtgcacgccttgtatgtttcgtacctcccaacctctcttcccctgagtcacgcgggcttcttgccctcttctggcgcgcccaactcctccctgcgtgtggggcccccctgtgtggacgttctcaacgaggttgttgtaggcgccccgtgtcggtttcttcaaaaagactgttctcctgtctcgtcggctgcgggcgattttgggcatcatctctctcagctacatggggatcatgtgtgtttctatgatagctaccacggtccgacagcgttcttgccacaggggcggggattcctctaatcgccccaagaggcgtcatgcaacacctccgcgtgccccccgtctaatgagagcacacacacgacaccaccggcgcggggacgatgtggtggcccacgacccccccagggcaccacgatcgcggcacgacgacggggtggtccatcccccgcagcacacttgaaaaacaactgcgtgggcttcgccccacaaatgaacagagaag

SEQ ID NO: 500606 - DNA, 120 bp, Homo sapiens
cctaccaagatgagacctgttcatgaacatcataaagatccccgaaatacttaaacgccttatgacttccaggtgatgactgagccccccataaatccagtaatagggtatctctgaaaa

SEQ ID NO: 500607 - DNA, 985 bp, Homo sapiens
  misc_feature (68)..(68): n is a, c, g, or t
  misc_feature (166)..(166): n is a, c, g, or t
  misc_feature (177)..(177): n is a, c, g, or t
  misc_feature (179)..(180): n is a, c, g, or t
  misc_feature (206)..(206): n is a, c, g, or t
  misc_feature (222)..(222): n is a, c, g, or t
  misc_feature (229)..(230): n is a, c, g, or t
gaggtcaggtggcgtttgctgtggcggctaggcccgcgtgcgctggagacctccgcgctggcccccgngagcctcctgccctggcccggcgctgcggctctgccgcggcggcagcatgggtggcccccggggcgcgggctgggtggcggcgggcctgctgctcggngcgggcgcctngnnactgcatttacaggctgacccggggntcggcggcggggcgancgcgagnntcgggatacgctcttcgaagtccgcagaagacttaactgatggttcatatgatgactgttctaaatgctgacacaacttcaggaaactcctttacctgctggagtcaacggaggatcctgtaattattgaaagagctttgattactttgggtaacaaatgcagccctttacagttaaccaagctattattcgtgaattggggtggtattccaattgtagcaaaacacaatcaagcattccaaccagagtattagcgagaaagctttaaatgcacctaaataacctgagtgtgacttgttgcacaatcaaatcacgataaagatatagcatcagtcaagttatgtgagggatgtctctactggtactcttgaactatgatgtgcagtttggtggactgacattagtagacgaacattgatgtaacaatgaccagccaggagagttgcttcgaaggttagcgttagagactgtccaggtgtacataactggaaattggaaaggaaggtgaagttttgaagtgatattagagttgtgtgaaatccagcagaaagaggactgacggtggcaggtggattcattgttacgtattccgttaagtgaagggcagatagaaaggagagttctgatgagagcgagaggatcgagataatagagtgtctgagatgaggcattaatggaagacatatagtggagtgatggacgagaagtgagagagtgcggagtagagttagtcacaggagaaggagagagttgga

SEQ ID NO: 500608 - DNA, 175 bp, Homo sapiens
ctagaccagcttattgctacctccacaaacaggcagtggagtttggttggtagtattactgttggtggatggtggtggttggtacgtattactgttggtggtgatggtggtggttggtagtacttaccttgttggctggtgactggtggttggttggtagtatcacctgtatgtg

SEQ ID NO: 500609 - DNA, 668 bp, Homo sapiens
ttatcagtgtaaaggagtgtgccttcatggccgcaacacaagggttgacccttcctcctgcaatcatcgctgagcttatgcctctcgaggtacaaatgaactttatacacgagaactttttactagtcttaacaagagaactaggtgtagacattgacagaaatccttaactttctggcatggttcgaagtataaataaatttggacagctaccataaacaccactggtataccaggcaacatcctccagagtactgggatacctgaagtatgcgtcacaaatcttgactataatcaagtaagcttttttcataaccagtttctttgaaatgatcttctgcagcttaaaaccttaacacatgacactatagtactggtctcacaattttttacaagtctacttgaaacacaatattatcctaaagtaagctgatcaagacatgagaaattaaacaacacaaaaagctcaaggtaatacccctgagttcttaacacacctcaaaatccaaaatgctaacatatattcattactacttgggacacttaaactatacaagggtcacagaggaacccttagcattcacgaataactaaaataagttacacaaaatttttatgactcatcaatactcacaaagatataacaaatgttgagtcaaacacataga

SEQ ID NO: 500610 - DNA, 287 bp, Homo sapiens
ggcttggattaagcctaaggcaataataattacaggagttataaactgaggtacaatcaaaaggtttcaacactcgtttattttcagtttcaggacactacaaagaatgcatatcagaatggaactaaaaactgagacccaggcacgattaagttcatctaacgtacagctctgtacacaggtaaccttatgcagcacattgtgcacaacgtatggtaccgttcacatttgcagccattactgaagatactcatgtagaagctaagcaacaagttagcatacagtat

SEQ ID NO: 500611 - DNA, 150 bp, Homo sapiens
cgtataaattacagaaaactattttaaaaggtttgacaaagattccagtcccgaagttgaccagtcggtagaagctcggtttcccaattgaatatcgaaagtaaagtagcacagacctcggtcaatacttggaagggtgaacctttctag

SEQ ID NO: 500612 - DNA, 375 bp, Homo sapiens
tggcacgagattgaaagttatgttccaaataactttccgttgtttaccaaatttttttagacttggtcatcatcaggaagcatttgtaaaaataaaaatttcccccaattattggcccatttgggacttgttgaatcaatttgataggattaatttccagtgaagctgtgtttacagggcattccaagtgatttttatcaggaagtgtgaaaaacactcctgtacaaaatgggttaatttaaaattttatttaataagtgaacaattaatgaagatttcccctgtttacttagggtatttacccagacccatcgatcctgagttggggaaaagattttgaaattactgttttccaaaaaaaggggctccctttta

SEQ ID NO: 500613 - DNA, 172 bp, Homo sapiens
  misc_feature (102)..(102): n is a, c, g, or t
  misc_feature (110)..(110): n is a, c, g, or t
  misc_feature (134)..(134): n is a, c, g, or t
  misc_feature (137)..(137): n is a, c, g, or t
ttcatgtgggctcagaggggctgtgaggaccactgcacagttggtcggtttgttgccactgggagcaggctagggccagagggctccccaggtgcccagttngcatacantcaaaggctcctgctccacccacntgnaagtcccttctgcgaggaatggatggccaatccaa

SEQ ID NO: 500614 - DNA, 220 bp, Homo sapiens
gtgttgcttaatgtaacaagtttaatctagaagtacgtcttaagatctcctagtatattttttggagaaaaaaaaaagccaaagaaacaaaaccagagtgttggaaatgctcacctccaatatatgtatacactcaaacggatcaatgggcatggtttctggacagtggctgctgttacaccagcaggttattggacagactggacaccgtgtgccatgg

SEQ ID NO: 500615 - DNA, 392 bp, Homo sapiens
ggagctcggtaccgctgtatgtgcgactcttgaagtgtctggatcagctgatctgcctgtgtaactttacttcacggctgaggacagtcgttctcagtttgtcatgagctgtgaagtgtgaaaatgggaacgcatccttggatcttaggtgctgctgacctactttcccaaagcaaaatgttttaaaattcaaggctgtctggaacgtggacaatttccaaagcttccttaggcaggacttttctgtgacttcctcgcgcacgctgctttccctgccacgaagcgcttggtctgcttactaaagacacgtatcctgattgtacagaaacgtgggcaggtccagcagtgccactggagagctcccagagaagcgcactcagaaggaagtgcta

SEQ ID NO: 500616 - DNA, 307 bp, Homo sapiens
tctagcggatcttatcagctgcccgacagctgactggtgcagttaaggaacagagttttaaatttcatttttttttttaagatggagtctcgctcctgtaacccaggctgtagtgcctggtgcaatctcggctcactgcaacctccgcctcccaggtccaagggattgtcctgcctcagcctcctgagtagctgggataacaggcgtgtgccacccatgcttggctaattttggtattttgggtagagacggggttcagcattttgttgaggctggtctcgaactcctaacctcgtgatcctgcctg

SEQ ID NO: 500617 - DNA, 246 bp, Homo sapiens
atctagaggatcctgctcggaggtgggtctgctccgaggtgcccacgaaatttaatgcaggttggtagttaggactgtggttgaggtactgttgcattataaattaagctccataggggtcttctcgtctgctggtcatggcccgctcttcacggggcaggttcattcactggtaaaagtaagagacagctgaaccctcgtggagccattcatacaggtccctaattaaggaacaagtgattatgc

SEQ ID NO: 500618 - DNA, 255 bp, Homo sapiens
ttatctccccttatccccagaatgatggttttggaggtgtggccttttggaaattatgaggtcgtgacggtgcagctctcatgcataggattaatgccattataagaagaagcacaagagagatgctctccctctgctatgtgaggatacaataaaaaggcagctgtctacaagccagaaggccgcttcaccagacactgtatctgccagctccttgaacttggacttcccggtctccagaatagggtttcgatg

SEQ ID NO: 500619 - DNA, 479 bp, Homo sapiens
gggggtttaaaatgtcaaagagagaacgtggtgggtcttttggggccaaattccggatttccttgggttttcgggtaggagctgtaatcaattgtgctgacaacacaggagccaaaaacctgtatattatttccgtgaaggggatcaaggggcggttgaacaaatttcccgctgttggtgtgggtaaaatggtgatggccacagtcaaaaaaggcaaaccagagtttagaaaaaaggtacatccaccagtggtcatttgccaacgaaagtcatcccgtaaaaaaaagggggtgttttttttttttgaaaataaggcaggagtcatagtgaccaataaaggcgaaatgaaaggttttgccattacaggcccagtagcaaaggagtgtgcaaacttggggccccggattgcatccaatgttggcagcattgcatgattttccagtaaatttgtaaaaaataaaaaaaaattaaacccttta

SEQ ID NO: 500620 - DNA, 707 bp, Homo sapiens
cgccgctccgccgtcgcgtttctctgtcggcgcgcgactggaagaagagatcgccgcgctggtcattgacaatggctccggcatgtgcaaagctggttttgcttggggactgagcgctccccgtagccgtgtttccttccatcgtcgcggcgccccagacatcagggcgtcatgttggcgtcatgtggccaaacaggactcctactgtgggcgatcgagtgcccagagcaagcgtggtacttctgaccctgaatgtaccccattgacgcatggcatcgtcaccaagctgggactgacactggatgatagcatctggtcaccactaactcttctagcaacgagtctgcgcgtggccccggaggagcacccagtgctgctgacctgaggacccctctctgaaccgccaagggccaaacagagagaagatgactcagattatgtttgacgaccttcaataccccggccttgtacgtggccatccaggccgtgctgtccctctacgcctctgggccgcatcattggccttgtctatggactctgtagtagcggggtcacccacacagagtgcccatctagcagggctacgcacctctcgccaggtccatcctgacgttggacctggctggcagggactgacgaatacttagtgaatatcctcatgagcaagttacgttcacaccgacgtcggaaattttgcgattcctgcc

SEQ ID NO: 500621 - DNA, 226 bp, Homo sapiens
ccccgtcctctccgccctaggcaactgctaatgtactttctgtctctatagatttgcctctctggacatttcataaaaatggtatcatttaatatctggtcttttgtgactgacctctttcatttagcatagcattttcaagatgtatccatgttgtaggatgtatcagtacttgattcctttttattaccaaatatgccaattaaaattccatcgtacagaaaaa

SEQ ID NO: 500622 - DNA, 601 bp, Homo sapiens
tccttaacttggcttaatggttgggggggtgaaaataaggcctggggcttgaaaaactcatggtcataaagttataaacggggaaacggggtcaaaaggcttaaaaccaccttgtcttcgcccattcttccctttctggtggattgaggcgggacaagggccggccccctgttgctggggcctgggacgcgagggctctcagagcttggagaaggtgacggtttccagtccctgtgtcctcagtcgtggcctggaccgatttcacgaggtctggggtctgcagcattgctcagtgtcccaggacgccacgttagtttgaggctctcggccaccgattggtcgcgggaattacagcgggttgaccttggtgctctgcaccgccacggggcctcttgcgtggaaactctcggccgccagcgctaaggcagcatccagcttgacctctttgtctgggaacccccggttgaccagcccattgcccagggcctcgtcagccatcatcttgcgggcggtgaaggccagctcgttgaccaggctctggtccccgatgaccttgggcaggcgctgcagtgtccctacatcggaagccaaacccaggtcc

SEQ ID NO: 500623 - DNA, 370 bp, Homo sapiens
  misc_feature (1)..(1): n is a, c, g, or t
  misc_feature (365)..(365): n is a, c, g, or t
ntctttttcgagcccatggtgccgatcgctatgcgggaagcctgtagagagcagactatctgcatagagctctaaatgctccaggggaaagccgttggaacccccctttcatttaagggaaatttaacccccccaaaaaaattttggtaaaacaccttttatttaagcccttttttttaaaaaaaaatttttttgaaaaaaaaaatttgaggggcaaaggggggggggccccggtggagtccacaaaattttttcgggaagaaaaattttttctaagggggccccaaaaaagggggaacccccgtaaaaaaaaccggggggggaaccccccccccggttttcgggggggggggggtttttttttnccccc

SEQ ID NO: 500624 - DNA, 1035 bp, Homo sapiens
  misc_feature (503)..(503): n is a, c, g, or t
tttgcgggataatgtaaaaaaaaatatgaaatgacgggaaagaggaacagaggaccatgacaacagtcgtggctgtattttcttcatcccttatacctggttcgtcagtgctgggaccgcgttgcggcaatcgagcgtttcccccggcggccaagcgctgtgggacccgacaccgttttattacttgcgacgccttgaagttgtcttgccttgggcaattgtgggcctgttcacttcggagggttttccgataaacccttcttgcggctatcaccggtccaataccgaaaccacggttccaataaaaacctgtcttggggcgcgcgggaaaaaatcaccaaattttgaacagaagcggtaataacctcttccaaaaaaaaaaggcggggatctttctcccccgcgagagattgaacgtgttgccccccagttacgccctcgtcgcaggagggttttcacatctcccgcgaccgctttattcttaaagggcctcccaatgagancccacccttcttgtcgcgcccgcagtccagtggtaaggtcctcccaacccctgtctccatacaacaggcttctataacgcccccttcggtttgggctaaaacaaggcgggtttcggcccatttcaaccaggcaccccctcacataatatgccttttgtgaaatataacgcgcatcttctcggtgtgtgtataggtgctctcctcttattcgtggtgtgccacgactggtcaagtaaagcccgacataaatattgcgtgctgcaccgccgcgatgttgaatcctgaataaggaaccaccgcgggaggtgctcttctgcttggaataatatacgtccacagacggatcgcgcacactcggttatttctttagtgctcccagcaagacgttctaagacgtgtatgactcgtgtcccgctgtcaggccccaaacaatgctgggctgccctgctgtgtgcgcacactgcgagagggcccacaggtttttgaaatagtttaccaagagcgggacaaaataccccttcccaacaataac

SEQ ID NO: 500625 - DNA, 142 bp, Homo sapiens
caagtaatctgagcttccctgacatgcccaccctggacacatcccgttcagcctcatctgtgagtcagcactgtggtgaaagctgcagtggcctgatgtgcaatctcaggaagcacagagtccaacaggaccatgaattctt

SEQ ID NO: 500626 - DNA, 342 bp, Homo sapiens
atctgtaccatgtgatgatcagtttttccattcttttttggttgcctgtaccatgggtcatacctatgaaatcattgacaaacttatgtcatgattttcccccatattttttttctgggtttacagtttaagtggttatatataggcctttgatccattttgagctaattttggtatatggtgttaagtgtccaacttcattcttttgcatgtggatatccagttttcccagtataattggttgaaaagattctactctccccacgaataatctgggtacttttttgaaaattatttgaccatatatgttagggattatttacggggctccctggacacgaa

SEQ ID NO: 500627 - DNA, 148 bp, Homo sapiens
  misc_feature (56)..(56): n is a, c, g, or t
  misc_feature (75)..(75): n is a, c, g, or t
  misc_feature (144)..(144): n is a, c, g, or t
aatcttaaaggttgtcttcataactttcagcactcagagtttacataagtaagccntgggtttaccctacccacnttttcccttatttttaaaatatctattccccaaccattgtctttagtaagtcactaaaatgacagtcantcag

SEQ ID NO: 500628 - DNA, 965 bp, Homo sapiens
gcggggttctcgccggtcctgcgggtcgctgctcgtgctgtgggttagcagcaccctgagcggagcggaagagctgcccgccgccgcgtaaccccgaggcctgagactcctggcctggcctccttgtggcccactgactgcctgccccgctggagcggacccatgggcctgagtgttttgtgtgctggggcctcaggctgagcgctggctgcagcctgtcccccatcgtctgcgccctgcgggcctggccctccccgtggaaggacctgcgggcttcgtgggccccacgctgtgggtgtgctgactcctgccacacacacatgctgtgtggcctgcggtgccttggggcgtgcagcacagccattctgctcgggctgcgtgatgctgaccccgctctctgtgcacctacttttgctgcgtttggtgctgagcctgaagtcccaggacatggcggctgagtggtggaaagatggtgtgaattggggtgggcagatacaaacttgaaagccaacatggacccgggttggcaccttaatggccgcctgcgcctttgcctgcagccccgctccctgggtcacccgaaggatggagcatggagctctatccgggcggcagaagcacccgagccacgctggagcgaaaacgggtccctctgggcaggagaaagctttgggcccttggcttggagcacgagtcacggagaccaccgccaagcgcctggcactgtagccaagatcccagcgtcgcctcgcaccgttctaagactgttagcgcgatcctcaccgttggccgagccataagccagaattgacagtggggcacgcggcgctcacggtggcacagggtactgccgtgtacgccaatagagacacgttcccaagtagtgggttaggagcgcaggcgccagcgtctgacctagacagaactgcagagtcttcaaccgtgcacgcccacagcacacgctg

SEQ ID NO: 500629 - DNA, 759 bp, Homo sapiens
gtctgcactggtcttcactaactcgttaccgtggatcttttgacttcatttatttcattgtgtaacgacatctatgaatgcgttatctaccttgcctgctcctatgccacagtgtacctgatctacgctgaaatttaaggcaatctacgatggaaatcatgataccttccgagtggccggtttctggtggtccctgtgggaggcctctctattgtattgagtgtaagtctgcgattttcgtctcgctcttggagactcctctggtagcttctccttctacctggagtccgtggctatccttccgtagctgtttatgatcagcaagactggggaggccgagaccagtcagccatccactatcctgttcttcctggagcctcttatcgtgtctttcgtactcttggtcaatctgtgatctggcgcttctactttgagggcttctttgacctcatatgctagtggtggccggcgtattccagaccatcctatactgtgacttcttctacttgtacattacaaaagtactcaggggaaagaagctcaggtttgccagcataagtgccatcataccatcaccagcatctgtccttcagggtgctcggacagaattcttaccacagctgaggcctaagatgcttgatccggacacctcatgacagcttaactctgtcgtatgctgatagtcatcagtggctctgtaaaaacgcataggaaaacgagcccgaaaggtctcttgcttaatgcagtcttggccttatc

SEQ ID NO: 500630 - DNA, 362 bp, Homo sapiens
actacgaagcatgctggaatggtctggggctgaagaatctctttaggcgagtcttccatggcacctacttgaagaacttctgttcaatagccaggcttctggggaccacgacgtgcaaacaggtctcttcagtttgcagtcgaagaatcacttatcctgaagctgccaacagatgagctcatgacacccctcacagaagaagaagagaaagcaccgattgtgggctgcacactgcaggaagattcagctgaagaaagataactcttccacacaagtgtacaactaccaaggcctgcgaccacccagagcgcccctgtgacaggagctgcccctgcatcatgactcagaatttctgtgagaag

SEQ ID NO: 500631 - DNA, 156 bp, Homo sapiens
ggtaccccgtgcttagttgtgtggagcgattgtctggttattccgataacgaagcctcacgaagcctcataatcgagaccctgagcggatcctactagcagctcgaccctgcaggacactggcggagtcttgggcgactggcctgttcgtttttac

SEQ ID NO: 500632 - DNA, 438 bp, Homo sapiens
aaaaaaaaaaaaaaaaaaaaaggtggggggggtggcgcgggggaaaaaagtttcaattcaattcaccccttggagtcttctctgcccctgaaattaactctaagtccttagagtaccaaaattaacctgcagagggaccacgaattgttggttattttgaagcgctaatttttaggatccccctcccatccaaaacagggatgaatagttgaggaacaccggagcgggccctggcccttctcggaacgttgcgctgacctaacatgacgctggtccgttcaaacgtcgcagttgtggcccacacagagcccagtctgttccagaggcgcgccctgcacccctctgcctgcccgaggtcttccctcccctccgctccccagaaacgcacccactgagacatgtgcggggagggggcacgcttactcccacatcccgccc

SEQ ID NO: 500633 - DNA, 573 bp, Homo sapiens
ggatgcagggccagtgtcacagagctgtgcaggccagtggagctgggcctgtcccacaaaacattcttcccttctaggactctgggcttataataggaggggctgcatgtgagggtctctgagatgccttcaagggcttctccccatagtctagtctattagcacttggttccttttgacttatgcacatttcttcagcctgctagaattattccctggaaaaatgggccttcttttactatcacatgtagcaggctgcaaatggttccaaatatttacgcttggcttcccttttatatacaagttccaactataggccatttctttgtccatgtatatgtgataggttgttagaagcatgcagggcacatcttgaacattttgctgcttagaaatttcttctgccagataccctaaatcatcactctcatgttccaagttccacatatccttagggtcaggagcacaaggagccaagttcttagctaaggtcattagcagaagtgatctttgctcctattcgcaatcagttcctcattgccctcttagatctcctcaggctggacttcactg

SEQ ID NO: 500634 - DNA, 157 bp, Homo sapiens
  misc_feature (150)..(150): n is a, c, g, or t
ctacagcgttaagtcctgtgactcatgtgatcctataccccagccttctgaatagctagaactattggcgcacgcatccacacccagctaagtttttaaattttttggaggccatgcacattcggctcacacctgtaaatcccagcaccnttgggag

SEQ ID NO: 500635 - DNA, 427 bp, Homo sapiens
  misc_feature (232)..(232): n is a, c, g, or t
  misc_feature (269)..(269): n is a, c, g, or t
  misc_feature (403)..(403): n is a, c, g, or t
ccgagcccacacatgtactgggagaaggacgggatggccctggacgaagtgtgggacagcagccacttcgcgctccagccgggccgcgcgaggacggcccgggcgagctggcattgcgcatcctggcggactcggatgcacggattccggcagtctacgtgtgccacgcccgcaacgcgcacgggcacagcagcaggcgggggcgctgctccaggtgcaccagccccccganagcccgcccgcggaccccgacgaaggcccccgcgccnggtggtggagcgctcaagtgcgcgcctaagaccttctgggtgaacgagggcaagcacagccaagttccgctgctacgtgatgggcaagcccgagcccgagatcgaatggcactgggagggccgcccgctgcttncgggaccggccgccgccttaataa

SEQ ID NO: 500636 - DNA, 958 bp, Homo sapiens
gatttttataatctttaaagtaacctaattagtaatacagattacttttacaaagaaaacatgaaactcaggtttacaaacaaatcctaccaagcctttaggggaaaaaaaaagttaatttcacattagtactgcatttcattgattataaaaacactctccccccaagcacatacatattctgtcatctctgaaattgagttgaatcttaaattgatggtgttttacaatctctcttggtcattgtcattgttaaacagtttttttaaatcattctgagtttggaatgtgtgctgtatatctttttttttttttgggagcatggatgtctcactcttgtcgcccaggtctgggagtgttcgcatgtgacgccggagatcacggccattggcatctccagcctggggcggaacagatgtcgaggactacttctcaaaagacaaaacaaaaacaaggcgccaaaataaaagggccatctttacgcgccacaaaacaagatttttctcggagaagaaacccccctcaacagccgcgcaatacccccgggtgtgcttctgagcggagaccacttctagaacaaaaccctctctcaagcgcttcttttacaacacccgcggtcttgcgacgcggcacaacaacccgcttctatcctgggcgacttttgtttttttttccacacacgtgtgatgaaaacatccgccggtgttgacgcatgcggaacccaccgtgttagacacagcacgagggtcggggcgccgctcaaatgatgaatgtcggcgctaatgttgctccaacacccacacacgcagcggctctccacagacgttctgcggaggtcgcgtacccacgtggtactcgtgtgtcggaacacatcacataggctctcccactttgggtgggtgctaccaccattctgtgccgccaaacacattcaacatcataatctcgttgcggcgct

SEQ ID NO: 500637 - DNA, 194 bp, Homo sapiens
aagacgaactgctggcgcacctgtgacacgtgcggcatcgactgcctggccccgacgatctgctgatcaccaagtggcgccaccgaggccatgcagatcgccctgcggtctgtgcggcgcggccgggcgacaccatcatcgtggaatcgccggtgtacttcggcttgctgcaggccatcgagcacctcggcatg

SEQ ID NO: 500638 - DNA, 781 bp, Homo sapiens
  misc_feature (192)..(192): n is a, c, g, or t
  misc_feature (234)..(234): n is a, c, g, or t
tcctccattaaactttttaattggggtcccaaattcctgggacaaattttgggccaagtggttcccattaaaaagtcctgttttaaaaacctaataacttaaaacggccaccacgcaaaaagagaaaacaccaagaggtggtcccacgaaaaacattcctcctttctccttctcgtgaaggaggtttaaacngaagtggctatgtgtttcatccaatttacaccgagctctctntatcactcacttaacactttaaagttgtgggccccacagtgtggaagcacaacacgagttctctgtgagacacgcgttctctctcccacccatctgtgttttaacagagatgtgggtgggtggggcaggagttattaagggcgagataaatatattcctaattaaggctcttctctagagaggtctattctctggggcgcaagatcttggggtgagacctcttggcccaggtctccacaggacaaggctcttttctgttggtgtgcccactcctgggtctttctgagatgagcaccccacaacgggaaaaatctgtgcgtctgtgctctctcatttattcaccgagaacacagcgacaaaagggagacccacaaagagggcgtgtgaggatataggctctgtagaaagaaaggctctctctctaagccacacacagtgttgggcgtctttgtgcccagagagaaccccattttctcaacccaaagtgtgggcgagggacatctcaccccagagagtttttcagaaaaaattttttgggggggcccat

SEQ ID NO: 500639 - DNA, 255 bp, Homo sapiens
ggatcaggcgaaaacgttctgtgctggtacttgcgaaagcaagcacagaggggcagcccttcttcaccacagccggggagctctggtggaagacggtcttgcatatgcacacctaacctgtggtgtcaaactcagaggggaagatgatgtcgtgatgctggcagatctggcagatgaagctgcgctgggtgcacaggtcgcagtgataaacatgctgggaggcaaatacaatcagggccttaaggaatccttcat

SEQ ID NO: 500640 - DNA, 872 bp, Homo sapiens
gggaaggaggtgtgaaaggaggtcagagggacttcaggctcctgggctgagtgtgtctgggcctcaaggtcacttggaaagtggatctggaaaagtaacattccctaaaatgaagatcccaaatttactttctctggccgtgagctggttggcagagaaatgggggtgggtgttcacttccctaaagcagaggccagcatccaagctggtgctggagacggcgagtgggaagagtctgaagtcaaactgaacaagtccaagatcaaaatgcccaagtttaattttttccaaaaccttacaggggaacgttgttttcattggttcaccgaaaagcttcatttttttgggtccaaaaggtggaccgtgaaagctgttcagagcgccgagccctctgcgtctcctctggaagagaggcagaggccgaagctcttccccgaacggaaaattctccttatttaaaagtaagaagccacgggaccgtcaaattcattccagtgatgaaagagagttctctggagcttccaccccgacggggacgctggagtctgaaggtggggaagtgtctctggaacggtgccgcacacgttaccgggtaaacacgggacagctgaaattacaggtacccttttggtggacttggggtcaagagcaagggtcactcatgaacggtgactgggaccgaattgactgagacggccacgatcacacggggcagtgggtgtcctggactacaaagaacgtccgactgccctcctcttcctagcacgaacaggtgagactctaggttggatccagttcccgtcgtgccactgtccagctctcaccaacacagaagtaaccagccctgctgtcgtgctcatatatatatttcc

SEQ ID NO: 500641 - DNA, 118 bp, Homo sapiens
ggccctgtagaggatgtcttgtccttccccaccaccaagaactacgtcccgcacttcgacctgagccacggctctgcccaggttacgggccacggcaagaaggtggccgacgcgactg

SEQ ID NO: 500642 - DNA, 292 bp, Homo sapiens
  misc_feature (124)..(124): n is a, c, g, or t
  misc_feature (129)..(129): n is a, c, g, or t
gcccaaaaaaaatgacatgaatctttatttttccctgccagcttcaaggaaaaaaaattttttttacaatttgcatgagggatttttttaattgtatggactcatggttgtaaacccaaacgtnctggnccgtgcagagaaaaggagcaaaaaaccaagttttctgtttatcctgaggctttccccaatgttcccctcctgtgagccaaggaggcaaactgcccaagcttgtaaatggtttgtctttaaaatggacataagtggaacctttaataaaatgaggggaaatgga

SEQ ID NO: 500643 - DNA, 252 bp, Homo sapiens
tcccccggattaaaaaaaaaaaaaaaagaattccccttggtccccttaattccttttttttatcttcccccccccccttcccttttttcccccccccttttcccagggggttccctttgccatatatttcggggaatggggggccgggtaaacccgccctaacctgttttttcctaaggttttggggtccaaacccccggttttaaaaaaaaacgggggggggccttaaaaaaaaaaatcttttttttttta

SEQ ID NO: 500644 - DNA, 876 bp, Homo sapiens
tgcctgcggctactcaatgagatcctcgctgactttgactgagatcatcagcgaggatcggttcctggcagctggagaagatcaagaccatacggacagcacctacatggcatgccataccggcctcaatgactctacctacgacaaggtgggcaatgacccacatacaaggcactggcctgactttgccatgacagctgatggaccagatgaagtacatacaatgacgcactccttacaacaacttccagatgaagatacgggctcaactatcggccccgtggataggccgggcgtgataggggcacgacaagcctcagtacgacatctaggggacaataccgtgaaccagtggaccagcacgcactggacaagcacctgctgtgatacaccgaccgacatccatggatcaaccacaacgacatgtaccaagagtgcatggctgacaaacaatgatacacagactggagtgccagcgagccgatgagctacacaggtcacaaggggacaacaaggcacgagattagattggagccttagctatcactcaaaatgcgaacgagcctactccagcatcagtacagtcagaactgagaagggactaatgtgttcgcccagagcaaccacatgagacctccaagaagtgtacaatcagggaaggagacatgcctacacatcaggacggcatagcccgcgaaggcctgctgccgtggcatcataccccaaaatgaacatccactacccgcacgacactgaggcccatgccaacatgaccttgataacattagcacacacccctagggcacgtcaacctatagcacaccattccagcgccccctgcctcggccgaggacacagcacctactcgcccaaagc

SEQ ID NO: 500645 - DNA, 427 bp, Homo sapiens
  misc_feature (42)..(42): n is a, c, g, or t
  misc_feature (67)..(67): n is a, c, g, or t
  misc_feature (80)..(80): n is a, c, g, or t
  misc_feature (85)..(85): n is a, c, g, or t
  misc_feature (105)..(105): n is a, c, g, or t
  misc_feature (128)..(128): n is a, c, g, or t
  misc_feature (157)..(157): n is a, c, g, or t
  misc_feature (269)..(269): n is a, c, g, or t
  misc_feature (319)..(319): n is a, c, g, or t
  misc_feature (322)..(323): n is a, c, g, or t
  misc_feature (415)..(415): n is a, c, g, or t
tccccatgaaggcattcagagtccacctgcagacagcgagancccaggaaggaagttttctgctgtncccaagcaccttnaagtnctctcagctcgccgaggagnaccgctagagcgccttcccggtngagccctctgtcccacagggagcggggancagctttgctgggccctacctgcatgcccagcttacccctcattctcacagcacagatgaggttgagaccatgcagtcaatgcattgcttaaggtctcttatttacaaaaanaaaccttaaacatagtccgctgtcattcagacattcagagaatggttggncannaacaatgaccaagtattgcttggcttaacttgaaggcctgctgtctccttctgggggtcagggacgcagctccaccctcaccactagcccancctgcccgtgga

SEQ ID NO: 500646 - DNA, 210 bp, Homo sapiens
  misc_feature (191)..(191): n is a, c, g, or t
acctaaattatataaaaataagtcagtctcgttgtattctcttatgtacttcattgacctataagattctctaaaatacaccctttgctctatccattgaaaagatacatctactgtcctacgtaatattattttttctgaacacttaagaatgaactgaatcacttcacaattatcctagagcatacctnttttctgtgcccatttcaa

SEQ ID NO: 500647 - DNA, 132 bp, Homo sapiens
caggatcttacccgactagcccgacaggatcccctacctgcacggacacactgactgagtatgcctcgtgggagtgactactgtggcctgccctgccacaccaccacctaccgcctagcccaacctgcgtgg

SEQ ID NO: 500648 - DNA, 490 bp, Homo sapiens
  misc_feature (82)..(82): n is a, c, g, or t
ctaggtctaagaacgataaagggagtgagaatctccctcgccgaaagactaaggtttcctcctcaccgttcgtcggaggagngttagtcgggacctaagggtaatccgtttggtgatctcgatggaagaaagggttaatattcccttactcggtatgttaagtgatgtggagacggagaagtgacagtcctgcctactgttggaatagtaggttaaagggtgtagatattgatcttggtaggcaaatccgccgagagagtcgaacctgatagtatgtgaatccttcgggtgcagcaatatggacgtaagcaggctcccaagaaaatccgctaaacgttaatagcatatcgacccgtaccacaaaccgacacaggtagttgggttgagtatactaaggcgctcgagttagccgcggttaaggaactaggcaaattgggcctgtaacttcgggataaaggacgccgtgtggcgacacaacggccgcagagaa

SEQ ID NO: 500649 - DNA, 243 bp, Homo sapiens
gagcaaagcatccacagaagaggctctccatatgtctttgtaagacctagacaatatagagattatgaagctgagttaacaatgggaccactgaacttctttccaatggaaaactcacggcccagtcccacaggaactagagcgcataccaaacaacgatgagaaaggaagggccgggtggctctaccaaacagttcaggtccactagagtaatgaagcctggtgagaaagcgaactcctgaa

SEQ ID NO: 500650 - DNA, 405 bp, Homo sapiens
  misc_feature (20)..(20): n is a, c, g, or t
  misc_feature (34)..(34): n is a, c, g, or t
  misc_feature (135)..(135): n is a, c, g, or t
  misc_feature (139)..(139): n is a, c, g, or t
aagtgccccagttgttgaanttgtctggttaccnatccttgtgaacaaaggagggtttttggtctttctttttaatgggtctgcaatttcagagaattactgtataataaaaactggagtgttggctgggtgcangtcntcacgcctgtgaatcccagcactttgggaggccgaggcgggtggatcacaaggtcaggagagcgagaccatcctggctaacatgatgaaaccccgtctctactaaaaatacaaaaaattagccgggcgtggtgcggtcgcctgtagtcccagctacttggaaggctgaggcaggaaaatggcgtgaacctgggaggcagagcttgcagtgagccgagatcgtgccactgtactcaagcctgggcaacagagcaagatgccatctta

SEQ ID NO: 500651 - DNA, 909 bp, Homo sapiens
gctttgcgaaggcgcggccggaggacacacaggcagtggacttcgtctggctccgcacgactgtgactgaggtctgctagagcgctttggtctctcctgtgcacagatatggcgatacttgccttgaatggacagaacgcatgtgcgtcagtctgcggacacgaagaggcgacaggtctcgcaaacgacgcaagatctactcgtagctggggtgttggaaccatgtcggatatggccgtgtgctatcaacattctggggaatagtctcgggcgtgtatgaatcctggcgtcgttgtggatgtttggggacagatacagccttaaaatgggagaaatgactggatctgcagactatgggagcttatggctctcagacggcctaatcagttgttgggcacgataaacgattattctgcagaccacgccaatgactaagatagtgctggtaactgcgggagtccggcagtgcgagaggtggacgcagtccgtggtcatctcgggtgcacagaattgttgactgtctgctgttgcatgattcctcagatcgtgcactgtacaggctcctgattgctatcataattgtggttgtccaggccacgtgggatcgattctgacgtatgttactggagactaagtgggattacccaaaagcgggtgaagggaagcggaggcaaccggatgctggtagaattcgatagctcgtgggcggaacgtgggtttcagccagcgggcaggacgtgtggggggaaaggcgaccaatgggcggtcgcccgggtggacgggccaggggcccgggtggaccgcaggaggcgcctcgcggaggaagacgccaagggggagggcaaccagaaggaacggccggagggcacgagccaccagcagcgccgcgggagaaacgcaaaacccaag

SEQ ID NO: 500652 - DNA, 1291 bp, Homo sapiens
tatggggggaacatctgtttttattggaggcaccaaaacaaaaggagggccccaagggggggtgtggggcgtgggggcaagagactgggcgtggaattgggggcgcaggccaaaacccgagaatgggcgcaaaaaccccaaccccacaaaggtctggccctgagaagtgcgcatggccgctggtccgccaggggacagggggaacaacaggggaacaggaggttctacacgagggctgggtgggacaaacctcccctccccacaaatgatgggccccacaaaaagccgacacaagggcacaccaggtggacacgggaaaccccaggtaacaaaaggcacaggaaaaaaatcgctctcatgtgagacacggggacacacctgtggggagacctctgaggacacactatggtcacacaggggagatatggaggcccccgagatgtgtggaggcaccggaaagagatccaccaggagagaacctctaggtcctcatatacacggaaagtgccccaccaaggagaaggcacaatatgtataactccacaccaccaaaaacagtgtagaggagacactggtgagcccccccacctgtgggcggggaccaaaagcgcaacgggggcgcaagtggcgacccacaggtgtgggcacgagcgcgacaagagggcgagtgaggagacgcacgtaaaaaccgggggggagcacccaaagggggcacaacaaacaatatacaagagcaaacgaatagaaggagaaagtaaccacaggggggtgacatccacccaactataaccaagtcggtgggggggcatctatcacacgacaagaaagggggggagggagggagcaaatataccaactacacaccattgaaaaaactcgagggggaagaaaaaacaccagggggcgagacaccacgagaggctactgtagcaggacaggcaacaaagggcgaagccacaaaaacaccctgaataaacgaagggtgcgctggtcataagaaaaggaactacagagagatagtatacgcatccgaggagaaacacacaaagatgatgggtgtagagaaaacgatgtggcgccaagagaaacactcagctaaattaggaggaggcagacattcaggaatattgtggcacaaacaaaaatgttgtcgtcggaacagatagtatagatgatgccactttgtggagtacgcaacaccaaaacttatgggatgcattctggggggatatgggggacaagcgggagggaaaaaagtggtctgtcatctaagtgtgtgggaccaaactgc

SEQ ID NO: 500653 - DNA, 250 bp, Homo sapiens
  misc_feature (168)..(168): n is a, c, g, or t
gacccgcacggtagctttgtcactaagcccacgctgggactggttggattccaaggaccaagtcatgggacccggggtttcctacttggttcggtacatgggttgtgtggaggtcctccagtcaatgcgtgccctggcgttcaagacccgtggctcaggtccgcaggnctgccttcagtctggtgtgtacggctgtgcggggtgctaaggggtcgacagggatggacgacaatgccctgtagactgtcct

SEQ ID NO: 500654 - DNA, 484 bp, Homo sapiens
ggctcagaggtcgtacacctgttccaaccgtgctgacagaatctatcgttttcacgcctttaagaatgaacgctgatataacggccacgagcgcctgggcgatgaacgtgacggcaaaggtctgaggcggccagaggtgcatcgttccggaaaccagcataggaccaaccacgccagctatcactcctccccccataaccagcgacagggcccgggcccggcgttcgggcgtaacgccatccgttgcggcaaaacgaaagcttagcgcgaccgccgcataggcaccgcccataaatgcagcaatgcagaacagcaggaatgagccgatgaagacggccagagcagccgtcagtccggtaatgacgcctgccccggtgccgaccataaaggcggccttacgaccatttgtccgcgccagtgaacctaacggcaagatacaggccgccatccccagaaacaacatggtgatgggaagagtggcagc

SEQ ID NO: 500655 - DNA, 140 bp, Homo sapiens
tcttctactgcatggatatgattcactttctatgagacagatataatcatatgatgtgttcaaggtctctcctctcagaggagacagcagatctgttgtacctcgtgacatgcgcgtagagggtacgagtcgatcgaatc

SEQ ID NO: 500656 - DNA, 750 bp, Homo sapiens
  misc_feature (16)..(16): n is a, c, g, or t
cgcccaatttgtgtgnaaatttaaaccccttgagcgccttgaactttataggcggttgcccacttaattgtgtgcggtaatcgcgccactgtcgtgggcccaggagagatccccgtttcgccgcgaccactgttattgacccgcgaagtaatggttgttacaaccacaggacatgttgtgttaaacacttatgtgggaaagaggatccccccttaatggtggtcgacagcccaattggtgaaatttagaccacgccaccacaacatccaaggggtctcacactccgaaaagcacaaccacaggtcccctggtaatatgatattttaaaaacggtatgtgtaatattgtaaattaattaaaaaaagttatatggaggtccctttaactttcttggagcccctgtaaatataccgctgcctggtgtggtatcctgggccgcttaccaaagcacgttagctgacggctatatttccacaatatattcccctagataatagtttgctcgctgctacctcttgggcctctaaacccaatgcccccccgttgtggtgatccaatacctcttctcgtgattaaaagagaatataatataaataataggtatatcctcaattttttgtcatcaaaagccgaatttttttgcatctactttctaaataataggttgttaaagtttaacgcccacacccccttacataattaacccccccccccttttaaaaaaaagaaaattttacacaatggggaaaa

SEQ ID NO: 500657 - DNA, 158 bp, Homo sapiens
tttacttttaaatatttagtccatataacatacaattatgccttcataatttcgggcctgtgtatgtacatgatgatacaagaaagcccaagacagctattagggcatggagagaaaacagatggcactattgtttttcaaaatccgttgagaagctt

SEQ ID NO: 500658 - DNA, 986 bp, Homo sapiens
gatcgtctgtttgagcgctattgtgaggatggcgaacgtggactggccatgataaagtcagagtcttcggaataagcgcacgccagcggtgtccgctgtcttgatctgagtgagtgcatcgtgaagttgctgagaatacggtctccatcgagatgcagatgtctctgcttgcttgcctgatttcagatgattgcgctcaaggatcagcgtcgagcagcatcatccgagggtccagagtaagaatatgattcggtgcaaaaaactcggtgcgaggtatgataacgcgattataggatgtataaagcggcgaacgggggatagacttgacccagacagatgatagcgaagcattgggagaatgtgctccagtaccatgcacacgtcgtgagagggtagaacacaaactgaagcaatgagtaggcattgctagtgagcaagatggcgcggtaagaagtagtgtgcattacaggcattacccattgcatacttggagggtattcgctacaagaattgagtcattatacgaacgaccacaaggtccttactggatatggagtggtagcgatgggcaacatcgaaaagctcaataagaatacacttgcaagtcggacaggttattggggactcctctgacattggctggaattagtgactttgacaaagacatattaggcaagcttctacgtgcatgctgctgttgactgctgcacgcccggtcagagtgtggtctgtggcatgggtctgctacttgcggctcccgaggggtgtcccgatgtaccctgggcaccggcttgggtgctgctgccaccttttgggcttgcacacctttcctggcagggattgctccaccagggaaccctgggacccccaccgttttgtggccggcaattcttccttgccaagggcgcacccatttggtggctccttctcgaggcacccaagggctcgtttccaagagggcgctggagagccttctctggacgact

SEQ ID NO: 500659 - DNA, 334 bp, Homo sapiens
  misc_feature (129)..(129): n is a, c, g, or t
catccagcacatggtcagcatggacaggacagcaagaggctaaccctctgcttatgtggaagctgaccccaagccacccttcacctggacaggatgagagtgtcatgtgtgcttcgcctcctggccctnatctttgccatagtcacgacatggatgtttattcgaagctacatgagcttcagcatgaaaaccatccgtctgccacgctggctggcagcctcgcccaccaaggagatccaggttaaaaagtacaagtgtggcctcatcaagccctgcccagccaactactttgcgtttaaaatctgcagtggggccgccaacgtcgtgggcccta

SEQ ID NO: 500660 - DNA, 454 bp, Homo sapiens
  misc_feature (95)..(95): n is a, c, g, or t
agtgttgatcagtttactagtatttttccaaacctgaagaatggtgaaagtttgtggtacagtgtggggaaaacagtaagtgtgggccccggggncggccggcgagcccccccgggcttgccggccccccgcaccaagagggggttggagtgtgtggtctctaaggcactgaatttcagtctgttctccatccatcagtggatatgtgagatgcaatgcaggggtgctggcctgtccctggtaatgagcgaggatatgagcaaagcagtgagtacagcctggaattccagctactcaggaggctgaggtacgagaatcacttgaacttgggaggctgaggtttcagtgagctgagatctggccactgcactccagcctgggcgacagagtgagactctgtctcaaaaaaaggattctacgactatgattccaagagtgtaaaattccaagatgt

SEQ ID NO: 500661 - DNA, 723 bp, Homo sapiens
  misc_feature (7)..(7): n is a, c, g, or t
  misc_feature (81)..(81): n is a, c, g, or t
  misc_feature (93)..(93): n is a, c, g, or t
  misc_feature (104)..(104): n is a, c, g, or t
  misc_feature (120)..(120): n is a, c, g, or t
  misc_feature (238)..(238): n is a, c, g, or t
  misc_feature (255)..(255): n is a, c, g, or t
  misc_feature (265)..(265): n is a, c, g, or t
  misc_feature (276)..(276): n is a, c, g, or t
  misc_feature (320)..(320): n is a, c, g, or t
  misc_feature (377)..(377): n is a, c, g, or t
  misc_feature (415)..(415): n is a, c, g, or t
  misc_feature (494)..(494): n is a, c, g, or t
  misc_feature (502)..(502): n is a, c, g, or t
  misc_feature (523)..(524): n is a, c, g, or t
  misc_feature (576)..(576): n is a, c, g, or t
  misc_feature (588)..(588): n is a, c, g, or t
  misc_feature (606)..(606): n is a, c, g, or t
  misc_feature (654)..(654): n is a, c, g, or t
  misc_feature (673)..(673): n is a, c, g, or t
ttctttntcttctgacatgtgctgggttcgggccattagctgtgccgtcgacaatagccccattcaccccattcataaatnctgctgctacangaagggaacancggctctcccagaaanggatccacctggaacacgagtcacctccaaagaactgcgactgtttgaaaatctgccaagaagaaaaccactcaataaaacctggataacccaggcccggaaataatagcaggatgtngtacttcaagaccctgnacaccctgtngatcacgaacntcccgtcataactcaagaaggcaaacaaccacgggtcaaccgangaccagtccacggcatagacgctgtcctcgtgctcctcgtaggtggcgatcacgttntcctgcaggggctccttgctcttctcttcagaacggtngtcctcctggtcactgatgtcatcctcgtctaccaagtcgccgaagcctccgacgagatggacaccatgttggaaaggntgactctnctgtcactgctgcccgtgagnnccagctggtcatgagagtggttgtagcggacgttccacacccagtgggagtnttcctccagggncttcacgggttcggtganatttcgggtgtcccagaacttcaccttacagtcgtctccgcagctggncaagtagtactgcttattnggattaaagtcaaggtcccgcaccagctgtccgtgggcattctctatgca

SEQ ID NO: 500662 - DNA, 161 bp, Homo sapiens
gtgggggcggcatctaaatagtaaaaaaatatgcaaggggaggtataaataatattatatgctggggtatcagtgactctagaggtaaacaaggactggagaaaaatagacaattctgcgaggaaaacacctgtcttgggactcacgccgaggtgttttcc

SEQ ID NO: 500663 - DNA, 951 bp, Homo sapiens
ggtgcatccagaatgtccagcatccaggaggtcctgaacggtcaacctctctatctatacaagtgatacaatgcatagggggctggctcctcccagaagctggatggaggctcagatgcgggggcagtgacaggtgagtcagctgctcttgggtgccgggagagccattcagtacaaccgccgtatgtgtcacagcgagtgggttctaggaaagtgcggagtttagatcatgctgtacagatacatcgatcagagcgctaagatgaaacctcagcctagaactcataggactgactgactggaaaggagggtttagtgtctgcttctatccacttatactatagtctgctgtgcgtccactgaggtcacatatatgctgactactaattgccttggggtctttgcagagggtgggggaactgaacccccgtatgacaccttggccttgtcctcagaatgatgagacaacggggagttaacatcttgtgaaagaagcccggagcgaggatatgcccagggggctgccagtcgtgggatatgcagtgcaaacgcatacaacgcttccggggctacaaaagacgagacagcctgagaaccttgcaacagataatcgggggaattaacaaggcacacaacacgaccattgacagtgggtaaaactgggaaatgtggtagagatagagactgaggttccaccagagttgagccaggcgaggcaccgaaccgtgtgacccgaggggagcacaacccgcacttgtacctccacaagggggcgggtattacaggcacaggcccacgggccgagatgagaccacctatagacaccgactcatggggggaataacggaaccaaaaagaacatgacagagaacacaaattgggcaacaaaggaccccagatatattgcacaagcaagggtaccgcaatgagcggaaacaggaaacaaagaaa

SEQ ID NO: 500664 - DNA, 161 bp, Homo sapiens
gcccatggagaaagcaaatgtaaaactggataagaaaatttttttggcagttcagccctttccctttttccccctaaatttttttttaaattacccagggaacccttttaactttccagggccctttgcccttaaagtcttttccccttgatttgtttcca

SEQ ID NO: 500665 - DNA, 124 bp, Homo sapiens
ttcgatgtgtgccagagttattgtacaaccacaggtgcgggcagttaaaattcttgccaaatgccgcgttgatagaacacttttctttttagatttataactcaaagcagcaatctttgaagca

SEQ ID NO: 500666 - DNA, 146 bp, Homo sapiens
tttggttggtttttaaatcataaaaagttttggtacaaaaagtgagtggttttttttcttcatttaaaaacaccagggtgtggtgggggagggagtgcaaacaaataacaaaaaagagtgctttggtaacatatattttccctgtg

SEQ ID NO: 500667 - DNA, 144 bp, Homo sapiens
tttccctcccaacaaaagccctggtttttgggttggagtgcagcacccccaaccaggttttgagctccttcccaggagcctttagtaaagacacgccactccaacccacacccctgcatttgttcaagctacctcccggggcca

SEQ ID NO: 500668 - DNA, 422 bp, Homo sapiens
gagccactctcatcgaggagatgcacggtccgatgcctaggacgctctctagagcaccagggctactggacagcagccgatgagagctgctatagacccggaatcacgcggaacagaaggtctgcacgagccagcacatcttgcacggccgattacgccataccatcttgtgcttgctgaccatgcatgcggagtaatccgtagcgagacatacatccggtatggtgctgatagcagaatgccacagtactgtacactcacgggtcatatgggactggagtgatacatgctgttggagatgatgcatctgcgacactactggtgacatgattttcattagcggctcgagctctgagggttatcctgagcctgctcactgcaatacgcctcactgtttacgacactacctgctcgaggacttt

SEQ ID NO: 500669 - DNA, 128 bp, Homo sapiens
  misc_feature (77)..(77): n is a, c, g, or t
gaatgcgtgtaggcagacttggttctacagtgagccttctctctgcgcagtgagtctcaaaggagccaattaaaagngggtgaagatgttcttccttcaatatgtaggccgggcggtgtgggtttcac

SEQ ID NO: 500670 - DNA, 173 bp, Homo sapiens
cctatcatatagtaaacccagcccatgaccctaacaggggccctctcagccctcctaatgacctccggcctagccatgtgattcacttccactccataacgttcctaatattgggctattaaccaacaaattaaccttttaccattgtagggggtggtacaaggggaaggcac

SEQ ID NO: 500671 - DNA, 118 bp, Homo sapiens
cttacccttctagcctccctcttccagtttaaaagaatgcttgtaattacatgggctctcctagatactccaggataatcttgtattaaggtcagctgatgggcacacattatgaacg

SEQ ID NO: 500672 - DNA, 1004 bp, Homo sapiens
acactacagcttttaaacagttccgacttcgaatctgactatcgtcgtatcccctaatctcattcaatttcgccatagaagaggggtaattatgagacatctctctcagtatcttggtgctgactctcactgtcgataatgcacattatcgtcatgtctggttctggtattctggaatgcttaccagaagcatttgtgtagagcctcagtatcccttggggctagtgcccagaggcactcttatgttctcgctgatgtactggcacgcaccgcatgatgtgcatcagtgatagccagacagcagcgtttgattattctctttaaaaacgttgtgttcgtccacaggatttaccattagcatccgaatctgattgcctaagggccagatatctctagcgaaatatgagggccattttataaggcagagtctcttctaggtccgtcccttttatttgttatcaagcgtagcgtaccaaacgtaaaaggcaataccatcgacatcatggatattctctgaacacctggaacgtatcattgcctttggctggctgtggaaggacatgctcattcaagtccccaatccaaacacctttggaatttcagcagcgatgtggggatcatacttgaggccaggatttgacacagaacactgccggagaaggccccagtttcgaaagttgggcctcagttttcccagaattgtcctgggtgccataagccgctattagattgtcgatgaatctactgatgcaatgtgtagcagcctaaaacaactgctgttggtaccgttaccgaatttgctgtaccaagcgatagaatctcggggatatgccataatgtcgccctcttcacgatattactgccttgaaatattgaaagccgactttcagttgaacccaaaaagaaagccatacaacggggaagcacagttaaacattcgaacgacgtttcgctgaactccaaacaaaaaagcaaaattgccgctcaaataacactcgcgacct

SEQ ID NO: 500673 - DNA, 257 bp, Homo sapiens
aattgtatcttaagaacataccatgaaaatatcagtgaattgtcctgatgattccctgttagttgatttaaatcctttctgaataaagatcagcataaacagtaactgaaggagcatgtatagctctttccttcaaattcaactagagccttttcaaaaagacattttgcctgctagtcagatacatttacatttatgcggaatcttttaaataggagacaattcagaaactgggtcacaggcctaaagttcaggag

SEQ ID NO: 500674 - DNA, 136 bp, Homo sapiens
cggttaaatccaaaacggcagaagcctgaatgagcttaatagaggggcatgtgctgtaggccagcgcaaccctgtacgactactacaaccccgagcgcagatgctctgtgttttacggggcaccaagtaagagcag

SEQ ID NO: 500675 - DNA, 448 bp, Homo sapiens
  misc_feature (386)..(386): n is a, c, g, or t
  misc_feature (401)..(401): n is a, c, g, or t
  misc_feature (429)..(429): n is a, c, g, or t
  misc_feature (446)..(446): n is a, c, g, or t
tgaaattttccattgcaggcatgtttgggcaagtcacctgtgtagtctgtcttatctatgaggctgtgggcatgtcttaggcaagcccccctgtgcaagttcccatatctgtgcctgcagcttgatttttcaggctgttcttttgtttaaaagaattctaccgagaacccaccctaactgcctgcctgactggtttcttcctttctcctctctcactccttctccagatgaggaaacaagatcagagaggggacagtgacttgccaagttcacactgaggatgagtccaccctgtgaccctcccctccttcaaaagagggacctttaccaaaggggattgttcattcgggggggcccttcaaacatccatattaggtgatggacantttggggaaggaggntttggaccaaaacccaaggaaacaggantcctaaggttttttaantt

SEQ ID NO: 500676 - DNA, 431 bp, Homo sapiens
acaattgttatatataattaaaagtcagaatcttaggtgataactgtcagacctctgagcacaagctaagccatcgcatcccctgtgacttgcacgtatacatccagatggcctgaagtaactgaagatccacaaaagaagtaaaaatagccttaactgatgacattccaccattgtgatttgttcctgccccaccctaactgatcaatgtactttgtaatctcccccacccttaagaaggttctttttaattctccccacccttgagaatgtactttgtgagctccacccactgtctgcaaaacattgctcttaacttcagcgcctatcccaaaacctataagaactgatgataatccaccaccctttgctgactctcttttcggactcagcccgcctgcacccaggtgaaataaacagccatgttactc

SEQ ID NO: 500677 - DNA, 572 bp, Homo sapiens
  misc_feature (172)..(172): n is a, c, g, or t
  misc_feature (181)..(181): n is a, c, g, or t
  misc_feature (184)..(184): n is a, c, g, or t
  misc_feature (200)..(200): n is a, c, g, or t
  misc_feature (205)..(205): n is a, c, g, or t
  misc_feature (212)..(212): n is a, c, g, or t
  misc_feature (215)..(215): n is a, c, g, or t
  misc_feature (221)..(221): n is a, c, g, or t
  misc_feature (226)..(226): n is a, c, g, or t
  misc_feature (231)..(232): n is a, c, g, or t
  misc_feature (244)..(244): n is a, c, g, or t
  misc_feature (248)..(248): n is a, c, g, or t
  misc_feature (360)..(360): n is a, c, g, or t
tctagtaggtcccccgtgcagtactggatgtgctggatcaacgggaaaagtgactgcgcatgactggggcccagctaggctgccaggacttgtgctcaccctctggctgaggagctgtctggctgctttccatccagctgggagtctggcaggcccttttttttttttcttngccgaaccntgnagggttcctctctaanggagnatgtgcngcngtgctnggggnatgtnnctcccggggtgnggcngggcggctctcacatacagaggcggaggggccaattcgttctcggccacagggatttgcctcatggtgtcccaaaaacaaatcgcagccagtttttccagaaatagaaaatncggcggtcggaggttaaatactccaggtaagtaagtttggggagggaagaccatttttagtgttgtgaagcctcctgatcaggaaaccagaaataccacttttatggaccatgaatgtgtgggttcttgactctgaggggcatttggagtcaatcagcgtagggggatgtcaaaagcaggcaatccttgtagccgagagaaataaaggcttc

SEQ ID NO: 500678 - DNA, 413 bp, Homo sapiens
accccatgctcttataaaaatacaaaaattacctgggtgtggtggctcacacctgtacgttccagctactcgggaggctgagtgcacaagaatcacttgaacccaggaggtggaggttgctgtgagccgagattgcgctactgcactccagcctgggtgacagagcaaaactccatctcaaaaaaaaaaaaaaaaaagcgggcggtaacgtgtttgctcgcatattatattggttatcccaataacctggttttgtggatccagacgctctgggaaaatgtattaccagcatgaacctaacatttctgtcactcgaattcctttctctcctccccaccaccaagagtcatatggtttcaggctgcgacattcatgtccataggggttgccttgtacacagatcaaagaaacag

SEQ ID NO: 500679 - DNA, 149 bp, Homo sapiens
atagctctccatgctttctctatgagttgacagctgggctgaatgctgatccagctctgattcccatcttctcattttctgcggacatcttcatggttttgtaactttcatgttgaaccatgctctgtctcccaacgagtccattctgt

SEQ ID NO: 500680 - DNA, 410 bp, Homo sapiens
cgcaggggtgctctaaagttctgagtttccatctgctccagcgtttcacgcagatcggacgtcgcctggtcgatattgtgctgcatctcttcgtgataagcagccagcgacattggcatcgagttgataccgtttttcagcatatccagctcgccgagcataaatccttccacccggctgtcgagttgcccgcgacggatgcggtcgacggtattcaccatgttgcgaatcggaccggttacatcgcgcattaagcggcagccaaaaataagcgcaataccggtacaaaacagcatcatcacgctggaaataaagatctctttatattgctgcaagcgaaccgattttagatccaggtccagcgcaatatatcccaacatattttgactatttgtgggcatcgctacttt

SEQ ID NO: 500681 - DNA, 737 bp, Homo sapiens
cacatctgtaatcccagaactttgggaggccaaggtgggcagatcatgaggtcaggagttcgagaccagtctggccaacatgatgaaaccccatctctactaaaaatacaaaaattagccaagcatggtggcatgcacctgtaatcccagttactggggaggctaaggagaatcgcttgaacctgggaggtggaggttgcaatgagctgagatcgcaccactgcactccagcctgtgcgacagagaccccggttcaaaaaacaaaacaaaacaaaaagataggccgggcgcagtggcttacgcctgtaatcctagcactttgggaggccagggtgggaacgatcatgagatcaggagttcgagaccaacctggctaacatggtgaaaccctgtctttactaaaaatacaaaaattagctgggcatggtggtgtgtgcctataatccctgctactcaggaggctgaggcaggagaattgcttgaacccaggaggcagaggttgcagtaagctgagattgtgccgctttaccccagcctgggatgacagagcaaagactccgtgctgaaaaaagacaagacaaccacacaaaacaaaaacccgggggggcgggaggggcccgcgaaaaaggttctaagaacagggcgagggacgcgcgcgcccacatgggcacgggacacaggcgcaaacggggacccaaggaaacccgggaacacgagacaaaggcaaggatctccaa

SEQ ID NO: 500682 - DNA, 598 bp, Homo sapiens
agcgggttcttcttgttggcctacctgaatacatgctgaagaatgtcctgaggaccctctgtcagtctgggtacagatatgctatagttcagtggcacatggtatgaggagagagctgcctgcagagagcgtgagtcctgatcccttgtcccagggcaaaagagtttcagaggaagcccaactccactgggcggtttttcaggacctggagaggagaaggagatgaagagtgtcatttactggtttcctcagttatctcaagaggtccacgtctatctctctcatgaagcgtaagcactcctctgactcagaacactcagttaactgaggtgctttttaaacagagatatggatttagatcatggagcatatcctctcacccgtgaccagtagccaatattgcagaacagctgacagaaatgtggtagggatgctgcgtgactacctgggcattactctacagagctggatcacagaacctaacttcattagcatcatagtctaatgagataactagtgagtgcaataaatacttgatgactacgaataaagtcagcaaagaaaacagacaaagaaaaaaaaaaattcttccagggcg

SEQ ID NO: 500683 - DNA, 790 bp, Homo sapiens
ggtgctggattacaggcatgagcacctggcctaatttgcctggttgttgtttgagtcaggatctccctctgtcgcctagtacagcggtgcaatctcagctcactgcaaactccacctcctgggctcaagtgatcctcccacctcagcccctggagtagttggggttatggcgtgcgccaccatgcctcgctaatttttttattttttttgtagagatgggttttccccatgttagcccaggctggtctcgaactcctgggctcaagtgatctacctcggcctcccaaagtcctgggattacaggcgtgagccatcgcacctggcccaattcgccatttttaaatgatgaggttggtcatttttcctatcaattggccatcttatatgtggtttatgtgttgtcgacatttttgtccttttcaaaggggactaggaaagctagcaacagaaaaatgggcgtttgttgtgacttctgaaagtcagggactcgaagggagacaggagctttccggagagggccctgctgtggggggacctagactggagaccagagggagggctgcaagcctggtttacagatacacgtaatgggaatggttctgtgtgtttcctcgagtattgttgagtgcctactaagtgccagacaccatacctggtgtctcacctgtgctcaggtctttagggctaaggctgtacagtactaaccatccattgtcaatgcgaatgaggccaacgctactgggcacagaaccattagtgagggtcccaaggccagcctgtttgcaccctg

SEQ ID NO: 500684 - DNA, 449 bp, Homo sapiens
tacgggcagtgaatcgagctcgtgtaccggggttgcttggtttggcagtgcagtggctatctcagctcactgcaacctctgcctcccagcttcaagtgattctcctgcctcagactcctgagtagctgggattacagatgtgtgccaccatacctggctaatttttgtttttgtttttgttttttttgagacggagtctcactctgtcgcccaggctggagtgcagtggcatgatctcagctcactgcaagctctgcttcccgggttcatgccattctcctgcctcagcctcctgagtagctgggactacaggcgcccaccaccacgcccggctaattttttgtatttttagtagagacggggtttcaccgtggtctcgatctcctgaccttgtgatccgcccaccttggcctcccagagtgctgggattacaggcttgagccaccatg

SEQ ID NO: 500685 - DNA, 606 bp, Homo sapiens
  misc_feature (139)..(139): n is a, c, g, or t
cccctcccccccatattgccaagattttatgggaccgcgggcctttttgcccccggcctgggaaccgtgggcccatgggcactttcatatgcccccccaggtcctttagtcccagggacccccagagcacccccaagcntggggttgagtggcagaaagctcccccttctcccctgctccaggaggtttgcagggagctcaagcccttggggagggggatgccttcatgggggtgcccccacaatttgttttatcccccccagccgggccccggcctttatgttttttgtaagataacccgtttttaacccaaagccccgggctgtaaataagccccgggctgctgtaaatccaggaaaaaaaagctttaggtgggagcggggctgggaggaagggatgggcccccccttcctgggcaccctttccagcccccgggggggttttttttcctcccccccttccccatggacataaactgtccctttaggaagaagcccaatgcccgattttgccctttaaatttggggattttcctggatttataggatgggccttttttgattaaaatatttaatatattgaataaaaaatagccctgtggttgga

SEQ ID NO: 500686 - DNA, 652 bp, Homo sapiens
  misc_feature (240)..(241): n is a, c, g, or t
atcaggtgggtgttagtggtttcctgggtgtattgtctggtctcctagtaggtctggtgagaatagtacaaggattagtaggattagtattataaataaggcccctagaatgtctttaatagtgtagtatgggtgaaatggaattttgtctatgtctgatgagattccggtagggttgttggatccggtttcgtgcaggaataggagatgtacggctgcgagggcggtaatgatgaatgnnaggataaagtgaaaggcgaagaatcgtgtgagggttgctttgtcgacggaaaagccccctcagattcattctacgaggtctgttccgatataagggatagctgatagtagatttgtgatgaccgtagctcctcagaatgatatttgtcctcagggcaggacgtagcctatgaaggctgttgctataacggtaaatagtaggactactccaatgtttcatgtttctaggaatatataggatccgtagtataggcctcggcctacgtggatgaataggcaaataaagaacatggatgctccgtttgcatgtaggtagcgaataactcatccgtaatttacgtctcgacagatgtgtgtaactgatgagaaagctgttgttgtgtctgatgtgtaatgtattgagtctcacgga

SEQ ID NO: 500687 - DNA, 185 bp, Homo sapiens
catgcaggatccccctcctaggcaccagacaattataccctagtcctaccccttgaacacccctccccacattaagcccgaatgatatttcctattcgcctacactaattctccgtatccgtcccttacaaactaggaggcgttcttgcgctattactatccatcctcatcctagcatagaatcg

SEQ ID NO: 500688 - DNA, 1004 bp, Homo sapiens
acaaacatggaaaaacattccttgttcaaggataggaagaatcaacattattaaaattgccatactgcctagagcaatttatagattcaatactattcctgttatactaccaatatcattcttcacagaattagaaaacaaaactattttaaaattcatatggaaccaagaaagagcccaaatagccaaggcaatcctaagcaaaaagaacagctggaggaatcatgctacccgacttcaaactatactacaaagctacagtaatgaaaacagcatggtaatggtacaaaaacagactcatagaacaatgaacagaatcgagagcccagaattcatgctacacagctacaatcatctgatatttgacaaagtcaacaaaaataagcaatggggaaaggactccatattcaataaatggtgctggaatacctggccagcatacacagaagactgaaacaggaccccttccttataccatatgcaaaaaaaacaattcaagatggattaaaagacttgaatgttgttaaaaaacttaaagccaaattaaaattttaaggcaggtttaattggagcaatgaactgatatgcaagtcgggcagccccagaatcacagcaagattcagagaagactccaggatgctcgtggtcagaacaaatttatagaacaaaaaagggaagtgacgtacagaaaatccgaaatgagtacagaacaactggattggttacagtcatcatttccttatgtgacccttagcagatgagtggtgagtatggtgcggattggcacactgactatgtaagactggtacctagtaagtgtcgactgtactatagtagggggagtcctcacgagacaattgagaggatctccagcatagcaggtaagaacaagagtaacgggagacagagcaggaaagagagtaagaaacacaacaaaaggggaacgcaaacaaagaggataacaaaagagacagacgagatactttatgacgggacaaagacgc

SEQ ID NO: 500689 - DNA, 276 bp, Homo sapiens
  misc_feature (179)..(179): n is a, c, g, or t
  misc_feature (252)..(253): n is a, c, g, or t
cctagggtcagttttgcaggtggtagccatttaccaagatagttgtaggtaagaagggcagatttattagagaaattgtgaaaatatgttgcagtgggcagctcagcagagaaggggctacctgcaaagaggcgagggctggaggaaagttttatagggtcctgcgtgaagggtgctancagtgtggacatgaaggtcacttgtgccctgcaggttgtttgtgattagctgtctctaacaattgttcatacnnaataattgttccattattgttct

SEQ ID NO: 500690 - DNA, 913 bp, Homo sapiens
  misc_feature (281)..(281): n is a, c, g, or t
  misc_feature (291)..(291): n is a, c, g, or t
  misc_feature (329)..(329): n is a, c, g, or t
  misc_feature (331)..(331): n is a, c, g, or t
  misc_feature (333)..(333): n is a, c, g, or t
  misc_feature (458)..(458): n is a, c, g, or t
  misc_feature (480)..(480): n is a, c, g, or t
  misc_feature (673)..(673): n is a, c, g, or t
gcttctgctggcgagggctttccgcagatgtgccgctcgcggctatggcgaggtgcgctgagcaggtgtcggcgctcggctgccgggccgatagactggacggaaagccttgcgtccgagtctcgcgtggctcctggcccccgctccgagctatgagctacggccggaccgcgcttccctgactgtggacgggtatgactcttcccactctacaggtgtgactaagcgtagagacgtagccgctaccgtcagctcctgacacgctgaggcgcgtcttcganaagtacaggncgcgtcggcgacgtgtacatcccgcgggatcgctacancnanggagtcccgcggcttcgccttcgttcgctttcacgacaagcgcgacgctgaggacgctatggatgccatggacggggccgtgctggacggccgcgagctgcgggtgcaaatggcgcgctacggcngcccccggactcacaccacagncgccggggaccgcaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgnacgaaggtccaagtccaaggtcctcggcggtctccagatctcgttcgcggtccaggtcccggtctcggtccaggagttcctcccccagtgtccaacgagggaattccaatccagggtcgcgatcgaaagagtcaccccaagtctcctgagtaggacgagcggtggtcttttagaaactgagtattcggaaaaggggtaaacggagacttggggaaaaggacccattatcacatgagaaaa

SEQ ID NO: 500691 - DNA, 907 bp, Homo sapiens
  misc_feature (275)..(275): n is a, c, g, or t
  misc_feature (285)..(285): n is a, c, g, or t
  misc_feature (323)..(323): n is a, c, g, or t
  misc_feature (325)..(325): n is a, c, g, or t
  misc_feature (327)..(327): n is a, c, g, or t
  misc_feature (452)..(452): n is a, c, g, or t
  misc_feature (474)..(474): n is a, c, g, or t
  misc_feature (667)..(667): n is a, c, g, or t
ggacgcgtgggtcgacccacgcgtacggcctttcccagtgtccccacgcggaaggcaactgcctgagaggcgcggcgtcgcaccgcccaggacgctgagagacagccaggcagccatagttcagcaggaggctaccaggagccagccacgacagatgcaatagagcgaagcaagcatgcgcccgcgacccggagagatgagagtagtgacctccctcaagggtggacacactgacctaccgcacctcgcccgacacgctgaggcgcgtcttcganaagtacaggncgcgtcggcgacgtgtacatcccgcgggatcgctacancnanggagtcccgcggcttcgccttcgttcgctttcacgacaagcgcgacgctgaggacgctatggatgccatggacggggccgtgctggacggccgcgagctgcgggtgcaaatggcgcgctacggcngcccccggactcacaccacagncgccggggaccgcaccccgcaggtacgggggcggtggctacggacgccggagccgcagccctaggcggcgtcgccgcagccgatcccggagtcggagccgttccaggtctcgcagccgatctcgctacagccgctcgaagtctcggtcccgcactcgttctcgatctcggtcgacctccaagtccagatccgnacgaaggtccaagtccaaggtcctcggcggtctccagatctcgttcgcggtccaggtcccggtctcggtccaggagttcctcccccagtgtccaacgagggaattccaatccagggtcgcgatcgaaagagtcaccccaagtctcctgagtaggacgagcggtggtcttttagaaactgagtattcggaaaaggggtaaacggagacttggggaaaaggacccattatcacatgagaaaa

SEQ ID NO: 500692 - DNA, 937 bp, Homo sapiens
caggggactgtgtccacactgagcggggttaccttacagagccactgagaatgatatatataatttcttctcagctcttaatcccatgccagtacttattgaaattgtggacccgcatggcagagttgccggtggagcgcgagattgtctgaatttgctactccatgaacgatgctcgtggccacgctcatggcatatataggactaaagcttaattattgcatactaccagtataatgttgcagctctttcttataattctaattggtaaggaacacagttgcgcgagtgcttcaccgcactccactagctaatgtgagaaacttgtcttgcacattctacaggcggcgttgcaagtggtggcgcttatggtagcccaaaggatgggagcgagatagggcttatccaacacagtgctaggttagtggaggtcctgctagaccagaaggtgagtgatgctggatggaggtggatatgggaggtacagagcagtatgcagtggtctatgaccaaagttctagcaggaagtctccagggactatctagtctaaaccttgctggagggtagagaatgtgcattaacatagcttgtccagatataacagagctgtacattgtgtggggatgttgcactacgaatgggagggggtgtgacgtatatcccagtattcgatggtaagtcggacagtatatttgattctggttcacgcttgggccagttactactataccaaatgcttgcattctcctgtgtacgaaagacgagtgagtgaaccgttcgcatacagggttggaatcctggtccggtagtgggaggtgacattgttctaaaacttcacccggatttgacacggaacgttgctcgggctttataagtccttggccaactggacagatagggcccgtatatagaggggccggagggtaagatggcatc

SEQ ID NO: 500693 - DNA, 655 bp, Homo sapiens
ggccggttttcagaggtggagtccagcctcaaccagtccttctgctcccgccgcctctgcgcctgcctggtggccacgaaggccaaaggagatctatctaaatatccccgaccagccggacacactgtgcttccagaattcgtggagctgccccaccgtacgtctatgctgtggggagaggctctgaggccatggctgagggctctgtgctggtcagtgctattctgaaggtcaatggcagcaagcgtgatgaagcgatggtgcccctgaggtcctggagcactattccaggcattccggagtcggtgctgatagaggcccgtgggcctgtagccagtggatctagtcgacacccagtggaggatgcccaggaagcacgatgccagtcaggaggcctccactgaggagcccagtggcgagcaggcccaggaggaagacccaggctgattcagcccttcccactgctgtccctgggtccccggcgtgagccgtgtgtgagtgacagcacccagtggtcgaccctgtactgtggacaatggtgcacctggaacacggcgtggtgtatgagtatgtgatcacggaggcgtcgggtggcatgtgctggagaagatcgtcgcccgctcccgtggctgtttttggtgtccatcggcaagat

SEQ ID NO: 500694 - DNA, 108 bp, Homo sapiens
ctttagagttcccccatggttctcacattcgtatatactagtgcagtcattcaaatcaacccatggagcaatgaatgaaatgtaagtgagggcgacagcccacacagg

SEQ ID NO: 500695 - DNA, 350 bp, Homo sapiens
  misc_feature (1)..(1): n is a, c, g, or t
  misc_feature (47)..(47): n is a, c, g, or t
  misc_feature (67)..(67): n is a, c, g, or t
  misc_feature (71)..(71): n is a, c, g, or t
  misc_feature (80)..(81): n is a, c, g, or t
  misc_feature (87)..(87): n is a, c, g, or t
  misc_feature (104)..(104): n is a, c, g, or t
  misc_feature (114)..(114): n is a, c, g, or t
  misc_feature (147)..(147): n is a, c, g, or t
nttctcagagccctctttcggtgatgtttgcattcaactcacagtgntgaacctttctttgatagtncagntttgaaacnntctttntgtagaaactgcaagtngatatttggncctctctgaggatttcgttggaaacgggataanccgcacagaactaaaacagaagcattctcagaaccctcttcgtgatgtttgcattcaactcacagtgcttgaacctttctttgatagtgcagctttgaaacacttcttctttgtaggaaacttgcatttttacttttccagttatttttattaagttatttatttataggaggacagagtctttgctatgttggcccaagctg

SEQ ID NO: 500696 - DNA, 524 bp, Homo sapiens
atcgggactccatgcccacgtcgtctgggtttagtgctccaaggaggtgccaccccatcccgtgggccctctcctcgcccatctcttcatcctccccgtgcggagagcctactgggggacccagatccccaccccccacaccttcctctgcaaggtgaccggccgctgcggctctgtgctggtacgcctcatccctgcacccaggggcactggcctcgtctccgcccctgtccctaagaagctgctcctggtggctggtatcgatgcctgctacccctccgcccggggctgcactgcccccctgggcaacttcgccaggccacctttgttgccttttttaagacctacagctacctgccccccgccctctgggaggggactgttttcaccaagtctccctatccggggttcactgaccacctcgtcaagccccccaccagggtctccgtgccgcggactcaggctccagctgtggcttccccatagggtttttatacaagaaaaataaagtgaattaagcgtga

SEQ ID NO: 500697 - DNA, 228 bp, Homo sapiens
  misc_feature (37)..(37): n is a, c, g, or t
  misc_feature (47)..(48): n is a, c, g, or t
  misc_feature (50)..(50): n is a, c, g, or t
  misc_feature (69)..(69): n is a, c, g, or t
  misc_feature (77)..(77): n is a, c, g, or t
  misc_feature (97)..(97): n is a, c, g, or t
  misc_feature (101)..(101): n is a, c, g, or t
  misc_feature (105)..(105): n is a, c, g, or t
  misc_feature (107)..(107): n is a, c, g, or t
  misc_feature (112)..(112): n is a, c, g, or t
  misc_feature (118)..(118): n is a, c, g, or t
  misc_feature (123)..(123): n is a, c, g, or t
  misc_feature (133)..(133): n is a, c, g, or t
  misc_feature (136)..(136): n is a, c, g, or t
  misc_feature (149)..(149): n is a, c, g, or t
  misc_feature (156)..(157): n is a, c, g, or t
  misc_feature (168)..(168): n is a, c, g, or t
  misc_feature (177)..(177): n is a, c, g, or t
  misc_feature (183)..(183): n is a, c, g, or t
  misc_feature (199)..(200): n is a, c, g, or t
  misc_feature (221)..(221): n is a, c, g, or t
agcacaggccatcttgttggacactgtcactttgggncttggcaggnntncacagaatcacatcggtgnatttattngtataatattgtgaatattnggangttntnagtgngttgcnctttnagaagttttnggngtgtggatcgctnggttccnngaaagaagatntgccccggncccttngaaagattgtgaattnnagagatagaggccttaggatnccttctc

SEQ ID NO: 500698 - DNA, 879 bp, Homo sapiens
gagagaactaggtctcgagatttctccgaatgtatatttttccttaggtaggcaaattgttaaatccggcccatatgcacttctgaaagcttgaaacacaccccaaaaacagcacccccgggacctgggggggcaaagtgggcaccccccgataaggtataatgctcaataataggggtgcataagggtgcgtgataaaataccttagggtgttcaacaaaaacacgtggacgagtctccaaggggtggtcgtgcgaggccaactatcgcaggcgggacaccggggtctcaaaaccacctccgagggctgtccactatgtcccagtgtggccgtgaagtctcccgacacggtcatagcgaggcctggtacgtgggggccgaggaattctcccaatgaaaggggccccgtcaaagcttgtggacgcccacccagtgtggtccatttggggagaaactcccggtggtggccctccaaaaaaaatcgcggctatgagccgtcacttcacagaagagcctctgtgccccaaccgaggtctgtgcacaacaaatttacagcggctgtccatatcgaggccataatattctcccacaaagaccaacacacaacaattgttgggacatctcaacatgggggggggggtaaaaaatatttttctatctccctctctgtggccccccggggggggcccattccctgtttgaaggttctgcggcgccagagagtcgaacctccaggtctcaaatatagcgctctctgtgcgcccaagacagactcttgcgggggctcccccaaagcgtcttccactactcaccctcggtcggaacgagcgggggtgcccccccacccccgtgctgtcgcactgtgtttggaccccccat

SEQ ID NO: 500699 - DNA, 132 bp, Homo sapiens
cactcggtaccaggtcggctatctgtaatgcccaactaaatactaccgtggccaccataattacccccatactccttacactattcctcatcacccaacaaaaaggctgggatagtaaggcaggaggttgag

SEQ ID NO: 500700 - DNA, 660 bp, Homo sapiens
atgtaggagcttatagctataaacttccctcttagttctgctttcgctgtatcccacaggatttggtatattgtgtttccattatgtttgtttcaagatatttttcaatttccttcttaatctcttcatcgacccactagtgactcaggagcatattgtttaatttccatgtgtttgtatagttcccaaaatgcctcttgttattgatttataattttattccattgtggttcagagaagatacttgatataacgtcaattttttgaatgttttaagacttgtttggtggtctaacatatggcctctacccttgagaatgatgcatgtactgaggagaagaatgtgtattctgcagccactggatgaaatgttctgtaaatatctattaggtccatttggtctatagtgtagatgaagtctgatgtttctttgttgattttctgtctggatgatctgtccaatgctgaaagtggggtggtgaagtcttcagctattattggattgaaaattatctttctctttagctctaatatttgcttttatgtaataaggggttccaatggctggggcttatatatgtttaactggtttttcccattgctgaaatggccccctttatttataaggaccctctttggcttctaaatttttggccggaa

SEQ ID NO: 500701 - DNA, 114 bp, Homo sapiens
  misc_feature (94)..(94): n is a, c, g, or t
cggcgactctcgagatccccttgaaaccctcacagagctgatgtcaccctggtctgggcacactccagaaactgtttgatctcatagaggcagnctgctactgctggatgggga

SEQ ID NO: 500702 - DNA, 410 bp, Homo sapiens
gcggtcctgtgtatatttctgtgcacacagctctatattcagatctttttctcttcacttacacgccacgggtatgacacaaccacttcctgggcacatggcttactcttcaagctgtgggtgtggcttcctggccacatgacacgaacccgtgaatgccctcggaggccatggcagctcttcttggacttccctgggcccatgatggtgcgtctaataccctttggctcttctctatgcgtgcccattggagagaaagggaccgggaccctacaccttacaccaaccacaccagtttaaatgggcttagaggccaagaagatatgggaactaacactctgaataaaccttttattagcgctcataccttctagccccctcttcgctaggccctctctgccttttccctt

SEQ ID NO: 500703 - DNA, 218 bp, Homo sapiens
tacataagttatgggtgatgaaatagaaagtgaagcaaaaaagaatcctttctcccggaaaattggaactaactttttgagaactggagggacaaagacaagaaaaccgaaagaagccagctgaagaggaagcgagaaaacgtttagaagaagagaagggtgcgtttgaagaagccaggggggcaatggtcaatgcagttgaggatggtccggcccgg

SEQ ID NO: 500704 - DNA, 159 bp, Homo sapiens
  misc_feature (55)..(55): n is a, c, g, or t
  misc_feature (118)..(118): n is a, c, g, or t
  misc_feature (148)..(148): n is a, c, g, or t
  misc_feature (152)..(152): n is a, c, g, or t
ctgctctcaccgcccgtgtggcaggctgtcctctgaaggacagagtcctcttctntcgtgtccctaagcctagcaggcagtgggaatgaacgggcagcccggttgctgggcacccatntccccagcctagccggtgtgtggaggattncagncctttag

SEQ ID NO: 500705 - DNA, 476 bp, Homo sapiens
ggccgggcgcagttgggtcacccctgtaatccctgcctttggaggctgaagtggtgacccatgcgcccggccaacatgatgaagcccacatctctactagaaacacaaaaaattagccgggcgtggtggtgggcacttgttattcccagcttctcaggaggctgaggcaagagaatcacttgaacccgggagagagaggttgcagtgagctgagattgcaccactgtgcttcccaagcctgggccaaccaaggaaatgagaacttccggtccttcaaacaaacagacaaacacatagtatcataacaaacaaacaaatctttttgcgcccgctcacgggcccccgtgaagaaagcgtttttgtacaacacaatttgttggggacaccggcgcccccggtgaggttccgtggaaccacttgggccatagagtgtttccaaggggaacacccgggcatgacaggggtggattacacac

SEQ ID NO: 500706 - DNA, 455 bp, Homo sapiens
gtaatctacgtataactgaaaagttatattctctgttttttaattatataatttcattaacatccccgctaggagggacatttaacctttatctctctcactacaggctaagccagtgatgcaaatgctttaaacgactctgtctttgtcttcgggtgttgcttttatgctacagaaaccctatgttgattaacttgtgtggtcagtagctgggctgttttttaacacctatgccatgctgactccaactcttaatttgcatgctctgtttagccatatcccctcctcctaagaacccaatatagccatgaaatcttttgtctcaattcagactattttgcagacttgtaaaagaacttgcagactgcggacctctagtaggctcttgcatggacatagacgctgtatgactgcagattaaccaacacgtctcaataaaggaattctgcttgtta

SEQ ID NO: 500707 - DNA, 169 bp, Homo sapiens
aattacgactcgagttagtacccaaacacctgggggcacaattgatatcattaacacgtagcacccttcagcaggaccctataaaactttcctccagcccttgcctctttgcaggtagccccttctctgctgagctgcccactgcaacatattttcacaatttctctaa

SEQ ID NO: 500708 - DNA, 357 bp, Homo sapiens
ttcctgcatggttgactcttgatggatcccgctcccgacggggtgtttgaaaatcatacttaaaacgtcataataaattgtgtaggaggatgtccagcttaggacctgggtcatgagccaggccacgctcgtggaagggggcctctgcatgttcagaggatcactgctgtcatcaccgtcatcctgggagtcgcagttattttgccatggccttgattgcaacagctgcctcctctgtcatggcagacagcaccgtgatcaggatctcttctccacagtcgtacttctgctcaatctccttgccaaggtctccctcagggagacgaaggtcctctcgtaccaccccgtcgggtggag

SEQ ID NO: 500709 - DNA, 157 bp, Homo sapiens
ccttcaacatctcatgcctccttccaacatctcattcccctatccaacatctcatatccccaatatctcatctcaccttccaacatcccatctcacctccatctctctccctgtgcaggccatgagatgttggaaggaggcatgagatgttggaagg

SEQ ID NO: 500710 - DNA, 146 bp, Homo sapiens
ggcctgtctcagaagaggcatcatgcaggttttgcagcgggatctgctctgaagagggcgaagaagagagagtcagacatttgcctgaaaaaattaaggatgacccagcagctagaagaatatgcagtggccatggttttattgaa

SEQ ID NO: 500711 - DNA, 86 bp, Homo sapiens
ggatttgctggtgcagtacaactaggcttaatagggaacatgtcactgttattcgtggtttaaaagctggggctaaaaaaaaaaaa

SEQ ID NO: 500712 - DNA, 194 bp, Homo sapiens
tccgattactccagcccaagggcccagcgtcctatatgctatcatctcccttgcaaactttccagccatgatctctgaaaaaaactcatccacactgagctggggctgattggaattcattccagggagagttgcattttgtcaaacactaatgttaaagaattgactctgaagaatagattgtagacaggatg

SEQ ID NO: 500713 - DNA, 494 bp, Homo sapiens
  misc_feature (450)..(450): n is a, c, g, or t
acgcacctcctcctcctcctgagaggagctcagcggaagaagggcaagcgtattaagctgatgaaagcagtgaagaagaggagggcgctttttagagaaggtcattgcaccaccaaaggctgctggagaaggtagtaaagcagggctgtcaccagctaattgccagagtgaccgtgtgaatctggagaagtctttgctgatgaagaaagcagctctccccactttcggttctgggcattgcacagctgaagaggtgtttgcatctgaagatgaatctgaagaaagctcctcactcagtgcagaggaagaagactcagaaaatgaagaggctattagaaaaaagctttcaaagccttctcaagtgagcagtgttcagaaactggggccacagaacttcattgatgagaccagtgatatagaaaatttactcaaagaggaagaagatcacanggaagaaaataatgattccaaagaaacgtcaggtgccctcaagt

SEQ ID NO: 500714 - DNA, 276 bp, Homo sapiens
ccacgcgtccgggaatttgaatttggggtctacggatgttccattcccccccccggttggtataactgcacatcaggttattcggattttattttatttttttctttttcagccgttattcaggcactgctccccgattaggtaataggcacctagagccatgggacaacctttcccccccctgctatgttgtccagcatagtagcacgtggtaatttaaatttaatgaaaagtcaataaaatttaaaattaactttctcagtccaactagctata

SEQ ID NO: 500715 - DNA, 678 bp, Homo sapiens
  misc_feature (509)..(509): n is a, c, g, or t
  misc_feature (580)..(580): n is a, c, g, or t
agcagtgtctcacacctctaatcccagcactttgggaggccgaggtggacagataacctgaggtcaggagttcaagaccagcatggccaacatggtgaaaccccgtctctactaaaaatataaaaattagctacgcatgggccgggtgcggtggctcatgcctgtaatcccagcactttgggaggctgaggcgggcagatcatgaggtcaggagatcgagaccatcctggttaacatggtgaaaccccatctctactaaaaatataaaaaattagccaggcatggtggtgggcgcctgtagtcccagctactcgggaggctgaggtaggagaatggcatgaacccgggaggtagagcttgcagtgagctgagatagcaccactgcactccagcctgggtgacagagcgaaactccgtctcaaaaaaaaaaaaattaacttggcgtggtggtgggcgcctgtaatcccagctactcaggaggctgaggcaggagaatcactagaagctgngaggcagaggttgcagtgagctgagattgtgccagtgcccttctgggcaacacgagtgaaactctgtctcnaaccataatattaaattaaggtgcttctttatattgttggtcgaattgaattaaattttgttccagtacaccctatatttaatggaatttggtgtgct

SEQ ID NO: 500716 - DNA, 231 bp, Homo sapiens
  misc_feature (4)..(4): n is a, c, g, or t
  misc_feature (18)..(18): n is a, c, g, or t
  misc_feature (33)..(33): n is a, c, g, or t
  misc_feature (142)..(142): n is a, c, g, or t
  misc_feature (154)..(154): n is a, c, g, or t
  misc_feature (178)..(178): n is a, c, g, or t
gccntgatgctgggcatnatagcatggactgangagacgcagaagaacacgtgacctcttgagctctctgggtcgcctggaaattcaagccattttcagtccatgcgagggagagaacttcccttttccctctgctttcccntcacagtacagncccagagaccactggaggacatgngaggatgacatgcccaaacttgtgccctctgctgctcaaaagggagaagagct

SEQ ID NO: 500717 - DNA, 123 bp, Homo sapiens
gtggcagcgccgcctttatgcaggctgaacctgaccctgggtggactccctgctctctgccgagcgcctttctcacccctgggtcccaccgcccctcccccagccttcctgacagcaggggag

SEQ ID NO: 500718 - DNA, 354 bp, Homo sapiens
  misc_feature (29)..(29): n is a, c, g, or t
  misc_feature (285)..(285): n is a, c, g, or t
ctttgacgaggcccatagccatttcctancccctaatttatgtagtggatacattataaatacaaaaaatttagcccagccgtggtggttcatttctgtaatcccagcactttgggaggccaaggcaggtggatgacttgaggtcaggagtttgagaccagtctggcctacagggcaaaaccctgtctctaccaaaaatacaaaaattagccgggtgtggtggcacatgcctgtaattccagctcctcaggaggctaaggcataagaatcgcctgaaccttgaancggaggttgcagtgagctgagatcgagccactgcactccagcctgggtgattgactgagaccctgtctc

SEQ ID NO: 500719 - DNA, 172 bp, Homo sapiens
cgtgggaataagaaccttacggttctgccggatgaggccggacctgcaccgccaagctgaccgacccgcgactcctctacatcggcttcttgggctactgctccggcctgattgataacctgatccggcggagccagaccgtgacggctggcttgcatcgccagcttctata

SEQ ID NO: 500720 - DNA, 215 bp, Homo sapiens
actaccaatgcaatgggcatatccaggtccatgttgcaaatcccatgcatggtgagtgacactctaaaccttattacagatagatgtttcttctgcttgtgtatatcaccattaaacagagttcaagatgacttaattgttcaaccatcattgtttttcctcggcatgattgattttttttttaatttctgttattagtcctgataatgtgatag

SEQ ID NO: 500721 - DNA, 220 bp, Homo sapiens
  misc_feature (191)..(191): n is a, c, g, or t
acgcggcacgcggtcaaaggaagagctagcctcactgcttgtaggtagaaggaaaaaaggcactaaggttgcaaaaccttctcatttcagagagatgccaggatcctaagtgcctgccaagacttaccaattcgtaaggaataagctggatggatggcatatactgatccctacgattactgcattggtgnctggcatccgcaaaatggtatttattaaa

SEQ ID NO: 500722 - DNA, 248 bp, Homo sapiens
tttaggggaacatggagaaagaaggagaccacataccccaaagcgtgttgaagttatgtgtcatgataagcaacatgtaaactgatatggaaattaatactagctacagacatatatttttccctatgttgagatctctcttttgtaatgcttttcatgttactgcctagggcggtgctgagcaccacagccaagtcttaatacaacttgacctgaattcaacaaaaaccaaacacccaacaaaggga

SEQ ID NO: 500723 - DNA, 326 bp, Homo sapiens
cctctcccaatggatgagaaattgctcccaatggacaagaggcatgtctggttcggcgagagcatgaccgatggcttccagttcgagtatggcggccatgggctccgacccctgactgctgtggccatccagcctgaccttcctgcgcctgatgtccaccgagggcctcccagaaagatcacgctaccacgtagcaggaacagcgtcatcctacatgtgcccagctgacgtgtctaacctcaagcaaggccctgctcccttccagggactccacggagcatcggagatccgcgccgagggcaaaaagccgttttcaaccctacagg

SEQ ID NO: 500724 - DNA, 282 bp, Homo sapiens
tcatgtcacaacagcctttgcagcatcagcaggcagcagtcagttattcagcaaggcaacaagtcttcaagccatcatttaacagtactcattcaacaggcaacacatccggtgggggagggggggccgccatgagccacattcaacaggaggtcaagccacagacaacaccagccaacaatagcacagtcaaatccactaatccctcagtgctttcatccctaatcactagactagtcaccaaaacctcaggattctccggctgggcccttccgatataag

SEQ ID NO: 500725 - DNA, 551 bp, Homo sapiens
  misc_feature (32)..(32): n is a, c, g, or t
  misc_feature (138)..(138): n is a, c, g, or t
  misc_feature (141)..(141): n is a, c, g, or t
  misc_feature (150)..(150): n is a, c, g, or t
  misc_feature (158)..(158): n is a, c, g, or t
  misc_feature (171)..(173): n is a, c, g, or t
  misc_feature (204)..(204): n is a, c, g, or t
  misc_feature (206)..(206): n is a, c, g, or t
  misc_feature (210)..(211): n is a, c, g, or t
  misc_feature (372)..(372): n is a, c, g, or t
ttattcttcattttatctcatactttgtctanattttctttatatttttatcctctcacaacccaccagttgggggagattacatcacttctttctccatggggagggtgcttacagggcactaagttcgggatcctnggncttgcaggncctgctgnagcctgagatgtnnnctagggtcctgaggttgcctcctcctttccngncccnnccttggcacctcccaagactgccaagggccctaccatggccccacagcccccagggctggcagttccatctaggagggtgcctctaggccccactctcaggctaggatggagaggcagatctgggcctggtgaggtgacctgcttctggaggggcagggcngcacccgagagcagggacaggtgcccgaacacagggtctccaggacgtagcgcccccccgcatacttgaatgtatgtgcgtatttatgctcacgtctgtgccatgtgtcaatgggtcctttccaacccaagaggtacattgtttttctgtttttcctgaaaaataaagtcggccaagtg

SEQ ID NO: 500726 - DNA, 112 bp, Homo sapiens
aggtcctgagatagcttcctcaagatctggaactaacgccagtagcatgtggatgcatggagactggaagaacattccaacttggacgcgttaccatgagagcatatcctat

SEQ ID NO: 500727 - DNA, 229 bp, Homo sapiens
tatttgaagttccggggaacatgtgcaggatgtgcaggtttgttaggtaggtaaacatgtgccatggtggtttgctgcacctatcagccatcccttaggtattaagcccagcatgcattagctatttttcctgatgctctcctccgcacaaccccgcactccatgacaggcaccagtgtgtgttgaaaagaagccctttttcaatgaaattataatttagggtcgacgc

SEQ ID NO: 500728 - DNA, 165 bp, Homo sapiens
ctaggacaaacctcagacctaacggtggtggagaacccataggggagttgctggaagcctatcaaacgtgactttggttcctttgacaagttaccggagaagctgacggctgcatctgttggtgtacaaggctcacggttggggtaggctatgggcgtacgggca

SEQ ID NO: 500729 - DNA, 303 bp, Homo sapiens
  misc_feature (10)..(10): n is a, c, g, or t
tgaatgggantgtaaagtagttaagaagttagatattatggtaggagtagagttgtttggatgagttgggatgtgatgtttattattggaggtttgggatttgtaggttaggggttgggtgagagtgttggtgtagaggttagttgtatgagtgttgaaatgttttatagagagggtaattagggatataaaaagttaggatattttgtgtatgatgaggtggagagagatttgtgttgtttgagtgattagtttggggtggttgaagtaaggatgtgttattggttggagaagtagggagtt

SEQ ID NO: 500730 - DNA, 874 bp, Homo sapiens
  misc_feature (870)..(870): n is a, c, g, or t
  misc_feature (872)..(872): n is a, c, g, or t
ccgaaggttggccgggattggttaacttggcccaagtcctggaaacttcccagccctccaaaatggggaagttaattaaacggttccttattaatggtcaaagcctaaggcttctcctattagcacacaccaacaaacaagaaccacggggggaacctcccagggggagaaaagctccagaattggatttgacaacggaatgtgggtccaaaagctccaaaattaaatggttcggggccgtgactaattcctatattaccgaatgaattaaccgacaaaagtataggtccaggtatagactctcaggtgaaccaagtacccgcaagtggaaaaacctgtgaaggaccacaacacacatgtgaaggaaagccctaagtaccctggtgtggggctttggggcggaagaactatacggcagaaaattggaaaaccggaagggttcccgagccttccccagcaagtaattaaatcaaggcatgtgttccttggttacctctccttccctattattccttgttaaacaaaattgggtgatatcaaattattcacttaaccatttttaaccaaccttccaaccaaatttttaaagggggttaccgagttccaagggggacatattaaaaattaccattccaccatttgggtggggggccaacccatattaaccaacccaatccatatcttcccaagaacatggggttcgccttttttcgctcttcaaattttttgtggggagacatgggcattttcccgcgatcccttaatattgggccccgggtttggtttcgccatatgggcgccccaattccatagaggggtcccacatgggggttatcccccgggggacccgtggtgattttgccccttggncncc

SEQ ID NO: 500731 - DNA, 642 bp, Homo sapiens
  misc_feature (642)..(642): n is a, c, g, or t
agtggaattatgtttagatttgaattcatctgcgaagcattcaaatcaaagctaaaagcctaaatgtgaaatgctaatgacaagcctgagaaggtaaactgtgaatcttcatttctatcattgatctaactttagatattggagcgagtatatttaggtggcattgcttcaatcactgtcattattctaaccctactcctacttaaattttaagctatgaggcttatcccaacagtaacatcttcacaaatgtactctcaaggcacaacatgtcctaacattctagcctctcccaccacaccccatatcgccctcactgcgccccctagcgctcgccccccctattgttatctgtgtatttcattaaatatgatccgcctcttatctcatgacctcttcttccttatatagcttgccaccctctcaaccaccttccaaccccctcccccctctccccccccccacttctcacctcccacaccccctctatccctccctcctacccatacattctcttctccttttttctccccccccccccctcttcccctatcaaatcttccccccatctcacctctccccccctccccctctccccctcctaccctctctccctgcctctcacgtcactcccttaccccn

SEQ ID NO: 500732 - DNA, 363 bp, Homo sapiens
ggatctacttgcctctgagtgcatagtctgagaagatgtgggtacagactcagatactgtagctgaggtacaggtacaggtatccaggtctcccctctctcctgctctggatgtgggctacagactcaggtgtcatcactgaagcctgtgtaggggctctggaccctggacaccctcctttggccatcctcttcctcacagagggtctgtgtgattctgggccacaggaccaaacagctctgaggaaggagttgggaggcaggctgacctcacaatgaatgctgacgagctgcaactgggtttgttttcctttctcgcctcccttcttccctgattaataaagtctataggaatggtttcaaa

SEQ ID NO: 500733 - DNA, 152 bp, Homo sapiens
agcatgtattgaaagacttatattttaggctggatgcagtggctcacgtctgtaaacccagcacttcgggaggtcgaggcgggaggatcccttggggccgggagttcgggaccagcctgggcaacatggtgatgcctcccatctctacaaaa

SEQ ID NO: 500734 - DNA, 421 bp, Homo sapiens
gactctaaggatcccccacgccacgagtcatagacatttgtttggggctggaaaagtattttggaattttttccagcatggtcttcagttcttcacatatgagcttgacaagtccattctttatgttactatatgaaacaccaatcatgaagattaaggctggtgggttgggaggcttactcttctcatatagaatcattccatatttatcctttttgtggctggcttattttacttagcataacatcctcaacattcatccatgttgtagcatgggtcagacttttcttcctttttgaggctgaatgatattccattgtacgtatataccacattttgcttatccattcttcttccatagacacctggttgcttcctccttttggctattgtgaatactgctgcttctggatcagccatt

SEQ ID NO: 500735 - DNA, 557 bp, Homo sapiens
atgtcacacttacatgctgaagaactcagggatccaatgatacaatgtagggaatttgtttcaaaatattttatggttgatgagtagataaattgatcacgacttgatgactgttggagttggataatggttcagagggattcattatactcacttgtttaatatatgtttgaaatcttcagtaatcaaaggttttaaattttttgaaatacgtatcatgacgaatggcacagttttaacgtttcccttatgtgtaactaacacattatactttttcatttatttagggcttatctgatgagtggttgtgtcccatccaaacatctatcccagtagtcaggaatataacaaagcccctgagattccctctgctgtcagctacctgtgtgtctgttgggatataagccacaccaggatttcaccacccatggctctagcatgagtaatttggaggttgagtgggacgaggaggaaaaatgtaggattctttaccttaatctaggctgtcgttctatggtaatcattaagctttcataatttgtgttggaaaaaaaaaa

SEQ ID NO: 500736 - DNA, 846 bp, Homo sapiens
  misc_feature (38)..(38): n is a, c, g, or t
  misc_feature (46)..(46): n is a, c, g, or t
  misc_feature (66)..(66): n is a, c, g, or t
ggtcgcgccatcctcggcgcgactcgcttctttcggtnctacctgngagaatccaccgccatccgncaccatggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaactgccatctccctcttctacgagctctcggagaatgacttgaacttcatcaagcagagcaaggacggtggcgggttccttattaaactctattgagatcttcccggggatgtgtagatttcttctggggaggtgagtggtgctctgagtagtcaccgatgggcattggtggtggatggacgtggtgtcaggcgtgtgcgtgcagaggagacagtgtgcggaggccattgcgaggcatcaagcctgtgtgatgatgaacaagatggacgggcctgtggagctgcagctggagcccgaggagctcttaccagactttccagcgcatcgtggagaacgtgcaacgtcatcatctccaactacggcgagggcgagagggggccccatgggcacacatcatgatcgatcctggtgctcggtcacagggggctttgggtctggactcaaggggggcggcttcacactgaagagagattgcgagaagttgtgggccagctcgcgccaaggggagggcagtggggctgccgaacggccaagaataaggcaaggtgacaaccgtgcgg

SEQ ID NO: 500737 - DNA, 304 bp, Homo sapiens
tacgcctggtgcagtccctgtaatcccagcttcttgggaggctgaggcaggagaatcgcttgaacccaggaggcggaggttgcagtgagcctagatcgtgccaccgcagtccagcctgggtgacagagtgagactctatctcaagcaaaaaaacaacaacaaaaaaaaaaaaaaaattatatggattctacaactaaaaatttgtacccaagtgcgcagggggctctcagcggctttgtatctcccggcactttgggcaagtgagcgggtgggtgggactcatttaaggggccaggagacttgg

SEQ ID NO: 500738 - DNA, 473 bp, Homo sapiens
tactgcagacaatgcctggctggcacctacatgcggctggcaacaagctggaagctctccacggccatctgccctcatttgggtacccatgccttcatcttcctggactgagcccaccacatggcatggaccccaaggcccggcgcttcctctggaacctcatccttgacctcatcaagacagggccgttccaattggttcgttgcctctcaccacgcgctgtggagagatgtgcgagggcgctgtgcacgcggctggccatcatggtgaactggtcgcctgctggtgcctgggcagcatccagcacctgaagaaccggttttggagatggctacatgatcacggtgcggaccaagagcagccagagtgttgaaggacgtggtgcggttcttcaaccgcaacttcccggaagccatgctcaaggagcggcaccacacaaaggtgcagtaccagctcaagtcggagcacatctc

SEQ ID NO: 500739 - DNA, 1111 bp, Homo sapiens
gagcactgtctggatccacgtgcctcctgggtctcagtatggcgctggtcgctggggttcttatcagttgctgagcactcgctaccgtctgactgggaaggcggccagatcccagtgtgtgagcgaaccgtagctaccggatggcccatgcagcgcaacgacacgacccctggagccagatgcattgggcaagctgggtttatatatgccgacatcggtcctttacgaaacgaggtaggtgcaagtgaaggatctgggttcctacggaagatcccatggactaacacgtgtcgtattgtagcatatcaactcgctccatagaagatctggaaggacaacgagtgctttcctcgagaagaagtgaccaagacgcactgtacagggatcgcatggggctaatcatagtataccactcgagcacttaccatgaaaatgttcacagccgtggcgacacaaatagggcaccactcgtacctaagatacggtggggagggcgcacagtaggtcactgttcggcatgcgactgtgtcgtgaactcgcttcatggggaccagcccaaagacccgtatcggtgcgttgccctttttgacgtgacaacggattggagaaggaaaccttgtggaggcttggtgctgttcgtattgcttgacgaagcccaggagcaactgagtcgaaaggtatggcgagactcgcgggcaagaagatttacatatcggataagcttctcctgtagcatgcatttacaggcgaatttgcaccttaaagtccaaggattgatccagtcggttacccatctgggaatttagtgtgaacagaagggataaaatgttggttggaggccataggttggggagggaatggcacagacagatatggacgcaaagggaggaggcgaaatagcaagtggcagggatgggggtagaattacttaagacatgaggtacgacgaagacacttatgtgggattgtgagggaacagcgtaggacgtagtgggccatttcgtggggggcatttctaaaaatccgaatatggtggttgtaccttgaagtgtttgttatcaccttcaaacttggtaattcgaaataatacagggtacgtgtggggtatggg

SEQ ID NO: 500740 - DNA, 253 bp, Homo sapiens
ccagagactataacagctttcaatgaggtctgtgagtccttgtggcgaattatataaccaaagggtagttttagggttccccaaacttgcaactggtatccaaagtaccggtagtttgtggactattccctgagtttgggaaatatatatgtaaatacataagtgtgataaaatattataatccctgtgagagctggctgtatggatggggagggcccaaagaatggctactctccctgcccgccaacccata

SEQ ID NO: 500741 - DNA, 181 bp, Homo sapiens
cctaaaacctttttattttgtttttttttgaaagaagagccttggggcccccccttcccccttttttgtcccccaactttaaaagtataaagggttttggtttccctgggagggggggggggcaaccaggggtttcctgttcccttactttagacccgttgaataaaaggggcccccttta

SEQ ID NO: 500742 - DNA, 90 bp, Homo sapiens
  misc_feature (33)..(33): n is a, c, g, or t
  misc_feature (83)..(83): n is a, c, g, or t
ctcagcggccccgagccgcagcgtgttgcggantggtagggatgccgaccctactgaggagcagatggcagaaacagagaganacgacga

SEQ ID NO: 500743 - DNA, 160 bp, Homo sapiens
actacaagtctcaaagcagtacaggcagctggatattcacatttagagtctctgactagcctggtgacttatcacactggctcctccctcgttcccacttctaaagtcacctgtccattgccaccagattaagctttctccagccagaacaccgtcgaag

SEQ ID NO: 500744 - DNA, 156 bp, Homo sapiens
cgttatacgaagatgtgcccttttctaccttggtcaatgcgattgaaatctccacatggaaactccacaaaaagagtgtttcaaatctgctctttctgaaggaaggttcatctctgtgagttgaatacacacaccacaaataagttactgagaatt

SEQ ID NO: 500745 - DNA, 121 bp, Homo sapiens
agccggacctactttcacaggggggaaagttaatattggtctttcaagttttttctttagctattgttaccacttgccactgtctccatgttaaaatgccaaaaatgatctagttgttgtt

SEQ ID NO: 500746 - DNA, 152 bp, Homo sapiens
tgatactctcagcactcatggtatgtctaggggctctcaaagcatgccagccatgtctgcctgctctctctcttgcactttagtgtttgttctcttctctgctgtcggaatgtagccttcactgtcatcctctggaaagggagaatcattaa

SEQ ID NO: 500747 - DNA, 380 bp, Homo sapiens
  misc_feature (26)..(26): n is a, c, g, or t
  misc_feature (30)..(30): n is a, c, g, or t
  misc_feature (32)..(32): n is a, c, g, or t
  misc_feature (35)..(35): n is a, c, g, or t
  misc_feature (53)..(53): n is a, c, g, or t
  misc_feature (70)..(70): n is a, c, g, or t
  misc_feature (75)..(75): n is a, c, g, or t
  misc_feature (77)..(77): n is a, c, g, or t
  misc_feature (85)..(85): n is a, c, g, or t
  misc_feature (111)..(111): n is a, c, g, or t
  misc_feature (134)..(134): n is a, c, g, or t
  misc_feature (136)..(137): n is a, c, g, or t
  misc_feature (172)..(172): n is a, c, g, or t
  misc_feature (175)..(175): n is a, c, g, or t
  misc_feature (189)..(189): n is a, c, g, or t
  misc_feature (219)..(219): n is a, c, g, or t
  misc_feature (221)..(221): n is a, c, g, or t
  misc_feature (231)..(231): n is a, c, g, or t
  misc_feature (245)..(245): n is a, c, g, or t
  misc_feature (252)..(253): n is a, c, g, or t
  misc_feature (258)..(258): n is a, c, g, or t
  misc_feature (267)..(267): n is a, c, g, or t
  misc_feature (271)..(271): n is a, c, g, or t
  misc_feature (274)..(274): n is a, c, g, or t
  misc_feature (277)..(277): n is a, c, g, or t
  misc_feature (279)..(279): n is a, c, g, or t
  misc_feature (295)..(295): n is a, c, g, or t
  misc_feature (371)..(371): n is a, c, g, or t
tgcttgtaattgctctatttattaanaaananatnaaaaatgttcaaaaaatnaatgcattcttgttggnatgcnanaaagaggnattatttttgaagatcttttaaaaanattttgacttgttcccccttcananncatttttaaattgtttggatgagggcctcaatgtntanaatgtcaatgcaanaaaaaaaacagagagaagtagtaaaaaaananaaaagcaatnaattggggaaaaanaaaaaannatggncttcacaanaagnaanaananagctttgtaacagggntatacagggttcaactgagagggaaagaggcaccaaactgcctacacaaacccagggatgtaacaagcaagggggncaccccaag

SEQ ID NO: 500748 - DNA, 207 bp, Homo sapiens
gtcgtaaatggcaacatcttccggaatcaaggcgatgagcacggccagaacagcccactgttcgccatcgtctagaccatcgccatcgagccgctgccagttcgcccatcgctcgtcgaacgcatcgacagcgctccacggaccatgcagtcgtgagccgggaatgttctcgcgttttccggctttcgcaccgtcgagaaactcgac

SEQ ID NO: 500749 - DNA, 1046 bp, Homo sapiens
  misc_feature (1046)..(1046): n is a, c, g, or t
gctgttccccaaccttttcctccgagcccctaacaacgccccctcctaatactaactacctgactcctacccctcacaatcatggcaagccagaggccacttatccagtgaaccactatcacgaaaaaaatctaactctctatactaatcgtccctacaaatcgtcctgaattcataacattcgacagacactagaactagtcatattttatatcttcttcgaaaacacacttatccccacgtgggtatcatcacccgatgaggcaagcagccagaacgccatgaactgcaggcacatacttcctattctacaacctagtaggctcccttcccctactcatcgcactaatttacactcaccaaaaccctaggctcactaagacgattctagctcctcactctcactgccaagaactatcaaactcctgagccaagcaattaatatgactagcttacacaatagcttctatagtccaagataccgctttacggactccgattatgactcccgtaaagccccatgtcgaagccgccatcgctgggtcaaaatagtacgttgccagcagtactcttgaagactaggcggctatgggaataataagcctcagactcattctcaagcccctgaaaaaacacacttaggctacccctttcgttggtacttagtccctatgacggcattcattattagaaagtccaatctgacgtaggacaaagaagaacctacaaccggcccattggataaatctagccaatgacaggccacatagccctcgtaggtaacaggaattatcaatcacaagccccctgaagagttcacggggggccgacatttctcagtttaatgcgcccaggggaagttcccatcctacgtgaagacaatgtggactaacaaaaagaccaagatagcagaggacacccacagagggcagtacaaattctcattcacgggatgtcaaccagtcactgcccaaataagacatgggcgagttagagagaggtggataaacacgtatcacaacgagtaatctctggggagaaactcn

SEQ ID NO: 500750 - DNA, 803 bp, Homo sapiens
  misc_feature (317)..(317): n is a, c, g, or t
  misc_feature (390)..(390): n is a, c, g, or t
  misc_feature (404)..(404): n is a, c, g, or t
  misc_feature (421)..(421): n is a, c, g, or t
  misc_feature (428)..(428): n is a, c, g, or t
  misc_feature (482)..(482): n is a, c, g, or t
  misc_feature (613)..(613): n is a, c, g, or t
  misc_feature (624)..(624): n is a, c, g, or t
  misc_feature (675)..(676): n is a, c, g, or t
  misc_feature (684)..(684): n is a, c, g, or t
  misc_feature (689)..(689): n is a, c, g, or t
  misc_feature (694)..(694): n is a, c, g, or t
  misc_feature (709)..(709): n is a, c, g, or t
  misc_feature (718)..(718): n is a, c, g, or t
  misc_feature (723)..(723): n is a, c, g, or t
  misc_feature (741)..(741): n is a, c, g, or t
  misc_feature (788)..(788): n is a, c, g, or t
gctgtacggccggagtcgtagatcaaggctactagcagcccctcctccttgaacggctagctttgcctgtcgcctggtccatctacatggaaactgctctgcctctggaccaggcgaggtggtaggatgagctgggtggggctggtcccatgcttgggcaaagctgacctctccctaggtacactgcagcctgctcccggctcctggtccaatacaaagcgccttcaggcaggtccagggctcagaaatcagctctattgacgaattctgccgcaagttccgcgtgagtgcctgtccttccacccccatggggcganactttcgggcatgggtatggggggccagagggctctggccacctggggcttgctgtcctgagagccccagcanccatgtcacccccnacagctggactgcccgntggccanggagcggatcaaggaggaccggcccatcaccatcaaggacgacaagggcaaccncaaccgctgcatcgcagacgtggtctcgctcttcatcacggtcatggacaattgcgcctggagatccgcgccatggatgagatccagcccgacctgcgagagctgatggagaccacgcaccgcatgagccnccccccacccnaccttgagggccgccagacggtcagccagtggccgcagaccctgagcggcnngtcggcgncagangagcnggacgactcacaggngcgacagangctgntcgacctggagccagccnacaacgccgtcaaccgcgtccggcatgcctgagcccggggcactagncctggcacagaaggg

SEQ ID NO: 500751 - DNA, 91 bp, Homo sapiens
tcgaattcaagcttctaacgatgtacggggacatgccattgcactccaccctgggcaacaacaatgaaactctgccccccgcccgcaaaaa

SEQ ID NO: 500752 - DNA, 121 bp, Homo sapiens
  misc_feature (65)..(65): n is a, c, g, or t
tcagatcttcgtagccaagagaatctcatcatgtatctagccgagatcatgaggtactcatgtcnaccagaactagaagatagtcagcgcgcgtcatgctgtatccacacttcggaggcga

SEQ ID NO: 500753 - DNA, 1317 bp, Homo sapiens
  misc_feature (231)..(231): n is a, c, g, or t
  misc_feature (243)..(243): n is a, c, g, or t
  misc_feature (294)..(294): n is a, c, g, or t
gcttgttggagccctaagaacaccacatttggtgaaagctaaacagtctacccacagtgacgtggtatctgatgaagacccgatcgatgtgtatagactgttagtagtagctctcagtgatccctccaccaacaaggaggcacgggactgctatctgcaggccgtatatcagggatgagtcagtacaatacgtcacgaaacatgaacgaggagatgggccgagaatgcggngctcgcagtggngacgaaacagtaccatgattcgcctccttgatcacttacgtgttcacacangaggagacttttagatgtgttgaaccttcacaacgagtgttggcgcctctctcactccttcgtagaacaaaaactgacaagaagattggtagtagtgcgtgcggacggttcgggtggctcaatggcgcgtgatagagtccacgatgtcgacgtgcccgtggagggacgtcgaggggcccgaggcagagcagtcaagtaggagagctctaggaggagaactcaaaggcatcgctagatcgcgttgggaccaaagctaatgggttggcaaaaaccacgttgtcatcgtcacttaaatcatacagttacaaagatcccaaattctagacccagtgcgcttggacaatttgtgcgcatagtgtaaaggtgacgcaccaaggagaattcaaccttttggtgagcgcaaggggcctttggaatgtcggcctacaggggcacggcaacactttatgcttttgggaaaaaaccgctcggtggtgcaagggaggtcgggggccaacagtggctatagaggcgcgaagagtttacgaaccggagcatcggaaacgacaagttcagcgggaaagcgaacccacattgtgagaacaaaactacctctagcaaacgcacaccgtaagagggagcaacaagcaactcggacgagacaccacaattccaaaagaaacctgtgggctgccaatcccaaagaccatgacaaaagctgcaaacaacttattcgagaaaacctccaacaattaggcacaacagtgggtcaggaaggagcacactcacacgctccgacattttcgcggacagacaagtgagcctcaggtttttgcacttctgctctggcctcatagatctccagtcacagcttaagctcgctggccggacaacgcgattaaggatgatcaacaggggcacatgttaaagcaactaacgcggctatcagtgaactaccatacgcccgacacccagagcgtggcctcattctcccttgggggaccttacggtaagccccggcatcaactatgattggacacccag

SEQ ID NO: 500754 - DNA, 852 bp, Homo sapiens
gtgcagcgggggggcccggaggccctggtggccctgttggatggggaaccgcggtggcttccgcggaggtttcggcagtggcattcgtggtggccggggtcgcggccgtgcgaacgggtgcctgggtgccgagtgccgcgtagctcgcggatggcaggccgaggataaggagtggtatgcccgtcaccacagttgggccgcttggccagggacatgaacgatcatgtccctggaggagatctatctcttctccctgccctattatggaatcaagagatcatatgattctcttccttgggggggcctctctcaaggatgaggttttgaagattaatgccatgtgcagaaatgcagaccctgtgcctggccaagttgcaccaggttcaaggcatttgtctgctatcggggactacaatgtgccacgtcggtctgggtgtaagtgctccacggaaggtgtggccaccgccatccgtggggccatcatcctggcaagctctccatcgtccccgtgcgcagaggctactgtgggggaacaagatcggcaagccccacactgttcccttgcaaaggtgacaagggccgcttgctgggctcttgtgctgggtacgcctcatcccttgcacccagtggcactggcatcgtctccgcacctgtgcctaagaaagcttgctccattgatggttggtatcgatgacgtgcttacaccttcaggccggggcttgcttgcaaccttggcaatttcgcaaggcactttgtgcattctaagaactaagggtactgacccgactcttgaagggactgttctccagttcctatcggggtcctgcactcgttagaccaccaaattctggg

SEQ ID NO: 500755 - DNA, 125 bp, Homo sapiens
taatgggtcgagatattatgctttgtatgtttggatatatcgaggatggaggattattgcataggatgaggtattgatagtaagtagggcaagagacagccatcctagatttgttagggacggca

SEQ ID NO: 500756 - DNA, 472 bp, Homo sapiens
tcacttcgacggtgctgcttgctgtagacctgtacaactcagtgatgtcaccttacctcctgagctgcgtctcctgagtgacagtgagtatttgtgtgcagatttcacctcttgagatttaacatcagtggaaatgccaagacagcaaacaggacaaagagcactttggttcattctaagaactgaatcttggctgggcacagtgtctcatgcctgtaatcccagcactttgggaggccgaggcaggtggatcacctgaggtcaggagtttgagaccatcctggccaacatggtgaaaccccatctctactaaatacacaaaaaaattagctgggcgtcatggcaggcacctgcagtcccagctactcaggaagccgaggcagagaatcgcctgaatccaggtggcggaggttgcagtgagcctagatcacaccactgcactccagcctgggcaacagagggagactgtctc

SEQ ID NO: 500757 - DNA, 461 bp, Homo sapiens
tcacttcgacggtgctgcttgctgtagacctgtacaactcagtgatgtcaccttacctcctgagctgcgtctcctgagtgacagtgagtatttgtgtgcagatttcacctcttgagatttaacatcagtggaaatgccaagacagcaaacaggacaaagagcactttggttcattctaagaactgaatcttggctgggcacagtgtctcatgcctgtaatcccagcactttgggaggccgaggcaggtggatcacctgaggtcaggagtttgagaccatcctggccaacatggtgaaaccccatctctactaaatacacaaaaaaattagctgggtgtggtggtgccagctacttcgaggctgaagtgggaggatcgcttgagcctgggaggttgaggctacagtgagctgtgatcatgccacactgcactccagcctgagggacagagtaagactccatt

SEQ ID NO: 500758 - DNA, 131 bp, Homo sapiens
tggcccgaaacatttacttgttaaaacccaaacattaatatggttggaaaaccctggattaagagggggacatggggaaggcaaagggtggccccatggtggtttccccaaaaaaaaatggggatttggga

SEQ ID NO: 500759 - DNA, 176 bp, Homo sapiens
ttttttttcccccggggggggaagaaaaaaaaacccccccctttttttgagggggggggttttgccccccggggggccccccccccccggtttttttaaaaaattaattagggggttcccccctttttttttttttagggggggggttttttccccgcccccctctccctttttta

SEQ ID NO: 500760 - DNA, 171 bp, Homo sapiens
catttattgtttacttaaaatttctggtggataaacaggctttaactcatgtgcaaataactttatataacatacgtttgcttcatttttttaggcaggattgaaattatccagattttttcttttgcccgggtttcatacttcgtggattcctccccctgttgcttctct

SEQ ID NO: 500761 - DNA, 671 bp, Homo sapiens
tgttccctttgtctctaaaaataaaataaataagaaatacttttccgaaaaatgaatgctaggcactagaggtgtctcctgcttttgctagaggcactggatataaagggggaaacttctagctgggggtagtggctcacacctgtaattccagcactttggaaggccgaggtgggcagattgcttgaacccaggggttcaagaccaacctgggcaacataatgagacctgtctctacaaaaatttaaaaattgtcatcccattctctactggaaaataaaaaattagctgggtatgctggcacgcacccatagtcccagctacttgggaggctgcagtgagagaattgcttaggcctgggaggttgaggctacagtgagccaagattgcgtcactgcagtctagccagggcaacagagcaagaccctatctcgaaaaaataaataaaataaaagtagttaaaatggtaaattttatgctttgtccattttaccataatttaaaaaatggcccaggcagtggggtctcttgaaggaggttatacttaagttgagacctagaggataagaaagtaccagtcaggggaagagtggtccagtcaatgggaaccgcatgtgcaaaggccctggggtgggtgagagcttagtgctgtgctctaggaattgtgagag

SEQ ID NO: 500762 - DNA, 310 bp, Homo sapiens
  misc_feature (46)..(46): n is a, c, g, or t
  misc_feature (58)..(58): n is a, c, g, or t
  misc_feature (63)..(63): n is a, c, g, or t
  misc_feature (89)..(89): n is a, c, g, or t
  misc_feature (94)..(94): n is a, c, g, or t
  misc_feature (104)..(104): n is a, c, g, or t
  misc_feature (124)..(125): n is a, c, g, or t
  misc_feature (127)..(127): n is a, c, g, or t
  misc_feature (130)..(130): n is a, c, g, or t
  misc_feature (160)..(160): n is a, c, g, or t
  misc_feature (164)..(166): n is a, c, g, or t
  misc_feature (183)..(183): n is a, c, g, or t
  misc_feature (210)..(210): n is a, c, g, or t
  misc_feature (265)..(265): n is a, c, g, or t
  misc_feature (278)..(278): n is a, c, g, or t
  misc_feature (281)..(282): n is a, c, g, or t
  misc_feature (303)..(304): n is a, c, g, or t
caagtgccatgttcattgggggttgaagtggtgagtgttctttganaaaccaagtgangaaanagtaaagattaatctgaagcatgcancattncttggctganataaaaagaaaaagccttanntnttnttccttattagctttattttactttatgtntatnnngtatctgggctgagtanagcttaatggaaccttgggagtttgangggtggttgtaaaggaaactggaagaaatagttactaaaggagattcaagctgtnattaaaggaattnatnngaccaagttgcagagcaagcnnagataa

SEQ ID NO: 500763 - DNA, 1248 bp, Homo sapiens
  misc_feature (195)..(195): n is a, c, g, or t
  misc_feature (998)..(998): n is a, c, g, or t
  misc_feature (1248)..(1248): n is a, c, g, or t
gcaaatggcgggatgacagccggtgcggcgggggggcccgggggccctgtgtggccctggggcatggtggaaccgcggtggcttccgcgtaggtttcggcaagatggcatccgtgggtccgaggtgtcgcggtccgatggtacgtgggaccgggagccgaggccgtttggagctcgcggaggctagggcgtaggnataagtgagtggaatgcccgtcaatgctaagtttgtgtgccgacattgtgtctaatggaccatgaaggagtcaaagtccctgcgagggatgatctatctcattctccctgtccctagttacaggcacactcagacgcatcacttgattgtcttgccttgggggcctctgctccaacgggatgaggtctctagagagcattattgctcacgttgccacgaatacgcaagaactcgccgtgtccccgagccaacgcctggcaacacgacgtgctttcgacagggccaatttctcggtttttgcctttactacttgcgcgggaccgtgaccaaaatggtgcgctaaccgatacggtgttgcctcgtggggtggtataagaggggtgtcttacccaacaagggtaggggctaggaggccccactcgggcccaaattcccccgatggagggggtcacctattgctattccccgtggggccccaacaaggcgtccgttccccatttccgatacccccaccggttcgcccgaacattgaaagggccttgaccctagtgggtgcgcaacccagatggactctgtgggaaaacgtcgcccctcagaagaacgttggttcaaccctttgcgacgaaggggctgcggatccggagggcctccgtccttggcagtggccttaccttagtttgcccttaagggtttaccttgctctgttcctaatgttccctccgtagctccacacctccactaatggggggagggccaacctcattgtggggccaggatttcgggggggcaccattccccgtgcnaaacagcgattttggattaggccgctgtttaaaggagaaaatgtgtgcgttacggctcttccatttttgaacgtgtggtgcattgtgggggtataattccgagaatatttgaaaccggtgggcttaaaaccaagcccctttcataaaggcccccagcggtgtgggggcctttgacacaccttttggcccaaaagcctcatttggggcggcaaatacctttattccgggcgcaacatatggtggggcccan

SEQ ID NO: 500764 - DNA, 76 bp, Homo sapiens
acaaagtcatcacaatcacaagcagtttatagttgacatattcttctagatcctgtgtgtaggcacatcttccaat

SEQ ID NO: 500765 - DNA, 391 bp, Homo sapiens
ctgggtcgatcactagacgtatccccgtcataattatcagcacagttattcttggacattactgggaagttcaagttatcaggaccatcagctctttatcccccagcattgacttactaagcatagcgggctctatgctttcacagttcgtgactcagcacacatgcctatcggtgctcctaaatccataacagtcatagtctctgctccatcaggaacagtacatcttcctggccttaatccattatacgcacgcgtgatgtcgtaaatgcttggcaggaagactggcagacagttgctttcattcttcctcaaagtatataccatcagctacagtccaaaattgctttttgttcaaggagatatatgaaaagactctgacaaggactct

SEQ ID NO: 500766 - DNA, 599 bp, Homo sapiens
catggataaggtatttatcttactgctccctaccctagaacccactaactgcttgacaggccctggtgtgtgataggtcccctccctgtgtccacgtgtactcattcaactcccacttatgagtgagaacaggtggtgtttggttttctggtcctgtgtaagtatgccgagaatgatggcttccagcttcatccatgtccctgcaaaggatatgaactcactctttttatggctacatagtattccatgctgtatgtgtgccacattttctttatccagtctatcattgatgggcatttgggttggttccaagtcttagctgttgtaaatagtgctgcagtaaacataagtgtgcatgtgtatatagtagcatgatttataatcctttgggtatacactcagtaatgggattgctgggtcaaatggtatttctggttctagatccttgaggcattgccaccatgaccagctaattaatgtattttcagtggagacagggtttcaccatgtttgccaggctgatctcaaactcctgacctcaagtgatccgccctcctcgtacctccccaagtactgagattacaggcgtgagccaccat

SEQ ID NO: 500767 - DNA, 200 bp, Homo sapiens
  misc_feature (134)..(134): n is a, c, g, or t
  misc_feature (196)..(196): n is a, c, g, or t
ttcactaaagaagaaattggcaagaggaaacctgtaaaggaaactacaattttatgttgttgatagtgaaatggaatggttctgaagtactgacccgtaagaaatagccctatgcactgattagtaaggagganaatttaggagagggaagcaaacttttttttttaatgtctagagttaacatagtctagaattngcac

SEQ ID NO: 500768 - DNA, 395 bp, Homo sapiens
agaggatcccccacctagcaacttccatgcgagacgcatcctcatcgccctcgagaggggggatctcatcaggaactgcagcattgggttcctctgctgccacttcatcttcatcaatacctagacctagcttgatcatgcgatagatgcggttggagtgggtctggggatcctcaagggaaaagccagaagatagcaggcggtttcatacagctagcaccaccaggtccttaacgtgccttatcattcttgttcggccttcagccttctgccgcagcgtctcctctaatggggatagctacagcgggtgatcttccacggtgcttttattggtccaatcagtatattcctatgttaggagatcgtcccagggagtgtcctcgggtctatgcaat

SEQ ID NO: 500769 - DNA, 1062 bp, Homo sapiens
  misc_feature (782)..(782): n is a, c, g, or t
ggattgctgttccatgaagatatttgatgtcagctgctcgattgcccaaatgactgtatccctcatagataaacgatctggtacatctgctctccatacatggcgacaactatgaagtataggttgagccataatgtcgagaaattccatgtgtggagtcaaggcaccaccagttcctgacgatcccgatatgtcatgcatgagatgaggtatctcggtgaaaacatgtcattgccagaggagccaaggtacttgcaaaaacatatgtcccatgttgcaaagggtgaccacctgtgtaaaggcttgactagtaccagtgcataccagatgtgctcatacctatcgccttggatgcgcgtatgtctgcgctgtatgccatgtgtatgggtctttcgagtcttcgagctagtagatcacttaggtgacgagaagtctttttgctactattctcccaatctaatgcgcacttaatagttcaccgtactcgatgtgcacgaggttagacgatagtgacttagagtttcagatagcggcacattctagctgccggaagcgaggaattgtgatcgttggattgcgatggcgcactagaagcaatcgtcgtcccctgcgtcggcctagttctcactttggaagtctttattaccaaagactggctacgtttactcagaatgtgattctaattacggtaattgcctattgatcaattggcatctatttatgggagctcaatatgttaaaataaccccgggtcgagttattcctttgacaagaagactccnacttatggacaggatctgtccctatgcagaccgagtactcccacgtagtcgccctaagtgatccagcaaagcacccaacctggtgcggaagcccgaccgcactgttcacgaacaagtaatcatcccctgcggctaccaccagaaattaaatggacttcattcccaacccttgaaggatgatttggtcgaaagattagagtgggtgaactttttattgaccccgacaggttcccaaagttcctctgggagagtttcctcccttggcttcgcctatctttac

SEQ ID NO: 500770 - DNA, 662 bp, Homo sapiens
  misc_feature (175)..(175): n is a, c, g, or t
  misc_feature (220)..(221): n is a, c, g, or t
  misc_feature (250)..(250): n is a, c, g, or t
  misc_feature (262)..(263): n is a, c, g, or t
  misc_feature (298)..(298): n is a, c, g, or t
  misc_feature (306)..(306): n is a, c, g, or t
  misc_feature (333)..(333): n is a, c, g, or t
  misc_feature (350)..(351): n is a, c, g, or t
  misc_feature (463)..(463): n is a, c, g, or t
  misc_feature (468)..(468): n is a, c, g, or t
acccagcggcaggggggggctgtccaatatataatcctagttaaactttaattttacccacacaaccctctaaatccccttgtaaattcatctgttagtccaaagaggaacagttttttgtacagtaggaaaaaccctcgcagagggaggaaatttttttacgggaggagggganactaaaagcagacaccatataagaaagcgcccaagattaacaccnnttcccaaaaaaaaccaaacatctaacaanaccaataacacnnaataaaaaaaactttatcatttatataaataaacnaatatttntcaaaatctacatataaaacattttanctccactttaatcacanntttaggaataacctccccatctccccaccacacaaccctaaacccttatttatcccacaactctcactaataaaattcaaccacaaactaaatacatccaatcatcgataanagggntataaatacactctcacttcttcctcacactcataccctccacctatctctttcttctctttttccctttcccttcccaccacttaataggctaagtgtcgagtccttggtttctcccttttctatgttttgttttctgctctctgtctccccccctctccggatttcattaaactctcatagtagaatataaa

SEQ ID NO: 500771 - DNA, 160 bp, Homo sapiens
  misc_feature (93)..(93): n is a, c, g, or t
  misc_feature (133)..(133): n is a, c, g, or t
ttatcgtggttcctttcctacctgtcagtgccagggtctttgggtcatccctctagttttgttgtctgcaccttccctgcaggttcctatcgnctctcagatgcgccttcatggtgggtgccaagcccctggncacatgctttcatttcccactcagaag

SEQ ID NO: 500772 - DNA, 816 bp, Homo sapiens
  misc_feature (222)..(222): n is a, c, g, or t
caggatacttcccctatataatggtgggatgtgcgcgacgggctcgccgcggcctccgcctcctcctttcctctgtacacggaatcacgtacttgaaatcgaagcccgctcccgacgtccgatgattagtggaaataaggtaagggtttaacaaaaactcctcgtcagtatatcaatgtctagcgcgccggcgaaccgacacacagaaaacgttagtatttnttgttgtttgtagtgagggttagggagcaggggtcggtcacgccccaaggatccccggctaaacagacgccaactcacaaaaccacccaccacagtatcaagaacctaaaatgagagggaaaaataacattgagacaagaaaaaaagagagaaaaacaacggaaagcggccgacccaaaccagttcgtgaggagaaacggaacaatcggtacagtttccaacaacaagacgaataacgccgtctcgtcgaatttacaccatccctgcgcgcgacatgtgcagaagaaaagggaggtcgacaccgtcacgcggcttcagggtatagagacaggacgaggataaacgtgcatggaccccagccaaaacgcaacctaagaacaatgacgagacggaggtgtcgcggagtaaggggactctagaaaatgaattgaccccgcggtcccgccctctcccgtcaccgcaatcaacaccatcctacctactcctctacgatcttagatgcgagtgtgtaaaccacgcgagcctcgcggacgcatcagcggtggtagatgactaaagatatgtagaacatctaacaaacgtaccacatacacg

SEQ ID NO: 500773 - DNA, 224 bp, Homo sapiens
catcttagaggttccccgtcgaaccctagtctttcacgcgtataccaatgagttgtatatttggtctctacatatcccatatttctcagaggtgttcattctttattttctttatttttgtctgagttattttggagagctggtctttgagctctgggattctttcctcagtttggtcaattctgttgtttattttgacaattctttttttttttttttttttt

SEQ ID NO: 500774 - DNA, 1125 bp, Homo sapiens
ggatcgcgagcccgcgggttggcgcgctggtcgcatgtggctggctcctttctgagcgcatgccgaacctctgaccccggtactccgtttacccctttcccggtgcgccccgtgcggccggctggaggcagaaacagcgagagagcgttaacagcagcagcggcggcgtgctgctccgccgtccgtctccgcgggagcttggagtgcgccctgtgacgcccagatgccgtgatcagcatcttcccgtgcgcaatgatccacagctcccgaacccagcgcggcggcaatcaagctgcacaagaacctcctggtgtcctacgtgctccgaacggcgcgccagctctaccctgagcgagcgctaccgccgagcttctaccgggcgccagcatgcacgcagcaacagcaagcaagccgccccaaccaccagcacccagcaccttagccgtacgcggacgccggcctatccgggacaagctgctgtcccggacattcgggcccggcctccaaactttggcgggcgtgcacggtgggaactgccagtaagaggcgcctgcacagaagacccagaatcacagagacaccgaggaacacccaagcatatagacacacaagagcttcaacaacacaatgagttccaaacagagcgtggcaacattcagaagaacaaaagacattaaacacaataacacgacaagacacccggatgaacacccaaggaaatattagaacagacaaagaataatataaacgagcaaagcacaaagataaatagaaaacttaccagaacacgtcaacgctaacaattgacaatatgataaaagttatactaaaaaagaaaaaacacatagctaaaaagaaagaaaagaaagcacgaacacaatatcactacataaccacgaacgaagcaatcgaggaatgatagaccacaacaaaagccgcataggagaaacgaccccaatatcgagagaacctactattaaaaagcagcaacgaagtgaaaacctacaattacgccacgagatagagacagctgaacgaccaagagagcgccagaagcacccgacgagacgaaaccaacaagaacatacagatctcatccctcgcacaggacgcacgaacacaacc

SEQ ID NO: 500775 - DNA, 675 bp, Homo sapiens
  misc_feature (58)..(58): n is a, c, g, or t
  misc_feature (410)..(410): n is a, c, g, or t
tgtttggttcttctcccccttaaaaaggaaattccaagtcccgggccatgtacacggnatagtccatcaccaacaacctccaaggagaaatgtgccctgaaattcacaaaagggggagctctgcgccaacaaacagtgtttattacagctcactctggaccgctcttctgatcagaaatccagcaaggaagatcctggatttctctcctctacgagctatattatggcaatttcataaccacgtaggaactccctgaggcctgagcatgctgagccattttgggactgttctgtctcatgttatctcagctcttatctatgaagacatcttccagtagtgtccccagacacatcaagtcatgggtcacacctgcaaatggaaggagttcctctatcatttgccaaatganaatgtaataataatgaatgtcatgcaccgctgcagccagcagttgtaaaattgttagtaaacataggtatcattaccagatagttatattaaatctatatcttacatatcataatatgtgatgattaagacaatattaattataataaaggtcacataatctttataaattcataactgtagctataacttgagcttattcaggatggtttctttaaagccataaactgcacaaatgaaaaaaacacaaaaaaaactcctgcagc

SEQ ID NO: 500776 - DNA, 242 bp, Homo sapiens
tgtccagagatacagtgcgcacaataatggctcactataacctacacctcccacattcaagtgaatcctccatcctcagcctcccgagtagctgggaccacgagctattcacctatatataggttgactcttctgctctctcccttctgctgataagcccgttcagtgaattttttatttctgttcttgtgtatttcagttctagaatttccatttgattgttcttttatgatttgtttctt

SEQ ID NO: 500777 - DNA, 309 bp, Homo sapiens
  misc_feature (282)..(282): n is a, c, g, or t
  misc_feature (304)..(304): n is a, c, g, or t
acctgggcgcccgagaatggaatggcagagcaggcgcatccatggcatgagtgagttggtgaccccggacagcagtcgggagaagaaaagaacgctgttgcagttcctctcagatcatttccaggacatccagactctgagagagtacttgctccagaaacagatctcaaaagtcaacagggagaatcgtttgtcaatgctagaggattcccagggtcagcccccaggtttccaacacttcactgtgtggcctgcctgctcattcctttcattttaagagangctgtcacatagctcgggccanctggc

SEQ ID NO: 500778 - DNA, 167 bp, Homo sapiens
agtagagacggggtttcaccgtgttagccaggatggtctcgattacctggccttgtgatctgcccgcctcggcctcccaaagtgctgggattacaggcgtgagcaccgctcccggaagtattcaaactttcatccattagtttgggggtctcacgaattccgctgag

SEQ ID NO: 500779 - DNA, 451 bp, Homo sapiens
  misc_feature (13)..(13): n is a, c, g, or t
  misc_feature (17)..(17): n is a, c, g, or t
  misc_feature (20)..(20): n is a, c, g, or t
tcaattcatagcntgcntantacgaggcgtggtggcctctggcgaggggggcgtgctaatcgaggtgtagggcgcgggcgctttcctggctggcggccggctgcacacaccgagctgttccgggcgggggagcccgcgttgtggcagtggcggcgctccgaggccgcctggtgtggtgcgaggagcggcaggcccgggccgagggcccgtcagggtcgccagcagccgctttcagccactgtgtgtagcgtcctggactctaagagcccagctggtgaagctagacaccatgccttgtgccgcacacacgtacctgctagcacacacttgccctgccttacgggcttgctggcacttccctgcagacaactacttacctggttgcccaactgccaccaaccttgtgccttggctgttggccccacagttctaactacaattctgggagccc

SEQ ID NO: 500780 - DNA, 947 bp, Homo sapiens
cccaagcgtgacggtgcctgcctgtagtcctagctacttgggaggttgagacaggagaatcgcttgaagcctggaggcggaggttgcagtgagctcacgccactgcaaccccagacctgggcaacaagagatgaaaactctggtcttccaaaaaaaaaaaaaaaaaaaaaaggtttttctccaatttgtgttgcgccggggtggtttaccaaggttttaaagggccaccgcgccttatgtgccctcattccctctcgggagaaattttcacacaacctttcccaggttttttcacctggtaatatgcgccggggtttcccaaaaaatttccccaaattttaaactaaggccggttggataaaatctccgtgacacagttgggaaccctcccggtggtgcgcctcttcaccccaattttaaaaagatctgtgggaacacccgtttttgcaattaacctcttagaaagggtccaccctcaggggcctccctctcccaagtaactaaccctggaggggacacgccccatgggggggggttttccccatttcgcccatattactatttaggtggggcccattacgcctggaacgttccccttagaaaaattacgcgggccatcacaatactcccgtggtgggccatgggtcccccacaaccatgagatcgtcgggaaaatcccacccgaggggtggccccaacgacgaaaggacgcggacattaatcaggcaggaccacccgcggcttggcaccaactcgggcacaactcggacccgcggggcaatcggcaatggccccaagtggggccctaccggtaactaccgccgggaaccttgacgcttaaaaacaaacacaaccaatgcgccgcgcccggccccacaaaagatctctacacatggtggcgcgggccaagagaatggaacgcacacgccccagaaccggcagaaagt

SEQ ID NO: 500781 - DNA, 111 bp, Homo sapiens
aacgcatgtatagaggatgcgggtgaactccacgtagtaagaagtagcctatatctatatcaatgggtgcctcccggtacatctcgtccacttacctcctctgtgctgtca

SEQ ID NO: 500782 - DNA, 369 bp, Homo sapiens
  misc_feature (9)..(9): n is a, c, g, or t
  misc_feature (62)..(62): n is a, c, g, or t
  misc_feature (67)..(67): n is a, c, g, or t
  misc_feature (69)..(69): n is a, c, g, or t
  misc_feature (71)..(71): n is a, c, g, or t
  misc_feature (79)..(79): n is a, c, g, or t
cgcggcggnactgacagacgtgtcgggggtccggggcctgtcgcggttgccaagcgctcggntggcntngngtcgcttngccaaggcgtggcaacagtgttgcaaacaggaacccgaggtgttcacttcactgttgaaggaacgagagggcatctgctaaagtttcagattccatttctgctcagtatccagtagtggatcatgaatttgatgcagtggtggtaggcgctggaggggcaggctttgcgagctgcatttggcctttccgaggcagagtttgatacagcatgtgttaccaagctgtttcctaccagggtcacacactgttgcagcacaggtagaaaattatgggcatgccgttttagcaga

SEQ ID NO: 500783 - DNA, 512 bp, Homo sapiens
agagcagaccgtgtgcagtggatgtggaaagtactatgagcttgacctccaggaaatgctatacagattaaaatttcagtccattagcagttactgctgaaagcaagaaatgctctcttaatcatttcaccatccatcttatgaaatgtaatgtcctcttgacaaaagtctgagtaccaagattcaggaaactcattccctacagaacaggtgttcgtttagtcccaagggatgatctaataggctgatttagtcagagacagcctggtgggagactccgatatagaccgtccatgctgtaatttaaagtaccatattaagttggtagtagtataggctaggcttaaaattgcactcctcttgcctccccgctcccttccaaaacaaagaaaaggtgaaaggaactctaaagagtgtcatatgcaggcacatctatataaaagctgggaaagaaatgcatattcctgccatttcccttcgtgtagtaccccagtttaattcaactacctcaa

SEQ ID NO: 500784 - DNA, 236 bp, Homo sapiens
gcagaaccttactaaagtagagggcacaatcagtgtgaattaattcacttcagagatctcaagtcaagggcagggcacggcggctcacgctgtgattcccagcactttggggagggccgagacagagcggatcacctctaggtcggggagttcgagaccagccttaccaacatgggagagaccccatctctactaaagaatacaaaattacctggggcgtggtggttcatgccttt

SEQ ID NO: 500785 - DNA, 1271 bp, Homo sapiens
  misc_feature (439)..(439): n is a, c, g, or t
ggcggatgcgcgcgtgcgctagtcctggaggctagtggtggtggtggcatccgtcgcccgagacccggccgacgggacccctaaagttctgcttctgtcggggcaggcctgccgtccgtgctgccggacgtccctggccggtgcaggccctgcctgctcatggtgctccgtgcccttacgatgggtccaggccgcggaggcaagcgagcgggggtggcttgtccgccgcggtcggcgcaaggcgagacgtcgctatcgatgcgccatgaggcgccccgagggacgaaagcgctcgtgatcgcatcgacacacttgaagataccaccagtagacacctcagacttgtcagcaaatcgaagagaaggcttcggaaatgagttgtaggctggcaacaagctatacgttggatacggaatctagcaacgatggagccacccgngaagagaagttttcgcacttgcatagacattgcagccgttgtgtaccgccagcatgaaaaaactcattgggcctttgctgagattagagagaattcgccagtgcagatataagatagctagtcgactaggcgtgcatgagatgccccggcgtgggcttggtctcggatggagcggatggcagggggccccgcgctgcagtgctgcgcccacgtcgttaccgggtccactcgtcgagggctgcgccccgagagttggtgcctttgggtctcctggcgcaacgtcctttcgaggaccttagcgggttgcgaccccatcttgggaggtggcccgatttcctagcggcacgggggtttagttgacccccgtctccgaaggaaggccatttctccctgcagttcgttgttactctgtgcggggtgagtcggggcgtccttttgagcactttccataaccttctggtgtagtcacttgctcggggtgaattccgttggggcctacccttttgtgtacccccaaggctactgggtcccgatgccgggggtggccctctttgccccgccgagaaaaatccgtgagccaaggcacagtgcgtgagtgtagtcattgctctcgaggcaacgtgttctaaactccccgagagaacacggggaacccaatgcgtgtcccattctgaacccagagagaaatatccttcctttttccttttccttgcttgcggagatgaatagtgaagacgtttaccgaatgcgacttgcgcccacagggcttggggcaccagaccgctctataacatgcacatactttggagattcacgtgtagtcggagctcac

SEQ ID NO: 500786 - DNA, 216 bp, Homo sapiens
ctcttagcgaagtggaggggaaggaggaaagagagacggggatatgtagtgtaactattgacctcccatctgtcctgttctgccccgtatgacacacacacagcctttcctctctgcttaatctcctttcaggttacaaacgcttcttaaaggactgatctaaggccatactccctttctgtctcccttcttctctcctttccccacaagccgcgt

SEQ ID NO: 500787 - DNA, 872 bp, Homo sapiens
  misc_feature (354)..(354): n is a, c, g, or t
gttgatggacttttgggtctgagtgcctgtaaccagattccggaaacgacaggacagggcctggtgatgttgatgatggggatttgaacgggtatgctgaagcttgtaatgcgagtggggtttcctgcgttttatgcaatggctgtagatttcctcccacttctaaagcgctgcctttctgtgacacgcagggagagttcagtctgctagttcgtatggaaacttggggacctcactgtgctgcttgctcttggcagaggatatcatttgagctgtcatagcagaggaccacatttaccagggtgcactttggccaaagaatagtaacctttctaaggcttagttcctctggcntgaccaaaccagtcccaggaggcccctgggttccagtcaaggtcatgggagaggcccaccatggatgaggcctgggggagcagggtggaaattaagtgcccaggtatgttatggatagcctgcagccctctccaatccctaccctccaaacccagtgaagggggacatgaaacaggtgaggcagaggagcaaatgcgggtcaagaattccgaactatacttgacttacagtgcagctgtgatgtgcacattggtgtgtgccacgagacagcatagtgtggtggaaagaaaatgggttttgaacagagtgtcctgggtttgaatctctgcttgcccatgtactagagagtagtcgaacctctctgggcctcagtttcccagatgtaaaatgggaatagtagtacttaccttgcacgggtgctgagagaattccatgagacgacacaacccgtgtaaagtgcctggcataggcatatcacattagggcactcagtaaatgtgatgtcttttctacttgca

SEQ ID NO: 500788 - DNA, 119 bp, Homo sapiens
atgtatacatgagcccattctttctccgccagtattgaacggtgagatcttgccctcatcaaatgaaacactcgtcctttgttcagagcactcttactctttcctcgcggatgcatgag

SEQ ID NO: 500789 - DNA, 393 bp, Homo sapiens
gtcgcgcggtattatgaaatagctgtcgtcatcacagtgcgccgatatgcacgaaggtgggtcatgctgagatcaggcaggagaggctattatttatctatgttcaagagttcctcaaagtagggaagattaaaaagcaagaagagtttctcactttaggcattactcttgcgactttcctttcatccatgttccccgggggattccttgaactcctttgccactgcttcaggcaaatttaggggagttctgctttattctacagtggatggtcccatgcgaggttaatgtgtggggcagtattaggaagctcaatcttgaggccaagtggggagtggacttagagcgtagcagggattgattagagacaggcagctgatgctccagagaggg

SEQ ID NO: 500790 - DNA, 646 bp, Homo sapiens
atgacgggaaatgctgtagataaaatcacatgagcgattcctgagatacaaaataggttatacagcagcagaagacaacacacaacatcaacaatgcatcggcccaggaactgctaatgaacatacagtgccgtgatggctcaagacgtttcgcaaaggagactggagccttgcagatgaggagtgcagtggccagtcatcggaaactgataatgaccaatagagaacatcatcgaagctgatcctcttacaactataagagagctgcccaagaactcaatgttgaccattttatggtcgtacggcattggaagcaaattgaaaaggtgacaaagctcaataaatgggtgcctcatgagctgagtgaaaaataaaaaaattcgttgttttgaagtgtcattctctctattctatgcaacaataatgaatcatttctctatcggatggtgatgtgtgccaaaaggtggattttatacgacaactggcgatgaccagctcagtggctggactgaaagaagctccagagcacttcccaaagccaaacttgctccaaaaactggtcatggtcatagttgggtggtttgctgccagtcagctcaactccagctttctgaatccaggtgacaccattacatctgataagtat

SEQ ID NO: 500791 - DNA, 105 bp, Homo sapiens
acgcaatgaaaagaccagagagactatgtacatgtaattataagctagatcacttctgggactaggttttcccagtgagggatcatgaagtccccaagtgattga

SEQ ID NO: 500792 - DNA, 225 bp, Homo sapiens
tggtttcagctccaaggtcttctatgggtaagtaacaaccctttgttcagcatagaatgtgtccaagtaaggttctcggaaaaagtgtctggtcctatggtctgttgtgcctttcaatcctgtttcgtttgtgtgtaatgcaacaattgaccaccgggaggcacattttaccctgtgtccctcgtgatacaataaaatcccacactcagatacacgcgggttaat

SEQ ID NO: 500793 - DNA, 768 bp, Homo sapiens
  misc_feature (222)..(222): n is a, c, g, or t
gctgagctgggcatcaggtttgcggcactgagccgtggaaaatgagcgagtggatgagaggtactggcctgtgctgtccatggagctccacgagcgccaaagaggtaacctcaagggagcgagagggcctgtgatgcgcctcatagtagctgggcttgctagcatatgatgaatggatgaggcttgcaaggatgaagcgtgacatggctggtcacatgcagncttgccggttcatctgccgtggccttgcaggtgccgcatgcctctgcgcacgaggccagaggcagtgagagccttagagccctcccacatagtgtctgcacactctagggagtctcaacatgcctcatggcttcgcagctgacgttgtctgacacatccatggagcctagcaataagccacgacttaattgaatgcttggttgaatgagttgcaaccagctctcaggggccaaggcttgaggatgcgatgccggctgcatgcagtgcgtgctgaggaagctgctggagtaagctgatggggcacccaagcgagagcactcggtgagtatgaaagcttgatgcttgcgacgtagtcaagcccatcgtatgcagaagttgccacggctgtgccctttgcatcggggatagtggacacaggacgggcgggctgccccttgcagtgaaacgaccttagaatgaggacgccagcaggggaaactcggaagaagccaccaatcgtgagaaatccaaccgagtattacgaacaaacatcatgccaaggcaggt

SEQ ID NO: 500794 - DNA, 382 bp, Homo sapiens
tgaggatccctgcttactgggcgtatggtctttaagaaggggcggccaagcatggtggctcacgtctgtaatcccagcacttcaggtggccaaggccggagtatcacttcagtccaggagttcgagaccagcctgggcaacatggtgaaaccccgtctctacaaaaaattacataaattagctgggcatggtggcagacgcctttagtccctgctacttggaaggctgaggcaggaggatcatctaagcctggggagttcacggctgcagtgaactgtgatcacgccactgcattctagctttggtgacagtgagactctgttttccacaaattaaataaataaaaaagggaagaagctagggagcccaagatgtgtctaaa

SEQ ID NO: 500795 - DNA, 483 bp, Homo sapiens
ctctgtaaactattcctaaaatgtgtatgatatatttgaaaaggcttccattaatataatagctttgcttgcagccttccaatctatgttggtttacctgtagtgttttataaagtgtggtcagaggcccctatagaatgtattgtttgaaagtgtagtgatatatttgtgtttttatttcaagtaagtcattttacctgtatgttcattaatattcatttatatggagtctttgttagaaaggaaattgttcgatcagctatcagcagttttggcccaaggttggtgttggttttccctgtcacgctctccttgtcacaatttctaatgcctcgggtaatgtgccaagtgtacagttttaatgatgtagcctttcaaggcattatgttcagtgtagaaacataggtagtattgcgcactgagctgaccactgtggcaccccttctcggtgtaactgcatttctcattttaattgattgagtg

SEQ ID NO: 500796 - DNA, 227 bp, Homo sapiens
cacgaggataaccacacaaaattagaatgcaagtactcagggaatatgtattgggggacgtgggcacaaaattagcgactattttgaataccacggtggaaatggatcaggtcgattaaaagggatacctcctgcaagccgttctcctcaagattcacattcaaattctactccttcctcatccgttcaatcgagaattccttctcctactgcattaggatttgggg

SEQ ID NO: 500797 - DNA, 213 bp, Homo sapiens
  misc_feature (56)..(56): n is a, c, g, or t
cccctaagatccatgttgaagccccaagtaccagtgcctcagaatgtgactgtatntggagatagggcctttaaaatgaggccagggtgtgccctagtccaatgtgactggtgtccttataagaaaagattaggacataggagagacaccagggatgatgagtgacacacaaaaaaaggccacgtgtggctacagcaagaaagtggacatctg

SEQ ID NO: 500798 - DNA, 430 bp, Homo sapiens
actcgttgcgaccgagagtatgcactcggcatgtctcaaggctcacccaagggttgaacgtgatgaaggtcggattaagctggacgccggcctccttcaggaacgccgacgcttcctcgaccatgggcacgttcatttccttgaagacctggtcgagaacctcctgcttggggaactccaacgcggtggtgatgaaagcaagcccgagctgccccatttccttgagggcgtctttgttctccagaatatgatccacgcgagtggtgaagtcgtacgtgagctcggggaactgcgagtgcagagtccggatgattttcaaaccgtgcttcttggcattgaaaaaatcagcatccgtaaaggtgaggtgagtcattccctgtgcgacgaggttcgccacgtcgcgctcaacgagatcgtcggagaacgaccc

SEQ ID NO: 500799 - DNA, 1537 bp, Homo sapiens
  misc_feature (1509)..(1509): n is a, c, g, or t
  misc_feature (1537)..(1537): n is a, c, g, or t
ggacaattgaagactattactcgttgtctagaacgtgcgcaggtatgcctcttctgaagatctgaaagctgcctaccggaggctctgtatgctctaccatccaagacaagcactatgagacccagtaggctcaaatgtcacatggctggaacgacatgtttaaccgttgttcaccgaggcgttatgaagtgcttagtgacccccatacatccaggggtcgcatctagtgattagtatactgtggaaggagatggagctgtgcacaagtggtaatgcgatgggaggtgctagctgtgaaatggagagtacgataaccccatgtctgtacagattacgcaggcatggagcttgtgaggcgggctgactgaagtacgcagagcagaagacgaggagtacttgcaggcatgctgaaaaccaatatcccaacggtgataacgagtcgagcgtgtgggtaagtacgcatgctcgaccagaaccgatatttcgactcagcctatgtgactgaagggaagtagtgagacgaagtgtggtcccggacaagataggtcgttctcccggcaacggcatgttagagagagtccaacgtaaatactagcactaattattcacctagatcagaataggaagggcgacgcgcgtttgagcaggccgaaacaggtacatcaagagcgaattccttcctactgtgcaaagcaactcattcaacactccacaggaagagtgtgcaatcgtcgtggatggaacggttatacctagttagaccttgtcggcgccatcgagcacaggaagataaagcttacggagcacaacgcgggactgggcggcaagaagatcgagaattcatcggacgaccttgtgaacgacccataccagggggccctatggttacggatctcaaaggcctgttgcaggaaatccttcgacagccaaagaagagagtaattggcgacagaaccaaacagtaggggctacataggcaggagatcacacacccccgcgggagaacatccacgagaccaggagcattagaccaacagtgggcaaaagccacggaaacctaagaaaaaagaacaaccgagaggttcacctggcagagggcgagagcgaggaatcacagagcagaccccagtagagaacaaagcagcaaacggccgggaaaaaactaaaaaagagagggccacctgcatcggggggcgccccagcagtgggagaaaacccgagcacgacaatggacacagaggcagataacagacaagaaatcacaagagacagcagaaccaagtatgcagaagagtcactcaaacgagagccagcttgagaaccgatacagcaaagcagagaaagacaaccctaagagccatacgaagccagcacgagtacaagccaagcacaggagaaactagaagcaaacgaagcggacaagacagacgataaagcagaccacgagataagaacgcgtagagatcgagcacacgaaaagctacacagtatgttgctcgccgcagtatncgcgcgtagtagcgtgagatagagggan

SEQ ID NO: 500800 - DNA, 451 bp, Homo sapiens
cccgggctgcaggaattcggcacaggatagtagtagtagtagtagtgtagtagtagatatatatagatagagagtgtagagagagcgagcgatttaccggcgtgattgtgtgctcttccccttgcccctttctcctttctgccctttgtcgctccccctgctctctcctacctctttcctgccttctcctctgttactcgctcacctccctctcccatcctatcctgtgctcgctcctattcctttcctcttctacactgttcttcagacttcgtccacttccccttcgcatcttaccgctccgtccctgatgtgcctcttgtccccttattcctcttgactcatgcctcctactcctcatccacactcgccatttcacacgcttctgctttccatgctctcacactgtcctgtggcttcatacttcctggtcatctcttttctcactgtt

SEQ ID NO: 500801 - DNA, 106 bp, Homo sapiens
gatcctttaggcacattcgactaggctcctacagaaaacgggaaaccgtcttaaacacatttgccaatccctgggacccgctgttaccaggaacatatgttgttct

SEQ ID NO: 500802 - DNA, 100 bp, Homo sapiens
cgaagaagcacccaggagggctaatgatgaaggggcagcagtcaccagagcgcccaccgggcacacccccctctgtgctgtccacctcctcatgtgctgt

SEQ ID NO: 500803 - DNA, 152 bp, Homo sapiens
ggctgattagaggatcccgaacgggtgatgcggtgcttcgggagagggtggggtggacggcagcagcaggcaggcgcacagtgagccacacccgtgggcagcgatgtcgccgtgcatgccctccctgccaggcagtctggcgttccatcctc

SEQ ID NO: 500804 - DNA, 851 bp, Homo sapiens
gctgagtgccgcgttcgcgtagtctcgcgcgccgcgtccactgcgcgcttcgctctccgccgcccgaggcccgctgcgctcgccatgtcccggccaccgccaccgcgggtcgcctcggtgctgggcaccatggcagatggtgtgcgcctgcatggactgcgccctgccagcgccgctggcctgtgctgcgccgtttcttggagcgcgtgtacacacccgaacctggacactggccttcatgtacatgcgaccggccatgtcctgagaccatcctgggctggcatggggctcgggctgtgtgcggtggcgactgcagagtgaacaattgccaacaaggccaacccttgggatggaaaatcactaaagcctgacagtgtccggtcccagtttggagcaccgtcacttgaagaggctgacagtgtccccaagtgggacctcttctacctaccacgacaccttgacacacggaaacccagagtggcaagcagacgcttgcattgccttgacagaaggaatggaccaggagggcaagttcgatggaagctttgggcctcatacacgaactatgctaagctgcggacagtgggccagaggatcttgaacccctcatgccaaggagcccaactggcttaggaatccattgacccaatagttgttaccaggggccattgtaaaccaccgacccaaacaaacacacgggcaacggttggaaaaacggacagccacctttccccctgtgccatccagggcaaccttttgagaacttgaaagggatacctaatggccgtaacaaacgccatcttggacatggcgtgcgccctgcttaccttggaaaacgtaacaaagatctg

SEQ ID NO: 500805 - DNA, 175 bp, Homo sapiens
gactcccgtttgtggttgcgcactgttcagccgatcatggaggaaatcagtcgtgacggttgaagagcgccgctgcaacattgggtgcatcacgctttcagacaatctggcgtgtgcttctgcccagcttgcaacctgccgttctgaccggctttgcgctcgcttttgcgcgtgg

SEQ ID NO: 500806 - DNA, 400 bp, Homo sapiens
tcggtctcggtacccgtcagacgctgaactatgtggaattggaagtttacttagagtcaaaaacaagtacaggaaagtcagttcttactcaagagttaggttttcaaagacagtggataaaataaaaatctagtacagtcaagattatacgtgcaaatcccctcatcactcatacagtttagcagtcagtcttaccgtggctcaccaggtccaatccacacttcttcctccacgattggagcagagggtgatttttttttatgagcaactgatgaagtcacttagaggccatttgcggtaggagccctgtgtactagagaccaatcaatgcgcccccatggcagcatttccacctctctccctctttgttcttgccaagtacacatagttcagcgtctga

SEQ ID NO: 500807 - DNA, 193 bp, Homo sapiens
gacaacacattctcctaatctttgtatatctggaaacatctttatgtcgcctacatttttgacgattagtttggccagaatacagagcatattggcttgatatttttttcttttacgaacttacgagtatgtcctccccgttgtctcctagttacccgactttttctagatgagaagtcagctagttgaaatt

SEQ ID NO: 500808 - DNA, 769 bp, Homo sapiens
acagtgatatgactgcatctttaagaagtgaccattatactgtgtatatatatataaacacacacacatatatatatatatatatagtactctaatactgcaagaaggtttttaaaacttcccactttattttttatacacattaatcagatatcatttacttgctgcggttgcaactatgcacttgtataaacgccataatgtgggagtttatatcactcattcgtgtgttacctgatggaagtcgcatgtcatgtataagcagttactgtaacaagaagtctacagttccattatatcagttcacctaatgcttcactgataggcaatttttacccattttgaatgccttaataaaatttcttctacaaagtctcagccctgtcgtgtcattaaaaacacaaaaaacgcgtttaccagctcttaggatgtaaactagctttgtggaagataactcgcgcacctatttatacacataaatagttatatcagtgtcagcctatttgataaaaccaagtgtcgtaacaagtattcagtggatatagcaaacaactattgcatgggtgttggaaactcattatttccttgaatgtcgtctactcatccactacactctttaacagacctccacaattatctgtactaccaggaccacatcacaccacaatcaaaatctatgctcgctccttcacgaaacagatataaacacattgtagggctcacccatttatacataacccatccggcacagaacgcggcaaaggacgcc

SEQ ID NO: 500809 - DNA, 703 bp, Homo sapiens
aaccggggatggcggccctggctttttcttctctctgagatgcgtttccctgccaagttattggccatgctcttctgcatccccaaggctttcgaggaccgattgggtgctcaccgtggtggccgctgtggggcaagccttcgcacccacagcactatgggcagcaccacctcggctacctacttagcttgggggtgctctcttgcctgggctttgtggtcctcaagctgttgaccatcagctcgcacggtggcgtctcttccagtgcctcacaggccacttctggtccaaggtttggaactgccccagtttcactttgcgtttttgtttccgacgcatttcaacaatcacccaagatttcattccttttgcgggaagaacgcttgaaaccaggggagaaacttgctgaaaccgttgaccccccacattgaaattggactctgagatgcaggcgtgtgcccagtgtcagacatcctgtgtgtgatgatatgcactgatcacacaagactgcccctttcctgagaaagctccgggcttcggtgtggaggggtggagtgctgtgatctcgacaacttactttcaaagacataaagcacagatctccgcacaggggatgtgtgtgttcctgatgtaatttgcataacttttctgtagtttgaaatgtttccaaataaatattggcaaggggagtggaaatgacacc

SEQ ID NO: 500810 - DNA, 108 bp, Homo sapiens
ggaccagcgggggggagcagaggtcagtggcccatcagcaatcgaagtccctttaatgtatgtgcgttccaaccggttgtgttcccgcccagacatttgcgcgggatg

SEQ ID NO: 500811 - DNA, 141 bp, Homo sapiens
cccacgtcgcctgtcacccaatatcttcagccgcgcagtcccgaagagtgtaagatgttcgccttcgccaagctcgcctgtcaccgttctctgatccgagctggatccagagttgcatacagaccaatttcttgcatcagt

SEQ ID NO: 500812 - DNA, 234 bp, Homo sapiens
ttatcccaacactctggaggtaggaggagatcatctgaggtcgggagatcgagaccacttacaacatttgaaaaccgtgctactacaaaattagccaggcgtggtggcgcatgctgtaatcccattactcagaaaggctgaggcaggagaatcacctgaacccgggaggcagaggttgcagtgagctgagatcgcaccatttcactccagcctgtgcaacaagagaaactccat

SEQ ID NO: 500813 - DNA, 556 bp, Homo sapiens
cctcttgttgataatttgtgagcttaaactctgttttttgagacttccctgactgattcttataacaaatgaattctcttctaagcaacattcaagaggctcttgtgggataaaaagcattttttatggaaatcaacggtatttacaatgtcaatagctgatgtatttttgtggatccagtaaattcccagtctctcaaaagaaatcatttggaaatctgtttattccaatagaaaacatttcttttatgttgttcagtttgttcagtttaaaacttttggggaataacttttcctcaaacatttggtgatttgtggggtttgggccatctttaaactggaagattcctaatgctgttcgtggatgaatgtcagttttaagggttgtttgaaagaaagggcagtcaaagaaggtttctgatcgcggggacctgggcttcatttgattttttctaaaaatttgaagtgggaaataaaaggggggtatttgttttttacgcccccatgatgcaatattttaaagggattatttaaaaaagttccatcttgaggcttag

SEQ ID NO: 500814 - DNA, 310 bp, Homo sapiens
  misc_feature (111)..(111): n is a, c, g, or t
gagctcgcgcgcctggacatcagcaaacaggatcagttaactattgcatttatatgtaccgtagctttgtattcaaaaattatctatagctaagtacacaataagcaaaancaaaaagaaaggaaaatttttgtagtagcgtttttaaatgtatacttttaggaccagtgggggcttataattaagggcctttattttatttgggaggtgacttttaggacatgaaaatgaaagacaattggggtagtttttgaattatgtacatttgcataaattctttcaatttggggcagatttaattttttccttt

SEQ ID NO: 500815 - DNA, 593 bp, Homo sapiens
ttgtggaatgttgaagagtctgtctgggcccgaggttccctatactgaagtaagtaatataaggttggatgaaagaagaagcccagttttaagtaagtttgaaagtaaagtagaagacttgaaatttcctactaataataagtaacaaatgaagatttcaaaaaataagtgttttagaaaactaaactatttgttaaggaaaggtattctgaatctgttctaaacattaacataacttcctctaatatattgaaagagtaattttatagctcttatgaaaaaatattgatttttgtgataaaaacttcaaaacgaaatagattgctaggagttcatgcctaatattgtttacaggtagaagtctaaggatagtacctaaagcaaaagtagattccaaagatggatattgaagtttatttcaagtagaataagcacatttcaataatataattttaaacttgcaaatcaagaaggtagcatgttgtgtatttatgtatatttatgtacatatattcatatgtatacatgtatatgaatatctaatttttgcatacctggaaataaatgtgtgtgtctgtgtgcaaaaaaaaaaa

SEQ ID NO: 500816 - DNA, 367 bp, Homo sapiens
  misc_feature (91)..(91): n is a, c, g, or t
  misc_feature (270)..(270): n is a, c, g, or t
  misc_feature (296)..(296): n is a, c, g, or t
  misc_feature (298)..(298): n is a, c, g, or t
  misc_feature (322)..(322): n is a, c, g, or t
  misc_feature (324)..(324): n is a, c, g, or t
  misc_feature (356)..(356): n is a, c, g, or t
ccgagatctggctgggcctcaacgacatggcgggccgagggcacctggcgctggacatgaccaggcgcccgcatcgcctacaagaactggnagactgagatcaccgcgcaacccgatggcggcaagaccgagaactgcgcggtcctgtcaggcgcggccaacggcaagtggttcgacaagcgctgccgcgatcagctgccctacatctgccagttcgggatcgtgtaaccggcgggcgagggccgtggggggcctggaggagggcagganccgcgggaggccgggaggagggtggngnccttgcagcccccatcctctccgngngcttggagcctctttttgcaaataaagttggngcagcttcgca

SEQ ID NO: 500817 - DNA, 648 bp, Homo sapiens
ggatccccgtttccaagcggagatgctggcagactcgctggagggaaggcagcagtggctacagtctacatctggtgaaatgagcttggctggcgttgtacttgcgtcatgattgcctctctcactttctcatactggatggatgtgtggcattcacgcaacagaatggggaagatgatatgaataaatgaagaactagtgaatggatactgaagagaaatatatggggtgtagcgattcgtgtaatgccctgtgtatatacgaaaggcaggttcgtgtagacagaacatatgtggggttgtcatgcaacagcagtagtactttgggagaaggggaatgagggggtggaggtggagtaggtagaaggaggactttcaagttccagtgcttaaatactagaccgcaaggaacagtctggtctcctttagtgaagaaatcggatgctcatttgctgttctacatgcgaccttctccaaaatcttaacaaattctgtgaaagatatggcactgtccccatcctgatcagcctcctgaatggtcctgtatgcgatgctgcccagctgctcatctgagatatttactccgaccatcatgcgtagcagctgtaacagctcatcacgggagatcttttcatctttatccgaatca

SEQ ID NO: 500818 - DNA, 486 bp, Homo sapiens
  misc_feature (27)..(27): n is a, c, g, or t
acggagctactcgtagtctactgagtnatatataattagccatatatattgatagagagatcatacaggtgtactgcaaaaattggtgatcagaaagttaaacagagtatggaaggctcaattggcagtaattatattccaaaatattattgtaaagggtggatgcaaaaatccattttccacagaaattgtattataaatcacagttaagtttcaaagatggtctataaagtcttaagccagatttgcagtcaacaatatctaagtcgagtctcaccagatgcatgtgaatgttctacctaaacccagcagggattagctgtcagggaggaggactaggtgctgctctgagggcagagcaacatcgtcttgccggtccgtgtcatgcgtctatcactgaacgtttcaagcagtctctggcacataggaggcactcaatatttgtcactggctgactgaccaaatcagaggatgccgcaaccgcaa

SEQ ID NO: 500819 - DNA, 253 bp, Homo sapiens
  misc_feature (86)..(86): n is a, c, g, or t
  misc_feature (91)..(91): n is a, c, g, or t
  misc_feature (146)..(146): n is a, c, g, or t
  misc_feature (148)..(149): n is a, c, g, or t
  misc_feature (156)..(156): n is a, c, g, or t
  misc_feature (158)..(158): n is a, c, g, or t
  misc_feature (165)..(165): n is a, c, g, or t
  misc_feature (167)..(167): n is a, c, g, or t
  misc_feature (169)..(169): n is a, c, g, or t
  misc_feature (175)..(175): n is a, c, g, or t
  misc_feature (181)..(182): n is a, c, g, or t
  misc_feature (186)..(186): n is a, c, g, or t
  misc_feature (190)..(191): n is a, c, g, or t
  misc_feature (207)..(209): n is a, c, g, or t
  misc_feature (213)..(213): n is a, c, g, or t
  misc_feature (216)..(216): n is a, c, g, or t
  misc_feature (223)..(223): n is a, c, g, or t
  misc_feature (225)..(225): n is a, c, g, or t
  misc_feature (229)..(229): n is a, c, g, or t
  misc_feature (231)..(231): n is a, c, g, or t
  misc_feature (234)..(234): n is a, c, g, or t
  misc_feature (241)..(241): n is a, c, g, or t
  misc_feature (248)..(248): n is a, c, g, or t
  misc_feature (252)..(252): n is a, c, g, or t
tgagcacacttatatagtctaccctactacacacactatatggtctagcctactacacacctggatggtctagcctactacgagcncttanatggtctaccctactacgctcctatatggtctagcctactaaactctttatggcntnncctactncncacctangntngtctancctacnntgcncttnnatggtctagcctactnnncggnttnatggtcnancctncntanactcttnaatggcntttnc

SEQ ID NO: 500820 - DNA, 105 bp, Homo sapiens
ggccacagtgtgcatctgaagagctcagtctagtgcagcttgagtctgcatgtgtgggctactgtcatctagtcatgaagatgctatatgtctgctaattactgt

SEQ ID NO: 500821 - DNA, 1240 bp, Homo sapiens
  misc_feature (393)..(393): n is a, c, g, or t
gctaaataggaagggagtatatcataatcagcaactttgtaagcggagatcgaactgttttccatgaacatctagaaatgtttagacacatgtctatggtctttaatcgcagtgtacaccttctcttaatgattagtcacttttctacccactgtcactgtattaaaatagtatgtgtacataatggtttgattggaataagtactagtggagaaagatgcagaaagcgttcgaggaatccatgtgtagtgtattattggggactatggatgcaggtatctatggaatgatgtatatactactttacgtttagtgtgagtaagaggctattgtagcggaaaacagtggacagtttgattgtcaagttgttgcgagacctgttagatgtagagntacttcgaattatgtcaagtttctatgttgtaatgtattattgctaagtatgtgtctgtatttcttacttatattatagtggttttgggtgagagtggtaggacaaaagttcgtctatggcaaccaaaaagtgatcttgtagcaggtaaaatttgtggctagcgcatagaaagagaatagagacacacaggagggacaagggtagagaagcaacaggggagcgtttgcgacgcttggacaactgtagtgggatgaggctaacatagctacaatgctgggtgtcgtcgctgtttggtctgcaattaaggacacacaaaaaaacctcggggaattagacaggccactaagactgtctcctcttacctaaggctcggcgcagagaaaaagcgaactgggggctcgcgcgaaccactcgaattttggtgtagggacttctccacgggggtagtaatgggggtgttgcccgcacactcggttttgtggcccggtttgaaataaggccctcgcgcatcgtaggaaccgccccccaggcgggagagtgcaccggggcgaataatgtaaacagcacattggtcggcatcgcagactatatcgtcctgggggtagaaaacacccgacaagagattggatttagacaggacgcgacaacaggcggcaatttggaacgccattcggcaactccggagagacgggactccacacattccagaggggagagttagtaaaccaacagaatacgaggtgccaacacaaaagggactttaacacaaacatagcggtgagagtatccatacaccaaaggaatccagcatcgtcgcggacacagagaacaccgacatagggaaag

SEQ ID NO: 500822 - DNA, 936 bp, Homo sapiens
ggtcactggcaaggctaaatgatagcagacactttcaattaagcattgcttcccaaggccatgaatgttgagtacatagatcccctccatggatagttttcccagaaaactactctctaagcaggagttctggagtgtccaagaggctcactcatgtcaaaagggttaactcgcgtaaatatataggtcacaatgaattagccagtgaacaaatacttgaacagcatcataatctgaggtaattgagatctcttcataatttgttaatagaacgggaaattgactaaaaggatataccaggacttagaaataatggaaaatttcaccacttgtctgatagagtcattggattaaaagaaatgtacagcattcaaaaaggcagaacaatgacccccatgattaaatacaaatcaaaactccaaattaactagaaagcaaatcaaatcaagcattcagatattcaagatgcaaggggaaggagaaagcacatcatagaaaacattatagagaataaaatgttaacagtaaatgctgtctgcatggatccttcgtaaatttactaaaaccaagtaaacctggacttcattcttcaaagaaaaaaacactttcataaaaccaaaaatgtgatgttcaaggttatgcatttatatactcaccatccaaattgatcaatggttctgcattttcagttgcatagtcagcaggtgttgaattatcaggtactaaatccttgtatttcagctataaaaacaggcaaaaatataatcttgtacaacgtgaaactcaaggtacaatgactactggctatttaccaaaatttaagctgagccaaacatgatttacagggttcgaggttccctttactggcaatggccattaatttccacttttaaagttgttcgcaagactttcggattacttctggcctatattcaa

SEQ ID NO: 500823 - DNA, 169 bp, Homo sapiens
tatgctgtattcagcacttgttaggctgagtgggaccatggtcgctgtcaccaggcacggtatacatttgagtatttctgtagtatagacagcgtttcaacttgttgggcaggatggtcttgatttcttggatctcgtgatccaaccatctcagcttcccaaagtgctg

SEQ ID NO: 500824 - DNA, 279 bp, Homo sapiens
  misc_feature (64)..(64): n is a, c, g, or t
  misc_feature (72)..(72): n is a, c, g, or t
  misc_feature (82)..(83): n is a, c, g, or t
  misc_feature (102)..(102): n is a, c, g, or t
  misc_feature (108)..(108): n is a, c, g, or t
atttttgttaatatcaacagcaaaagcctagtgcattgggagatgtgcaacctccctggaaaantctctttnctcgttctcnnggaagtacttcaggggtgngcctcntgcccaaggagccttctgccacaggtgctcccaccagcccccacctcatccgtctgtttgcagagcctcatctacaggtccccacgctgccttcttttactcactctggcgcttggccgttttgttatttggcttagtctacacttgggcggaagtctgctgtgcacagag

SEQ ID NO: 500825 - DNA, 182 bp, Homo sapiens
gacgctctctctgtggggacttgttgcgtctgcgcacatgtctggagcggtctccccaggatccctcctgaaaggggtcctggggcccttcacggttttctgtgccaccatcggtcacccattgatcgtgcccactcctgaacccccttggctctccagcctggtccacagtctcgagcagg

SEQ ID NO: 500826 - DNA, 159 bp, Homo sapiens
acttttgtatcatttactattatgtatgctatttaataacatttttctttattaatactagaacaaatatattgacctatgagcagtatagatttcaattatcttcttgggttggtctgaggttgctgatggcttcttggcatacgctgctgtacgttg

SEQ ID NO: 500827 - DNA, 108 bp, Homo sapiens
ccagaggagaccagaagaatcttctccggaaggtgtctcgaagtgtgcacagtggtgatgaggggatctcacaggcgtgggcatcacagtaagtcatcaggtctgctg

SEQ ID NO: 500828 - DNA, 131 bp, Homo sapiens
gggtcaagacaccaagggtacctcttacaatgagaaaccaggtcccggccaggtacctcatcctatgtaagacgtgtttcttcctcttcggtgaagttactcgagacccctaggtggtcattactgccccc

SEQ ID NO: 500829 - DNA, 798 bp, Homo sapiens
ggcggcggcgagcagaagcagctgagtgtctcctgatacccggatgtgaggcgatccgtggcgctagtctgaccctccggccaggcaaaaggaagatggtcttggctatagagtttttttttttcaaagattactaaacattacaggagttgataagaagtatcattcatcagaagcattcattcaatcaattcaaccttgaagaaaacaggtggatatataattccttaaaggggctgtgtgactgtgtaaggagcttatttagacgggaatggtctggtcctaatttcctcacagtgagttactggtggctgagacatcgaggtctatattggggggcaaaacctaagggcgagcacaaaggggaattctatcttactagaatattccggttgaccaagggaggttagataagactgaaaccaaagactcagcaaacagggaaagaaccgtgttagccataaggacatgtttcagggtgatcgaagtccaataatgtagacttcagaagaaaaaaggtcttcaaaatttttctcaaaaccaggtcagtgataaataactcctccagtaatagagctaaggctgaaaaccaaataatttcaaaatttacaaaacagatggacctggatcaaatttcttgtgtcaaaaaatttttaaaatatcaaaattttcctcaaattttattcctggtccaagtaagcaggtgttttagattactggaagtttcatgtgtaggatgacgaacttttgagcaagctttggggaagttctcctgtaagggttgaagcgccgaaaaaa

SEQ ID NO: 500830 - DNA, 1605 bp, Homo sapiens
  misc_feature (307)..(307): n is a, c, g, or t
  misc_feature (752)..(752): n is a, c, g, or t
  misc_feature (1400)..(1400): n is a, c, g, or t
ttgtgtgggcggcgccccttttgatgcagactgtttgggcgcttctagcgtatacccgccggtggggacaagcctccgtgtgggtttgcccacaagcgattgagatgttttttttccccgctggggctccctgctgccgctaacgtagtgtaaagggagtgttatcacctgggctctctgcatgctgcgcgtggtcgtagatcacccagatgcccgggtcccccaggggcgcccccctccccgcttggggagtggtgtggggctcccttcctcctgggcgggcgtttcctgtccagagtcgccatcncctgttgtgtgtgaggcacccccccccccgaggtccccttgggtgtttttccagacaggggccccaccaccggaagaggtgtggtgagaattttgcctccacgcccggggctcctagtaatatggtggtcgctcccggtgatgataaatctttggtggtgtggctctgggccctagccattgtggccgcccctggtccgcctcccgccccctcctgggggtggtcccatgggcccgtcgccctcaccgctctcacgggaggtgcccccacacatttggccctcacgggagacttttgtttgccagaagggggggctttttctctggggagagtgaatattcccggcgatatggtttcgaacgcgggggggacaacacccaagggcactacaaggggccacgaagggggcgcccccgcgagaagcgtcttctcgggcgggattatnccacgccgacgggttcctctgggtgcccgcccaaaagcgccccggcgctcaccgccctttgggccccacgacccacacaagagaggtgatgagagataggacccccgggtgagctcaagctcaaactcggcgctgcgctcgtgtgtgagaaaaggagccacttgtggcccacacaagagctatctcacggggggtgctacacacgcccagggccccgccgcgttttcccgggcccccgccccgggctttctctcggcactccacagggagagcctggttgttctccgcgcttgtcgccccggggagatctcaaggcgccaccaggtggggccacactgagaggcctgtcgccgtgagagcctgggcgcgccgcgctgtggccgagagatggccgcgccgtgcacagggcccggcgcctggggagaggtcttctgagggcttctgaccccacggccccccccgacgaaggtcttgggacgccggctctccaagtgttccccgcgcaccctctggaacacttcgacacgttccacagcctctgagagtctctcggagagctctgacgcacagaactctccgcctcacggagccctcgagagcccgcaggggcacacactccttgtcgagagcccggtttcacagagcttntccacgaaggaggaataattgattcgaggcctctcgaagaagagaagcccaagtgttccaaccgccacgtacccacaggtgaaagcttggtggagaacaccggccttccctgagatccccttgtagactgccctccagatgccggagactccccccttccacattacaaaatctcttctaacttaaacaaaaataaaaaaataaa

SEQ ID NO: 500831 - DNA, 345 bp, Homo sapiens
taaaaacacaaaaactagctgggtgtggtggcacatgcctgtaatcccactacttgggaggctgaggcagaggaatcacttgaacccgggatgtggaggttgcagtgagctgagattgtgccactgcgctccagcctggcgacagaaggagactcagtctcaaaaaaaaaaaaaaattgccccagttttgtaacgaatcagcccaaccctaatgagatcaaacacatttttttgtggaaaataaaaactatcttagaggccagcctctggggttaatgcctgtaaggccaacaccttgggaggttgaggaggccgttttgcctgaatccaaaaggggacccgagc

SEQ ID NO: 500832 - DNA, 960 bp, Homo sapiens
acctgcccgtgaagaggcgggcatgacaccagcacagcacgcagcaagcacccatcatggcagctttcaatttcattcaatgccaaaccagtcacctcaaccaaaccccaccaggtcctcacaactaccgaacacctgccattcaacacacatttcaggttggggcgcacctcgtgcagcaagcaaccccaagcctccgcagccagtcaccatgctcaagcacttcgacccagatccacaagcgcacactcactcatcactccaatttgcatcccaatcaacttagcaccaacaggcaacacagttcacccgtcaaggcatcacaccagcgaccaatccatcattcctcagcaggtcccatcatccaaccacctcagcggtattcaagcaccgtcgcatagttggcatccaggcaccatccgcgcatagagtagccaggacacgcgtcatttccaacaagcgtctccgactacctaggtataccacaccgcaatatcacaatgctcccattcaccgattgcaatcgttgcacgtattccacgccaacctgagcacgctcaaatcccccaggggtcctggttacatcgctacctacattcaccttgatacagatagttatccccataccccccatggcttaagcaggacaagcgggacaccaaggaagccaacaaactcaaacggggccataacattagtccacagaacaaaaggccgggacacagtttcacgcccgcgggttaaaaacctggcacgtacttcccacgttcgttcgacagaacctattcacgaccaccatctcactacaccccccaccaagccagccacagcccaaacaaggaaaaacccaggggggcgtctatagaagaaacagagaaagcagccgcgaacgcaaaacggggcgctgcgcgcccgcgcactactacaaacgaagacgacatcacccctggagaacgcggg

SEQ ID NO: 500833 - DNA, 4555 bp, Homo sapiens
gccttcttcagcgatgacccagaactggacaatctgatggtgaaggcaatccaggtcctgagaatccacctgctggagctggagaaagtcaatgaactctgcaaggacttttgtaaccgttacatcacctgcctcaaaaccaagatgcacagcgacaacctgctcaggaatgatctaggggggccctactcccccaaccagccctccatcaaccttcactcacaggaaaccaagagagttgccttctggacctgggtctggggaggagctagaaggagggaggggggcaggcaggaaggggaaaggacggaagaggactctggggctgtagggtctaagctctcagtgtcattgtcacaaaccacgcctccctcactgccaggacctcctgcagaattcccccaattccatgtccggagtctccaataacccccaggggattgtggtcccagcctcagcgctccagcagggcaacatcgccatgacaaccgtcaactcacaagttgtgtcaggtcggtgcaaagactgggaagggtgattgtgggaattccctgggaggagaaagggtggccccgaggcggttccaggggtgggggttgtcctccaccgagggaggggctcccagctcagtttcttgactaaagttttctgtaagtttatagacggttagcgccaagacccaattgtgatggtttagaacaaatttgggtcaaaatctcatgagcccctgagaggaccaagtaaggctgttgtcccttccccgaagcacctcccaccagaggctctgtcctaggctctagacaccatcccccacccacccataaagcagaaagccatagctcgctacccaagggctccaagtagagggtctttacacatgagtgccaaatgaactgggaaccctgcttgccctcgctcctacccactcccatggcaggggaccccaaaactggttgtctcctcaggtggagccttataccaaccggttaccatggtaacctcccagggtcaggtggtcacccaagcaatcccccagggagccatccagatccagaacacacaggtgagtgtgtgtaggtgtgtgcacatgtgcatggtgtgggctagggcacctgtaatcgcttcttatctgccaggcactttacacgggtgactcattgaatcctcatcatcctctaagaggtatcattacccctactttacagataagaagctgggtcttggaaaggttttatcaactcctgggattttgctgcctccctcctggggttacatcaaaggatcctgcacttcctattcctgtctgcagactgagccgctgtgtccctcagtggtagagagtgcacacacaaaggaagagtagaaagatcggaagtcagagtctgggatctgacattaactctgggatctctgataagtcacctaacctctctgagcctcagacttcttattgataaaagggggattaatagcaactgcacacagcctagccaacctacagggctgctgtgagaatgaaccacagcgatggataggaaagtgctttgcaaactgtaaagtaccacagaaatgctgataactacttgacagcttatggcaaattcatatcttctcctgttctctctgcatggccctgtttcctctgtctttctctctctctctctctctctctctctctctctctctctctctctctctctctctctctctccctctctctcccccccttccccatctcttcctccttgtccttcttcccttctcccatcacccaagcctcacctccactctctgaggggctggcatgggctgagagggaaaggtgacctccccagggccctaggaatgagccgggaaaggggctggcagccaagcctgccgtcgctatggcaacaggtccccagccgctgccctcacaggctgctgatgctgattttctctccacgtgccctgaaggttaaccttgacctcacctccctcctggacaatgaggataagaagtccaagaacaaacgaggagtcttgcccaagcatgccaccaatataatgcgttcttggctcttccagcatctcatgcacccctaccccacggaggatgagaagaggcagatcgcagcccagaccaacctcaccctcctgcaagtaaacaactggttcatcaatgcccggaggcgcatcctgcagcccatgcttgatgccagcaacccagatcctgcccccaaagccaagaagatcaagtctcagcaccggcccacccaaagattctggcccaactccatcgctgcgggggtgctgcagcagcagggcggtgccccagggacaaaccccgatggttccatcaacttggacaacctgcagtccctgtcctcagacagtgccaccatggccatgcagcaggctatgatggctgcacacgatgactcattggatgggacagaagaagaggatgaggatgagatggaagaggaggaggaggaggagctggaggaggaggtcgacgagctgcagacgacaaatgtcagcgacctgggcttggaacacagtgactccctggagtagtcgggcagcccagatggcactgatcactgagcaggagaggagtgtcgccgggaggccttcagggtgggggggaaggggacatgggcaggaagcaccgagggagttgggccctagcttccccaaatcagtagcttgaagaaaggcaaaggagacacctgttccttcccaaccaccgagcttcaatgaggaccccagccccacttccctggaactgccgaggactctgtttggcggggccagtcgagcagcctgtgtggaaagacaggagtgagatctggactcaccaaatccctgaggacagatggcacccatggcccccacccacggaaggacttgagttgtttacaagccctgcactgaggcagattggtgctgttcgcagagtaggcctttgcccgggggcagacttagaaggaaggggagagacaaagggggactgagtttcatccccagaagtttctcagctcctttgacagacattcaagggcaggagggagccccaaagcataaccagtggccagaggagtgggagggcctgaggcatcacatcttgcagatcagaatgggatggaatccaccaggctccagctcatccctccaaggccctgtctctgcgcacagcaaccatggacatgggagaaagggatgggagccacagtgcccttcactctctcctggaaaccaactgtaagctggtgggctcaacctgtgggaggttaagaggagtcccttctgggttgactccaagagccaaggagatggcagaccctgggctaggaaccatatggaggtgactttgaggccacagctgtccctaggtgatcacagaacttagctcctttaacaacaggacaatggtttttttaccctagatgttcccaccttcagtgctccacgccctccatagaccttcagagaaggtgaaaccaggttatctgggaatctttccagcccgcaggtcgccacggccatccctttgctcccagcctggctccatcagcctccagcttcctttcttcattctgtccttcagggaaggcagaagaaacattggaaagcatctagtccagtgggaagccaggggttggagaaggtgctacatccctcttcccatcaatatcctaaatgtgggggagggcccagagaatggcacccaagagcctgcggggatgcccatcccacacaccccacccagctgttctaaccctgctatccacagccctggaggaactggggctcctggaaggaggaggaggctctccactgtccaccctaacacataccctcccacccaccttccagacccccttggttggcaccctctcctccggttccctctcaccccatggctgtgaatgacaggacaggtcacacgtgtgttttccattgggtttaatttaatggacgtgcagtttcatttgtaaattgtgcattagccacctccttcagtggcaggatgtgagtggctacctggctcaactggaggggaccccttgggccctctggggcttcccctcccccacctggttggggtagagcaaaaggatggtcactcttccgaggtctccctgaaatgaatgtatttctcccccaaaagagctgatatttaatgttttaataaggatttttgagaaacaaataaccttatttataatctgggtgatccaatcattttttactcccttttgatgccatacatagaggaaagtctagcttttttggcgtgagacttttgcaatgtgcagtgggataaaatgcatttccttttctggttcgtttttcttgttaacacgcgcacacagacacacacacacaccgttccactcaccacctggacaggcgtcccccagcacggacacactggcacacaggtgcccacatctcttcctctcagcccctccacctgcctaatgttatgcaacctccttctgatgtatccaccaaaccagtactgaatgtggccgagacgttttcagtaaatcttattacctaccgc

SEQ ID NO: 500834 - DNA, 426 bp, Homo sapiens
gtgaatgattcagacgagtcaaccttgcgttggcggaacgtccgagatgccagccccaatgacacaaccacattgatatctgcggcagcaggtgccgtcgtcaagggtggcttgtacgagcgctttcgctcaacccgacgttgtcggtggttgcagcagaatttaccgggggttgatttaagctggttcaaagggttgcaaaagccacaaggtcgacatcggttttgaatcctactcgcccaatttttactaccagaacagtcgggtaacagcagtctatacagccgacatcgataagcttcgggcgttgatgccaccgaagttactggccgccgtgcagcccttgcaagttcttggccgggtcgcgggcttgatcgcgtatactgcgtacaccttatgagcattgacttctcttggaatcattca

SEQ ID NO: 500835 - DNA, 828 bp, Homo sapiens
agcagggtgttgtgacgtggtaggtcacacactcagtgctgggctctggaggcacagaagcaaccggcccagctacgcatcagcccttgagccgattcatgtgttcgatcatattcctgagacagtagggtctgtgcaggtaacaaagcaccagtcagcaggaaactcaccaccgggaagcctttctatcaaaacataacttcaaaatcagtaaagtgggccgggcatggtggctcacgcctataatcccaagcttcaaaatcaataaagcgggccgggcgcggtggctcacgcctataatcccaacttcaaaaccaataaagtgggccgggcgcggtggctcacgcctataatcccaacttcaaaatcaataaagcgggccgggcatggtggctcacgcctataatcccaacttcaaaaccaataaagcgggcgggcgcggtggctcacgcctataatcccagcacttcgggaggccaaggtgggtagatcacatgaggtcaggagttaaagaccagcctggtcaacatcgtaaaaccccatgtctactaaggaaaaagttagtgggcatggtggacgcctcgtaatcccagtggccgggaagctgagtgacgagaatgcttgaactgggaggagaggttacagtgagtgagatcatgcatgggttcatgctggtggaacagtaagactgtgtttcaaaacagaaagaagattttaatttttgcacgattttgcgattgttggagatacagttctgggacagataccacaggggagtttatattttgagctatgggccacggtggtttttaaagggaaaacagaaat

SEQ ID NO: 500836 - DNA, 313 bp, Homo sapiens
tttgggggttggggctttttaagctgggggcctgtttccccttttccatggatagggccctggttcccttggtccccctgctcgggttggtaaagttttggggggtttttggggccccggggctgggggggttttggcggctttttggctttttgggggttttttcctttttgggttttggggtccggggggggtggggggtgggggtgttggccttcccccttggggccgggggccccgggggccggggcccgccccctttccccgcccccgggccctcgcccttttccccctccgggtttttttttaatta

SEQ ID NO: 500837 - DNA, 890 bp, Homo sapiens
gtccatttccctccgcgcgaggggtgagtgccgttttttaaatcgcagggcgcggccagccaaccctcgggggtggccgtggaaattgtaggcgccggaggtttctatcaccgggttggttacccgtgttttgcactcacgctgcctgaattacctcacgtggcctttcgctgtggaaagcatggttgtaactcctctccccgggggtactcttgggcaccccgcggcggtgttgtgttcccgccctaatagatgggggactctctctcccccgagcgtttcctctcacgcgcaagagatggggcgcgcctcctcccgggggtgacctcgactttaccaatggtgagggtaatattcacagccccgccctttgtggagatgaatgcggtgcccccttccgcccccctctcgttctatcctctctttcgacatatgttaatctgatacgaccattgcaaccctcgtctctcgcctgctctcggagcaaaacctcttattgtatatggttcgcttctccacaccttgcagataattctcactcccctcaagtgagatgctcctcatataaggtaaatacataagtattcaccgcgctattctctccaataagaggactctctttccaaaacatcacccttctacaacccacgccctttattaccccaacatgtggccggattgtcgcaaccataagggcttgtgctcgccctccgggagtcacccgggggggcactaccccgatgtttctccaatgtacgcacaccacagatcgcggctatgtggtggcgcaggactgactctgcgccctccctcgccctgtatgtagatccatgcggcccgccgactatgattataggtcgcgccccgcctgtgctcccccacatgacaca

SEQ ID NO: 500838 - DNA, 998 bp, Homo sapiens
  misc_feature (998)..(998): n is a, c, g, or t
gctccagcgccgcgcagccatccgcacgacgccggcgcctctccttagtcgccgccatgtacgaccgtgatcctacctcgcagtgtgcgccgagaactacctaccaaggacgtcaggaggcgcgcgcattcaaccgcctagatcaacgctggagctctacgcctcctacgtttaccttgtccatgtcttactacttatgaccgcagatgatgtggctttgaacgaactgttgcgcgaaatactttgcttcaccaatctcagtgagcgacgacgggaacctgctgcgaaactgatcgaagctgcagaatcgaacgaggtggcccgaatccttcccttcaggcatatcaatgaaaccgagactggtgatgactgggagagcgggctgaattgcacattggagtgtgcattacatcttggtctggaacatgtgaattcagttcaatactggaagtgactcaagattggccactgagaataaatgatccccacttcagtggtgactttcattgaagacatcgttacgctggaactgactccaggctgcacaagggcattcaaaggatacttggggtagaccgacggtgagccttaccttgtcgccatagaatgaggaagccgccgcgaacattgctggcctttgggccgggcacttattcttcaatccgtacacacgacaactacactccgtgggcgaagaactaagtagtaatcacagttgcacagcggtcttaaagcccttaccgggtcgtaacagtatatgcgccctctacgtaaagcgcctgatatgggcgggcttggaagttttccccccgtggggtttccaacgccacacaggtgtccagggttgaccaagtggctagttgcgtgccggccagaggtggaatccagcctgtgttaaaccgatatattaattgccgtaacttaaacggttatggttaaccttaaaccccaccaagttccccaacctcttaacaggcattttcgtcgtcccgcaagtn

SEQ ID NO: 500839 - DNA, 318 bp, Homo sapiens
  misc_feature (53)..(53): n is a, c, g, or t
  misc_feature (83)..(84): n is a, c, g, or t
  misc_feature (88)..(88): n is a, c, g, or t
tagaggatccccccggaggactggttccaggacctctgccaataccaaccctntgatgcccaagtcgcttatataaaatagcnnagtntttgtatataagctaagcacatcctcctgtatactttaagccatctctagattatgtatgatacctaatatgatgtagctaatgctatgcaaagttgttatactttctcatttagagaataatgacaagaagaaaaaagtctgtatatattcagaacagatggaatttttccaagttttttttttttttttttgagacagtctcgctgtcgactgcttggattacaagga

SEQ ID NO: 500840 - DNA, 853 bp, Homo sapiens
gtccggccgcgggatggaagttgccgggcggtcgcagtgactccggggcgatcgccggcgagtccgcagtagttctgggccatggaggcggagccgccgctctacccgatgtgcgggggctgcggtggcctctgtggcgactgaggacctgctcggggtcccggacgggcccgaggcccctgcttggacgagctggtgtggcgcgtaccccgaactacaactgaggagtgaggatgtgagctgcctgttacatacctgcctgcaagcgcctttggggctgtgctcaaagaacgtgcttggctgccagtggcctgtggggcaatgctcaccttacggcgtctacgctggccctcctgcagatgcagcttaatcctgcactacgacgagacctaccgcgaggttgaagtattggcaaccatggggcttgccctgaacaatcgagcagcaaaaattgctggatgggccattccaacgttgactcccatcgccgcccttgctcttacacaaccatgtgctcattcaggttttttggaacgaagtggactgatgttccatcgcttgttgggcattctaacgcccgtcgtatggtctacaagcaaactacttgggagcagcctaccaaacacggctatgttgccacatcggatgttgcacccatgggacaattgtccccaattgttggcactcatttgtgggagccttccaatgggggcaaacatacgagttcacccaagtgcatatgcgtcaagaacagtaccgaatgaagtaccatcgcccacgatacaaagggcagcaaggaattggtgtcacgtgggaatagaacgcagcggggcttccgctgggagtatacaca

SEQ ID NO: 500841 - DNA, 320 bp, Homo sapiens
atgatgaacttatagaaaatttgagatttgtttatgaattgaggaagataaacttgtgttatatggccagtagagaatttctggcttgtaaaagggaagattttgggaggatataatcactttattcaaatgtttaaatttttcttggtcattggtcataggagagattaaacttatttcatgtcagtgttccaggggaccaaacaaaagccaacaagtgtcttttaaggtacaaggaggacatctgtgcaatttcagtgtccggtgtaattttttaacaggttattgtgagtgctatttccgaagagttttggaccctt

SEQ ID NO: 500842 - DNA, 178 bp, Homo sapiens
tacgccgatgaatgctgcgttcctggagctcggccaagtacgagctcgtaatacgatggtcgttgtcccatgctataaacatggtctagcccttagggagctcccggtcctgcagtctaaacttctttgagacgatgctgtcggccttggccaatcggagaatcgaatcatctgactc

SEQ ID NO: 500843 - DNA, 389 bp, Homo sapiens
actgcatctgtgcctctagtctttcgacattttgagatacgcatttaacaagtgccccataaacatatgaaaaaaatgctcaacatcattaatcagagaaatccaaatcaaaaccgcaatgagacaacatctcacacacatcagcacttggggaggccaaggcgggcggatcatgaagtcaggagatcaagaccatcctggccaacatggtgaaaccccatctctactaaaaatacaaaaattagccgggtgtgatggcgtgtgcctgtagtcccagctactggggaggctgaggcaggagaatggcttgaacccaggaggcagaggctacagtgagccgagatcgcgccactgcactgcagcctggtgacagagcaagactccgtctc

SEQ ID NO: 500844 - DNA, 371 bp, Homo sapiens
  misc_feature (90)..(90): n is a, c, g, or t
  misc_feature (102)..(102): n is a, c, g, or t
  misc_feature (329)..(329): n is a, c, g, or t
  misc_feature (331)..(331): n is a, c, g, or t
  misc_feature (346)..(346): n is a, c, g, or t
  misc_feature (362)..(362): n is a, c, g, or t
ggttgagggtaaaagtgattttattagtaattcctacttgcccttgtgtatgtcctgagctgaaaacaatccgtgattaagaaatttaanaggtggctgggncgtgggtcgcacgcctgtaatccccagcactttgggaggccgaggcaggcggatcacctgaggtcgggagttcaagaccagcctgaccaacatggagaaaccctgtctccactaaaaatacaaaattagccgggtgtggtggtgcatgcctgtaatcccagctactcggaagtttgagacgagaatctcttgaacccgggaggcggaggttgtggtgagccaaagancngccattgcactccancctgggcaacaacgangggactccg

SEQ ID NO: 500845 - DNA, 311 bp, Homo sapiens
attatattttcttgtgtgacatatctattcaatttttgtgtgtcctccgtcacgcgcctttctttgaagagacaggatctcactttgtcacctagaatggcgtgcagtggcccaatcatagcagcatagctcattgcaaccttgaactcctggtctcaagcaatcctcccacctcagcctcccaagtagctggagacttcagggatgcaccaccacaactagactattttctttaaaaaaatttatgtagagatggggtcttgccacgttacccaggctgatcctgaacgcccggactacacgttcgcgag

SEQ ID NO: 500846 - DNA, 311 bp, Homo sapiens
ctagagttcttctccttaaaatatggtggcagtgaatgctaacaggtatcaactttcttctgatcaggaacagagaagtccttcaggacactcgctttcctggtccttgttatcgctatcatgtaaatacttgttatcggtacacctgtgtactaattataattgattgctatttatgccaagggcgcatttcccaggcatgcctcatctatttactaacaacaaagtatgctcactttatttacatagtgccaaggagtcctcttttttcttctctataaatatagatgtggatgcgcgagacataggaa

SEQ ID NO: 500847 - DNA, 620 bp, Homo sapiens
ctaactgtcttaagccgccgccagttaaatttaaaaacgttcactaaggtatgaatgggttgcagcaccagccacggacaaagaagttatgtgccatttcgcggaaatggatacagtggagaatctttcgcccagttaataggcaaagatacaagaccgtattaagtagttaggggtgcagcatactgacaccagtatcgtgtaatatcatatatagtcagacttgatgacgtctcaccggagtaaccaggatggtttagatctccaagttagtatggatcgtgccgggtccagtcaaagtgtatatactacaggagtgagctctcttgaccgtgcagatgcagggtacatttaacccctactgtctagagctatttttcacacagattttcagtaatccagagcgaagaacggtgtctctgtcacagcagtaaccagtcgccacaacacaggctcaagagatagtcctaaagccgtttgtgaacaggtgataccctaagtgtatgtctccatgacaagctagtaatgtcactgtatgtagagacagtgtctgcatatgataccctggcagatgtagcactctatcattcagtcgagaataatacttcggcttactaaag

SEQ ID NO: 500848 - DNA, 463 bp, Homo sapiens
  misc_feature (12)..(12): n is a, c, g, or t
  misc_feature (150)..(150): n is a, c, g, or t
  misc_feature (154)..(154): n is a, c, g, or t
  misc_feature (214)..(214): n is a, c, g, or t
  misc_feature (233)..(233): n is a, c, g, or t
  misc_feature (237)..(237): n is a, c, g, or t
  misc_feature (241)..(241): n is a, c, g, or t
  misc_feature (249)..(249): n is a, c, g, or t
  misc_feature (259)..(259): n is a, c, g, or t
  misc_feature (279)..(279): n is a, c, g, or t
  misc_feature (286)..(287): n is a, c, g, or t
  misc_feature (296)..(296): n is a, c, g, or t
  misc_feature (298)..(298): n is a, c, g, or t
  misc_feature (312)..(312): n is a, c, g, or t
  misc_feature (318)..(318): n is a, c, g, or t
  misc_feature (334)..(336): n is a, c, g, or t
  misc_feature (338)..(338): n is a, c, g, or t
  misc_feature (343)..(343): n is a, c, g, or t
  misc_feature (350)..(350): n is a, c, g, or t
  misc_feature (374)..(374): n is a, c, g, or t
  misc_feature (376)..(377): n is a, c, g, or t
  misc_feature (391)..(394): n is a, c, g, or t
  misc_feature (399)..(400): n is a, c, g, or t
  misc_feature (403)..(403): n is a, c, g, or t
  misc_feature (453)..(453): n is a, c, g, or t
ctaacgccaganactttacatgctgatcacatttactcctcacaaccatcttgtaagggagacatcatcagtgccatttgaacaaatgaaaaactgaggctcagagagattacaataccttatccaacacgctctccaagaacaaataangtgnaaaaaacaatggatttgaattcaggaactgtttgattccaaatctggaactttctggaanctctgacaaacacacacanacanacanacacacanacacacacancaccattttcttatcttctncctcctnnactccctcnanatttcaccttacanacaaanccaactattatttatnnnanttatntataatntcccacattttaccaattcttttntnncttcattacatctnnnnctttnnctntcccacatttactatatatgatgtgtgtgtgatgtgatgtgtactttccnataattctcc

SEQ ID NO: 500849 - DNA, 137 bp, Homo sapiens
ggtggtgaccacagtggccgaggctgggcctagatggagtgcagttactgtattgttgggaaggggtggtgacctctggattgttactggattgttgggaagggtggtgacctctggattgttactggattgttggg

SEQ ID NO: 500850 - DNA, 102 bp, Homo sapiens
tcccacggtatgagaactgagccttaaagagatgaaataaattaagcagtagatccaggatgcaaaatcctcccaattcctcatcaattcctcatccttggg

SEQ ID NO: 500851 - DNA, 815 bp, Homo sapiens
tatggtggctcatgctgtaatcccagcactgtgggaggccacatgcaggtggattagctgaggtgcaggagttcgagaccagcctcaccaacatggtgaaaccccgtctctactaaaattagccaggtgtggtggcgacatgcctatagagtcccagctacttgagaggctgaggcaggagaatggcttgacactgcatatgtcactaagcacaagccttaacttcacttttaacttttaataacaaataggtgaacttctaccagttctcatccatttctttctgtatcaggtccaaataattacgagagaaaattcacgttacatgtatttccttatgtctagccatatcaagagtatgtcatatgtcacgtaacaatcagagccttagctctatctacggggtacacacctattaggttaacaccagaacactgtacgagtggctaaggagattccatcatttgccctaatccctagaacatgtgtaccactctgtaactcgctagaacctgtatacggtattgtacaataattcacaatgtggcaggtcatcttaaataggattatccgctgtagagagaattaacacttaagcaaattttagctatttcagtaaattaaaacgcacaacttcctgttcctagcattgggtcttgaaaatcaagtctgataagtatataaaatcgtgtctggtttattactggcgaaatgtgattgctttggcgagtggtaaagtccatgacattgtgtatatttaacatttaaacattacacctaagttaactagatatgggaggacgagcgggaaatga

SEQ ID NO: 500852 - DNA, 582 bp, Homo sapiens
  misc_feature (480)..(480): n is a, c, g, or t
gtattgacttggttgtcgcattcacgagcagtacgaactacacagaggagtaatttttaatgtttaaggatttactatgtgctgtacttaagatgtgtcctaaatgtgagtgtttagcctctcccgggctcagaataggtttccgctccagtgtgataccactttgctgccactcgctatccttggtttaggggcattgttaggtacctcaccaaacattagggcaaatgtccctctcactcaggacctccattggctggtcttctctctgggatgctcttggaggcctgggctagcctgtcttcccaaactgcagctgtgaagctcaaagacggagtaagcttgtgaaagggacagtgagatggtgatcagtgtgctgtgtcaggacgagccttcttttaaaacagcatccatttcttcttcacacttcttgcatttgatggccatgccagaatgagtacggtaatcagaactgatgcntttaaagcgactcagggacctcctccttctggttgcttcctgtgcagatgagcgcttaaagggcagaaattggtctcctccccttttgtaatgttagagata

SEQ ID NO: 500853 - DNA, 154 bp, Homo sapiens
acaaacactagccacatgtgatggcacgcacctatagtcccagctacttggaaggccgataaacaatcattgctggacgctgggaagcgcaggctgcagtgagccgtcacaccactgcactccaggctgggtgacagagacagactctactctt

SEQ ID NO: 500854 - DNA, 215 bp, Homo sapiens
cacctgcgtcactcggctcccgagtagctaggactacaggcgtgtcgccaccatgcccagctaatttttgtatttttagtaaagacagggtttcaccacattggccaggatggtctcgatctcttgatctcgtgatccactccgtcttggccatcccaaagtgctgggattacaggcgtgagccaccgtgaccctttgaatacgcgggtgacctt

SEQ ID NO: 500855 - DNA, 179 bp, Homo sapiens
tccgcccggggggggggcgggcggccggcctgtggcctggtgtggcccgtttgctccgcccgggtttttctggtgtgttgccggctcctcggggcgtttttcgggggcctcgggtgtgtggcggtctcggtctcggggccccgcgtgtgtcgtgtgtctctgtctcttgtgtgcgtgtg

SEQ ID NO: 500856 - DNA, 321 bp, Homo sapiens
gcagtatgtgtgtgtatgtgtgtgtagcgatggaggtaggattggtgctgtgggtaatgagtatgatggggtggtggttgtggtaacttaatagtgtaggaagctgactaattatgtaaggagaggtgtcagggttgattcgggaggatcctattggtgcggggctttgtatgattatgggcgtcgtagttaagctcgtgtaacggcggcggtgtcggcagctgctgtagcgttgagagtctggcgcgatgtctcacaccattttgctggtacagcctaacaaggaggccagaaggcagaacttatgctgactacgaatct

SEQ ID NO: 500857 - DNA, 466 bp, Homo sapiens
  misc_feature (1)..(1): n is a, c, g, or t
  misc_feature (3)..(4): n is a, c, g, or t
  misc_feature (6)..(6): n is a, c, g, or t
  misc_feature (8)..(8): n is a, c, g, or t
  misc_feature (15)..(15): n is a, c, g, or t
  misc_feature (20)..(20): n is a, c, g, or t
  misc_feature (22)..(22): n is a, c, g, or t
  misc_feature (24)..(24): n is a, c, g, or t
  misc_feature (27)..(27): n is a, c, g, or t
  misc_feature (30)..(31): n is a, c, g, or t
  misc_feature (33)..(33): n is a, c, g, or t
  misc_feature (39)..(41): n is a, c, g, or t
  misc_feature (46)..(48): n is a, c, g, or t
  misc_feature (99)..(100): n is a, c, g, or t
  misc_feature (145)..(145): n is a, c, g, or t
  misc_feature (147)..(147): n is a, c, g, or t
  misc_feature (153)..(153): n is a, c, g, or t
  misc_feature (155)..(156): n is a, c, g, or t
  misc_feature (162)..(163): n is a, c, g, or t
  misc_feature (165)..(165): n is a, c, g, or t
  misc_feature (177)..(177): n is a, c, g, or t
  misc_feature (179)..(179): n is a, c, g, or t
  misc_feature (184)..(184): n is a, c, g, or t
  misc_feature (189)..(189): n is a, c, g, or t
  misc_feature (195)..(195): n is a, c, g, or t
  misc_feature (201)..(202): n is a, c, g, or t
  misc_feature (205)..(205): n is a, c, g, or t
  misc_feature (234)..(235): n is a, c, g, or t
  misc_feature (244)..(244): n is a, c, g, or t
  misc_feature (250)..(250): n is a, c, g, or t
  misc_feature (257)..(257): n is a, c, g, or t
  misc_feature (263)..(264): n is a, c, g, or t
  misc_feature (266)..(267): n is a, c, g, or t
  misc_feature (292)..(292): n is a, c, g, or t
  misc_feature (298)..(298): n is a, c, g, or t
  misc_feature (300)..(300): n is a, c, g, or t
  misc_feature (304)..(304): n is a, c, g, or t
  misc_feature (306)..(306): n is a, c, g, or t
  misc_feature (353)..(353): n is a, c, g, or t
ngnnananaaaaaanaaaanantnaanaannanaaaaannnaaaannnaaaaaaaaaaaaaaaaaaaaaaaaaaaaaaaaaaaaaaaaaaaaaaaaaannaaaaaaaaaaaaaaaaaaaaaaaaaaaaaccttgtgggccccttngncccagncnnttttanncntggccaagtttntncttgnggccnaatttngggctnnttnggccaattccccctttggggggccgtttnncaattaatnggccgncgtttancaacgnngnnattggaaaaccctggggttccccantttaancncttngnagaaaatccccttttccccagttggcgtaataccaaaagggcccganccgatggcctttccaaacattggcccaccctaaagggcaatgggaaattgtaccgcgaaaattttggtaaaaatccgcgtattttggttaacctcttttttaaccctgggccc

SEQ ID NO: 500858 - DNA, 441 bp, Homo sapiens
ggtctttggactgtgacacgtagcacgggctgtcaggtctgaaacaagtttgtgtgttgttgggcttcgtgaagctactgctttgcgcaggcagcctcaagtttgatattgcaatgtcggcttgacaattaacatggattctaccagacaagtacagcatcgatgatcatcacagcgtcctatgattatggaggaagtggaggacctatagcaaaacagtatgctggctatgactattcgcagcgaaggcagattctgtccctccagacatgatgcagacacaacagccatacaccgggcagatctaccaggcaactcaggcatatactccagattgaactcatgcctttctatggaaacaactttgaggatgagcccacctttattagaagagttaggtatcacatctgaccacatctggcacaaaaaacataacagata

SEQ ID NO: 500859 - DNA, 333 bp, Homo sapiens
taatgaaattatgtcaccagtggggggggcggcggctcatgcctgtaatcccagcactttgggagtccgaggcgggtgaatcgcgaggtcagggagtttgagaccagcctggccaacatggtaaaacccctgtctctactaaaaatacaatacatcagccaggcgtagtggcaggtgcctgtaatcccagctactcaggaggctgaggcaggaaaatcacttgaacctgggaaggggaggttgcagtgagtctccagcctgggtgacagagcaagactcttgtctcaaaaaacaaaaacaaaaaacctgtcttctattgaaccggatagcttg

SEQ ID NO: 500860 - DNA, 256 bp, Homo sapiens
caggatggaccgaagtgtgctgcacacgccgagtgtccagaccattgtcctccagtcctgggtgacagagccgagactccgtctcaaacaaaacaaaacataagacatcagctagctggtccaagcacagtggtgttcacagcgaatagatcacagccaggtagaattcttcatcctttctccagttccagtgcgacgctcgaccagccttaaaaatacaattacacacaagaagttggggcgttcggcgtgtgca

SEQ ID NO: 500861 - DNA, 923 bp, Homo sapiens
  misc_feature (741)..(741): n is a, c, g, or t
tgcgtgagatcctctccttccgctttctagaatatctctctatctcatggtatagtgtctcgtccaagcctctatgctagccctcatcatagatgttgtctgcctcgccatgttgcttgctgtcctctagtcgtggtctgatgctgaccagagagtctatcccggacctattcccgtcctatgcattcacagttggcatcctggttggggggaagaataaacgaatcggcccttagactagacagaccccgattattccagatatgtgctgtcctgtatccccaatagcctgctgtgtaccagcggagagacgggtgcacttgtgagccgctgcttatttagtctcactgtgttatctatatgaggaacaacacactaacgctatggtacacgatcctcagtctgtggtggtggctttcacatcctagagtctggcatacacatccctaggaatacttgcggtctgtgctagtcctatccattccatcagactacagggcaacccgtgatagcgccgttgcatctgacatgaggctcacatccctctggggtttggggtcaatgttcttaaaacttgcatttcatcttccaaccccatagcgttcctctagccctctattctttaccttggtggtaagaactttagctccagggaacttgaggcagaggccctgttgtggtctgtgttgacagcaaccgcacctgtccacgtcatgctcctgaacttgaccaccaaggttngatgccggattcgaagccaggaaggcccagtccctcctctggtctcctcaaagaacgcaaaacattttccaaccaaagagctggtcacaggtgggagcacaagcaggggggccacccgttttccaaaatttcgttcaaagtttcaagttggaatcctggtggtcccacccaaggttgaggcc

SEQ ID NO: 500862 - DNA, 250 bp, Homo sapiens
tccgcatgtaaatggagctgtaccccatgagcgatttcaactctcctcgaactgatcaccgacagccgtggctttgccacgctgtggctcagtcgtgaagccaagaacaacgcgttcaatgccgagatgatccgcgaactgatcatcgccctcgaccacgtgcagggcgatcctgccctgcgttttctcgtcttgcgtgggcgcggcaagcatttcagcgctggtgctgacctggcctggatgcagcagt

SEQ ID NO: 500863 - DNA, 767 bp, Homo sapiens
aaaaaaaaaaaaaaaaaaaaaaaaaaaaaaaaaaagggggaagagaaaaaaaaaaaacccccaagggggccaaattaacggttccccggtgtctttgttacagggtgggctccccataatggtgtgaagtctgcttttatatatatggcaataggacacgtgtggcgccggcgctataaaacaggatgtgagcagtggggaaacacctggctaaccttggggacttctttggtgtaaagggaacacctatatatctctctgtgtgggggtgtgcgaaccattactgtgggcaaaactctctccctcaacgcgaagatctttaaagaagcctctctcatgagggcaacaatctttaaaccttttaaaagagggtgtatataaggggtgtatacaaacaattcctcggtgcgatatattgtggagaggagggggcgttaggagaaaacgtatctgtcgggctaatacgcgtgggatgtatatgtgtctcttatgagggaaaacaatctttttttatatcatacccacggtggacactcaatataggaaaaaaaaaccctgcatccgcccgaaaaagcgcgcgcggatggagagcgcaggaggacgagaagaagagccccatgacgcccgtgccgcgagaccgagtctcagtgaacaattagcgagagcgagcagacagagcaacccacagccaagggacaccggctcgaaacacccgagaggcctaagcggacacgaacccgaggacacggcgctcggcgcggccacaa

SEQ ID NO: 500864 - DNA, 814 bp, Homo sapiens
gtcgagctattctctacgaaccacaaagacatcggaacactatacctattattcggcgcaggacctggtaggtcctaggcacagctctacaggcctgccttcattcgagccgcagcctgggccagccaggcaaccttgctagagtaacgaccacatctactacgttatcgtcacagcccatgcactttgtaaataaacttcttcatgagtaatacccatccatagggtcggaggcttgggtgaactgagcgtagattccgccgtaattaatcggatgaccccgaatatgggcgtttccccggcagtagaacaagcgataagcattctgactcgttagccgtccctctctccgtactcctggtcgcactctggcgtataggtggaggccgggagcaggaacgaggttgaacagtgctagcccgtccgcgttaggcagggtgagacgtatccggtgcgcccaccgcggggaaggtcctgccgataaggaaagcgctgaaaccccactacttctgccgttatcacacttaggcgaggatagtctcccgtcgtaatacttagggggccgaatcgaagttctacagtcaacaaacaatattatcagatattagaaagcccgcgcgctggccagtaatcgccaggtagccaaatcggccccgtcttcgtctgatgccgtcctaaatcacagctagctcctgtacctttctcctatctctcccaggtcctagctgctggcatcagttatatctactaaacaggaaccgcaaaacctcaagagccaacctttccttcgaagccccgggggagggagggagaa

SEQ ID NO: 500865 - DNA, 133 bp, Homo sapiens
ggcctacgcggagacctcggtggtctctgcatctcagtccctgcgagcattgcacgtacgggacctgcggtccgccacatcgatggccgtagaaagcttccgactgaccccacagcctttgcctgctcacccg

SEQ ID NO: 500866 - DNA, 1233 bp, Homo sapiens
tatgaccaatgacactgccctcgtcccgagcgatctagggattgactggcagtgtcatacacggtcccggctgggccgcgagagatgactgctggtgaggcgtctttagcgtgatgggcagggtcgagcgcgccccgcgggagtcgaggcagatgttgcagtgcgcagctgacgtgactgtgccccttgagtgcagactgctgacgagagagcagactgttgcgagtgggtccgctggcgcaactgcacaccgccggggcccggtgtgtaggaacgtacatgcgagactagaggaataagcccgtgagtagggggaccagaccgtgttgggtggaccccctcgaccaatcccgaggcgtacacactagcaggtcggtataggaagatttccagccagactcgactgggattggcgatgcttgggcatttcggttggtgggctgcgaatcgttcttggccctaggcgtaggcggcggcgccggggcacttgagccccaagtggaagtcctcggtgttttgcctgtggcacgccaaggggggcgcccatggctacgcggttggccctggagcataggtcctcgcgcctgggaactttacctgcccactgtggttggaccttgtggtccttggcctctggcgttaagtcctcagagcggcgcttagtgggtgggcgaagagcttgagagaaggacccttgtgggctggccacggggatgcgcccaaagggggattcgggttcgtgttcgcacagagcatcgatctaggtctagtgattgcccgtgtgcccgcttgtggacccgggttttcccaacacttgagtggcctgttgccgggcgcctcctcgcggggggcccctcgggccttgttggccagactcgactctggcggccctccggacttgaattgccctgggccacactggtagaagtccggtgggcccttggcgattggtgctcccctgtggattcggcccctgtgtggcctccccaaccattgcccccggattgtcccggggggcgggcctggcccgtggaggcataggcttgagaaagaacttgtcccgggctacgcggagcttcgtgaagggaacgtcagacggatgtggttggatccacacgtgagggaccctgggaccctggcccgaacgtgtgcatatggccattgtatgctagactccaccctaagtccacgatttaacgacacaccaagggaagttagtacaccatattcacg

SEQ ID NO: 500867 - DNA, 449 bp, Homo sapiens
atttttttatttttgtagggactacaggtgcacaccaccacacccagctaatttttttatttttgtatttttacttttcaccatgtcggtcaggctggtctcaaactcctgacctcaggtgatctgcccacctcagcctcccaaagtgccgggattacaggcatgagccaccgtgcccagcccttaattgctgtctgaactttttttttttttttcaacctgacctgaggcatcaattcaggcacagtataactctgaccagtaagcggaagctaacccaaatgctttccagggctgaggggacatcatgagagttgtggtcatgtacagaagcacagtcccaggggcacaggtggtacccctgtaaacaaagaatttgcaatattagggcacctcaagcaggacatccattaggctgtacaggtgaacagacctcctaccaggggaac

SEQ ID NO: 500868 - DNA, 266 bp, Homo sapiens
ccattgatctcccttacttcctcaccaagactgtatcaagaaaaaaaaaactaaaacacagtatccaaaagtcaaactgggccagacgcagtggctcacgcctgtaatcccagcactttgggaggccaaggcgggcagatcacctgaggtcaggagtttcagaccagcctggccaacatggtgaaaccccgtctctattaaaacaaaaagccaggcgtggtgcacgtacctgtagtcccatttactcaggaggcagaagcaggaag

SEQ ID NO: 500869 - DNA, 692 bp, Homo sapiens
  misc_feature (223)..(223): n is a, c, g, or t
  misc_feature (225)..(225): n is a, c, g, or t
  misc_feature (227)..(227): n is a, c, g, or t
  misc_feature (239)..(239): n is a, c, g, or t
  misc_feature (250)..(250): n is a, c, g, or t
  misc_feature (252)..(255): n is a, c, g, or t
  misc_feature (270)..(270): n is a, c, g, or t
  misc_feature (283)..(283): n is a, c, g, or t
  misc_feature (291)..(291): n is a, c, g, or t
  misc_feature (294)..(294): n is a, c, g, or t
  misc_feature (300)..(300): n is a, c, g, or t
  misc_feature (303)..(303): n is a, c, g, or t
  misc_feature (316)..(316): n is a, c, g, or t
  misc_feature (340)..(340): n is a, c, g, or t
  misc_feature (347)..(347): n is a, c, g, or t
  misc_feature (372)..(372): n is a, c, g, or t
  misc_feature (377)..(377): n is a, c, g, or t
  misc_feature (385)..(385): n is a, c, g, or t
  misc_feature (535)..(535): n is a, c, g, or t
  misc_feature (568)..(568): n is a, c, g, or t
tgtttcctgcaacgatcacgaacatgaacatcaaaggatcgcatgggaaagggtccctcctgctgctgctggtgtcaaaactgctcctgtgccaaagcgttggccccttgcgcatctgtcccggcggggctgaccgatgtcaggtgaaccttcgagagctgttttgaccgcgccgtcgtcctgtcccactacatccagtaaactctcctcagaaatgttcagngnantcgataaacggnatacccatggncnnnngttcattaccaaggncatcaacagctgncacacttnttnccttgncanccccgaagacaangagcaagcccaacagatgaatcanaaagacnttctgagcctgatagtcagcatatngcgancctggaangagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaangaaatgagatctaccctgtctgtgcgggacttncatccctgcagaatggctgatgaagagtctcgcctttctgcttataacttggtcactgactacgcgaggattccattaagcagcactatttcagcccctaactgcgataatcacgatggtcccc

SEQ ID NO: 500870 - DNA, 839 bp, Homo sapiens
  misc_feature (223)..(223): n is a, c, g, or t
  misc_feature (225)..(225): n is a, c, g, or t
  misc_feature (227)..(227): n is a, c, g, or t
  misc_feature (239)..(239): n is a, c, g, or t
  misc_feature (250)..(250): n is a, c, g, or t
  misc_feature (252)..(255): n is a, c, g, or t
  misc_feature (270)..(270): n is a, c, g, or t
  misc_feature (283)..(283): n is a, c, g, or t
  misc_feature (291)..(291): n is a, c, g, or t
  misc_feature (294)..(294): n is a, c, g, or t
  misc_feature (300)..(300): n is a, c, g, or t
  misc_feature (303)..(303): n is a, c, g, or t
  misc_feature (316)..(316): n is a, c, g, or t
  misc_feature (340)..(340): n is a, c, g, or t
  misc_feature (347)..(347): n is a, c, g, or t
  misc_feature (372)..(372): n is a, c, g, or t
  misc_feature (377)..(377): n is a, c, g, or t
  misc_feature (385)..(385): n is a, c, g, or t
  misc_feature (535)..(535): n is a, c, g, or t
  misc_feature (568)..(568): n is a, c, g, or t
  misc_feature (625)..(625): n is a, c, g, or t
  misc_feature (655)..(656): n is a, c, g, or t
  misc_feature (667)..(667): n is a, c, g, or t
  misc_feature (671)..(671): n is a, c, g, or t
  misc_feature (682)..(682): n is a, c, g, or t
tgtttcctgcaacgatcacgaacatgaacatcaaaggatcgcatgggaaagggtccctcctgctgctgctggtgtcaaaactgctcctgtgccaaagcgttggccccttgcgcatctgtcccggcggggctgaccgatgtcaggtgaaccttcgagagctgttttgaccgcgccgtcgtcctgtcccactacatccagtaaactctcctcagaaatgttcagngnantcgataaacggnatacccatggncnnnngttcattaccaaggncatcaacagctgncacacttnttnccttgncanccccgaagacaangagcaagcccaacagatgaatcanaaagacnttctgagcctgatagtcagcatatngcgancctggaangagcctctgtatcatctggtcacggaagtacgtggtatgcaagaagccccggaggctatcctatccaaagctgtagagattgaggagcaaaccaaacggcttctagagggcatggagctgatagtcagccaggttcatcctgaaaccaangaaatgagatctaccctgtctgtgcgggacttncatccctgcagaatggctgatgaagagtctcgcctttctgcttattataacctgctncactgcctacgcagggattcacattcgcanntatcttagctnctgnagtgccgaatnatacacaacaacaacttgtaagcccacatccatttcatctatttctgagaagttcctaatgatccgctcattgcaggttcctttaagtgtaaccttttgaatccacgcttggtggaacagtcctctctaaaaataaactgactcctagaggctcctt

SEQ ID NO: 500871 - DNA, 195 bp, Homo sapiens
cacggggtattgggcgccggccagggggcgcatgcccagaggccggcccgcgccgcaccccgggacccgggcacactccccccacccccgggacacacaagggacccacggaagctagcgcctggggcatgccacacggtaacgcattccccaccgagcagggatctccgcagccaggtccaacagctggcaccg

SEQ ID NO: 500872 - DNA, 223 bp, Homo sapiens
  misc_feature (16)..(16): n is a, c, g, or t
  misc_feature (36)..(36): n is a, c, g, or t
  misc_feature (63)..(63): n is a, c, g, or t
  misc_feature (67)..(67): n is a, c, g, or t
  misc_feature (131)..(131): n is a, c, g, or t
caaaagacttgatttntaggagaatttacccatctnaactctataacagtcctgaaggattancagntgttctcttccaaatctgttaattcagctgtgtattcccatagaatcttcagctttcttgttgnatttggcattactttcattaatgtagtcgatactgcatcatcatataaggcgtctccggctatattgtctcgttttcaactgtttccagatc

SEQ ID NO: 500873 - DNA, 756 bp, Homo sapiens
gggtgtctttgctgatggtcacatggagctgcaggttgaatccggggtgccgtttagcgattcagcaccatggcggaagacatggagaccaagagatcaagaactacaagtaccgcccctttgtgacagccgacttgccccaaagcagaatcctagactagaattagctgctggcagaactacctggactttcacagcgactgttcggaaggtcaatgaccgctaaaggaggcgatatctctgtgtgcaaatggtaccagcgtgttgttaccagtccctctggcccacatcctgggtcacagagctgggatgagcaatcgggctgtacggcacgtttcccgtggaagatctgaacgggctgcatctccctattcctctgttcctccatgcttctcccagggatggtgaagggggacctggtacccattgatccccaatccgaggatcttgagtcatgacttaccgtggctagtaaaaagactcatgatggaagacgagtgatgtggctgaaagatgatggcgcgctgacgactcgcatgattcacctgatcctgacaagtccagatgagccggcgcgccgattcagcagtcgagagcacggcccaatctcgtgcacgaaactgccaagcgtggtgacacccctgcgtgtagggtccgcccccaaaaacaaccccggggggaaacgcacgcgttaaagacagccgacaggcgcgtgggcgacccgaacgcaaagggggcacagagacgcaaatgtcc

SEQ ID NO: 500874 - DNA, 183 bp, Homo sapiens
catatacagcatcaactcattcacagcataaactattacagaataaactatactgcatcacagggattatgcctaacttcaatacaacacatactcctcactttctccttccagtctcttgtaacattgctagcatttatctctcttcaacagaagcgtgtgtgcacatatgcagtatgtaca

SEQ ID NO: 500875 - DNA, 170 bp, Homo sapiens
caaataatagcaatgtaaaaatggttttttgaccctccaaatggaattacagactcagtagccatattttcccacccccccagtataaatttttgtctttttgctatgggggggactttgcagctgcttttgcagaaatcccaattttcctgtggaataaaaatggtcca

SEQ ID NO: 500876 - DNA, 380 bp, Homo sapiens
  misc_feature (3)..(3): n is a, c, g, or t
  misc_feature (6)..(6): n is a, c, g, or t
  misc_feature (19)..(19): n is a, c, g, or t
  misc_feature (22)..(23): n is a, c, g, or t
  misc_feature (30)..(31): n is a, c, g, or t
  misc_feature (294)..(294): n is a, c, g, or t
  misc_feature (332)..(332): n is a, c, g, or t
  misc_feature (367)..(367): n is a, c, g, or t
  misc_feature (378)..(378): n is a, c, g, or t
tgnatnttagagatggganctnnctatgtnncccgggctagtctccaccgtgcctggcccctctgtggttactttctctggtgaagtcaaacccctcaaagtcatccatgatgattggagtcaacttttttcaaactcctctaaatgttgacatattgacctcttctcaatgaatcactaatgttcctaatggcatctaggatggttaatcctttccaaaaggttttcagtttactttattcagatctatctgaagaattactttttgtaggaagctacagccttgcaaaaagnatttctgaaataataaaacttgaaagtcagttggggcngggtgggccacacctgttaattcaaaggcagtttngggggaggccnag

SEQ ID NO: 500877 - DNA, 760 bp, Homo sapiens
ggacgcgtgggtcgacccacgcgatcgaccactgcgtcggtggccgagtccagaaggagcttggggcccgggctgtttttaccaagcccgatcacgcacctctctcgccccagagcagcgtgacctcctctggtcatgtgagcgagacatgatgtgagcacggactccagcgcggaacaccttccaggaggatggcagtggcatgaaaagatgtgccctcatggctcaggagcctccgtttgcacaagtatgcagccctcttctcacagatgagctacgaggagattgatgacacctgactgagcagcacctggagtctcacgaacgtcaccaaaggtgcccggcacaagatagccctgagcatccaaaagctgcgtgagagacagagcgtcctcaatgtccctagagaaggatgtgctggaacggcgggaacctacgaaactgctctgcacggagctgcagtcagatcatcatcactcccatcatggcctacagtgtcctccaggccaccgtggctgccgtctaccacgacccctactgccaaggatggggcccgggggaaccaccggtgaccaggtgctgagccttcccctagtccaacccgtgacaggactataggcaccgagcgccaaggaccctccagctgtggagaacgtaaccagctccagcagctccagctcccacttgatggcacgtgagccctgcccggatcccagtcaggcgaagggagacatcccccagccagtttacacagggtgtt

SEQ ID NO: 500878 - DNA, 900 bp, Homo sapiens
  misc_feature (176)..(176): n is a, c, g, or t
cgggcaaagccttaccaagctctggcatcacgaaacggtacccccttgtgtcaaacacgaacaagcagccttagatggtggactgcggaactggagcagtccagtctagaaggattccaagtctgggctcaagccaaccctacggcagagtcgtaaacggcatctgcggagaaatngtctatctgggaacaggtcattcagcaagtaaccatagtctaagcaagagctgggcaaaggctgacccaggtttggcatagaaatggtaaccccttgttcagataatgatacaagaagccttagatttggatggggaacctgatctgtccagtctagaaggattccagtgggcaaggtcgtttccactattcctcgtccctggcttggcaagaaagcgaagcctgttctgagagcagcgtgatcatggacagagctccttcagacgcaaagcttcttacagtgaggaaggtacaggcaaagaaaatgagccccagcagaaggtttcacatagtaactcattgagggctggacagagccagaaagcaaccatgcacctcaaacaagaagtgacacctgcgggcatgccgtccctccgaatcaggtgaaagggctgacaaatagttgctagcccataaggcgacaatagtgcacaagttatcctctgaccatataatacgcgtttgatgcatttggcaaaagagcttgaacagccaggagaggtctataccacagtcagagaatcagaattcccaggagagtaagtggagagggaaactgtcgtgtcatcaagcgcaatctctcaggcccttgcgatctccagtttagcaggatgcagccacagagtagtatgcgtgtacctctgggtgctgaaccaaaatgaagaaccaaagtgattagaaagta

SEQ ID NO: 500879 - DNA, 351 bp, Homo sapiens
caggtgaaacaggaagttgccttgtacccaagcctggtgtgacttcagcagtgttgctactagaagcagaaagcatggtctagccaaatataactgagaagaccaccaacagagaaatgagaatgaagatgtgtgttgactcagtcacatgttgaggcccaggaagagacaaaaggataatagcaaaagcacaaatgtcatgtaggacggagaaaggagcaggaagggggtgattccttcttgtctaattctgcttggtgtccttggtaggctaagatgaaagtccctggtttggtggagcttacattcacgtggagaattcaggatatgaagcctgattccaccttgcca

SEQ ID NO: 500880 - DNA, 541 bp, Homo sapiens
caaattcagtaaccaccaggcacaaattcaccaggaacaaccaagcaaggaaggaagaagaagctgatgcaacaaggtgtggtatgacttcatccctcgcccatccccagaagtagcactgagtaaaacaatggagatgacaaaaatattggtaacagtgggccccagtatggacaaaggcactgacgaggtgaccaggccacgtggaggagagtcaaggaaaactcttgggacaacgaagtctttgcttccatctcaggacctcagcataaggaaaggttaaaaaaagtaaaagtaagattcaccaggactaggcatttcccaggtctcagagcagcctgggaaagccaaatcctgcagaagtcagagacacctttgactgtgtctagtgagttctggttctggacatttaatgggaacctagaagagaggggataccaggttccccaacaaagttccgtcaaataattttgtcagtgttcaccagcttgtaaaaacttagtgcgagagctgaaacatctaaataaataatgacatgcaa

SEQ ID NO: 500881 - DNA, 724 bp, Homo sapiens
  misc_feature (286)..(286): n is a, c, g, or t
  misc_feature (306)..(306): n is a, c, g, or t
  misc_feature (334)..(334): n is a, c, g, or t
gagatcttggtgggtggcggggaatactccatataaaatcaattgtggggggggggggcatttttataaaagggcccgaggccgccccctttttcgggggtcccgggggagggaaaggacactttttttttcgtgtttttggaaccccccttgagggaaagtggccggcgatcctttgcccaagagggggttttaaaaaataaaattcccccaagtgcagagacagaggcctttttatcccccgccccccgttttataagggagggggcggccctcctccccaaantgttgcggtttgggggttanaatgggttttccccaagggaggccatanaaaacccttttttcctcggttgggggggggggacccccaaatttcctgcccccatttccatttttgccctaaaggggatttagccccaaaagggggccccccttgtgtttttgttaaagcctgattcaggcgggccagcttttggggggggggaccccgagttttaaacccaaaaccggggcccccaaaggaaggggttggggggtttcccccccccttatgggggggccccccaaaaaattttcccgggtttttttttgccccccggcctgggccatttttcccggcccctttttcccctggggccggcccaaacccccccccctgggccggtcacccccccccttggccggtttgggggggggtaacaaagtttttttccctccttta

SEQ ID NO: 500882 - DNA, 1424 bp, Homo sapiens
  misc_feature (910)..(910): n is a, c, g, or t
  misc_feature (979)..(979): n is a, c, g, or t
caaattcagtaaccaccaggcacaaattcaccaggaacaaccaagcaaggaaggaagaagaagctgatgcaacaaggtgtggtatgacttcatccctcgcccatccccagaagtagcactgagtaaaacaatggagatgacaaaaatattggtaacagtgggccccagtatggacaaaggcactgacgaggtgaccaggccacgtggaggagagtcaaggaaaactcttgggacaacgaagtctttgcttccatctcaggacctcagcagtaagattcaccaggactaggcatttcccaggtctcagagcagcctgggaaagccaaatcctgcagaagtcagagacacctttgactgtgtctagtgagttctggttctggacatttaatgggaacctagaagagaggggataccaggttccccaacaaagttccgtcaaataggatgattatgagctctgagtccattaaaatacagaatgaacatttaagaactgaggaatcatagatgtagaatagtatgtaaatgttataaatcttgacaaagaaaaattaatgtacattgacaaattcagacatggaggaggtaaagtgggataaagacttaagaactaaccgtctcatcattcatggccaggtgtcatgtcacgtcatgtcttaaaattataatatggggaaaaacgctagtgaccaaccttaagtttttccacaatcttttttttccttgaccttaatacagtggttctcaaagtgtggtcccagaccagcaacatcagcatcacctgagaacttgttgaaaatgcagattcttggcccaccccagacctcctgaatcagaaaccctgggggtggggccaagcaatctgtgatttaacaagtcctccaggggattctggcacatacttgagttngagaataactggcttatttatcccttttaggaaccaatgaagaaacatttatctgaagttcagcagccncttcaatttaatgcctaattttttttctatgcattcaaataaagttaaatctaaaacttgtttgctggccgggcacagtgagtcacgcctgtaatcccagcaatttgggaggccgaggcgagtggatcaattgaggtcaggagtttgagaccagctggcaatatggtgaaacccatttctaataaaatacataaattagcgggcgcagtagcatgcactgtaatcccagtactgggaggtggagcggagatgttaaccggaggggagtgcgtgaacgagccgcatggcccaaccggggaagcggatctgttcaagaatatcataccgtccaaacagtggatccccgcgcttggcaatttgagggggaaccccggccgggttaagggaggaaccgctacataaggttaataaaagggcccggccactgatacaggatattttaaac

SEQ ID NO: 500883 - DNA, 1044 bp, Homo sapiens
  misc_feature (530)..(530): n is a, c, g, or t
  misc_feature (599)..(599): n is a, c, g, or t
tcttgacaaagaaaaattaatgtacatgacaagatttataacatttacatactattctacatctatgattcctcagttcttaaatgttcattctgtattttaatggactcagagctcataatcatagatgtagaatagtatgtaaatgttataaatcttgacaaagaaaaattaatgtacattgacaaattcagacatggaggaggtaaagtgggataaagacttaagaactaaccgtctcatcattcatggccaggtgtcatgtcacgtcatgtcttaaaattataatatggggaaaaacgctagtgaccaaccttaagtttttccacaatcttttttttccttgaccttaatacagtggttctcaaagtgtggtcccagaccagcaacatcagcatcacctgagaacttgttgaaaatgcagattcttggcccaccccagacctcctgaatcagaaaccctgggggtggggccaagcaatctgtgatttaacaagtcctccaggggattctggcacatacttgagttngagaataactggcttatttatcccttttaggaaccaatgaagaaacatttatctgaagttcagcagccncttcaatttaatgcctaattttttttctatgcattcaaataaagttaaatctaaaacttgtttgctggccgggcacagtgagtcacgcctgtaatcccagcaatttgggaggccgaggcgagtggatcaattgaggtcaggagtttgagaccagctggcaatatggtgaaacccatttctaataaaatacataaattagcgggcgcagtagcatgcactgtaatcccagtactgggaggtggagcggagatgttaaccggaggggagtgcgtgaacgagccgcatggcccaaccggggaagcggatctgttcaagaatatcataccgtccaaacagtggatccccgcgcttggcaatttgagggggaaccccggccgggttaagggaggaaccgctacataaggttaataaaagggcccggccactgatacaggatattttaaac

SEQ ID NO: 500884 - DNA, 351 bp, Homo sapiens
  misc_feature (17)..(17): n is a, c, g, or t
  misc_feature (71)..(71): n is a, c, g, or t
  misc_feature (79)..(79): n is a, c, g, or t
  misc_feature (147)..(147): n is a, c, g, or t
  misc_feature (220)..(220): n is a, c, g, or t
  misc_feature (227)..(227): n is a, c, g, or t
  misc_feature (256)..(256): n is a, c, g, or t
  misc_feature (310)..(310): n is a, c, g, or t
gacgccgcaaaactgtnccaggaacgtgacaaaggcactggtccttgggacgtcctgctggccaaggaganctaaagcntgtggaggtaggtgtgcccctgagctccagggttcctggagcctcacgaggtcaagggaacccttgtngaactccaccagcggcatctcgggaggaggcatcacccagaaaggcgagagcttggactcggagcctggcggngccagantagttaggggagcagaacaagggcgaggnagggctggaagcatttgctggagccctgcagccgcagctggtagtccatctgtncgttgatgttctgcagagatggcagccccgggctgtgttgg

SEQ ID NO: 500885 - DNA, 354 bp, Homo sapiens
  misc_feature (99)..(99): n is a, c, g, or t
agggcctggggcctttgtttttctgtggcctgagctccccaaagtcctgaggaggagcgccagttgcccctcggttacagaccacacacccagcccttntgggccagcccaaagggcccttcaaaccccaactgtttgggggtttgacttttgtggcctcagcaggacaggccccgggcactgcctcccaaccaaggctggactgggttggctccagtgtggtgtttagtggataccccatcggaagtgattttttaaattggatttgaattcggctcctgttttttatttgtcatgaaacagtgtatttggggaaatgctgtgggaggatgtaaaaattttgtttttccccca

SEQ ID NO: 500886 - DNA, 429 bp, Homo sapiens
cgtttctgcctctcctgcctgtggttcaccagtgccagggcccctggaggtgccgccctcccgagctcgcccttgctgcccagcattcaccagcgccagggcccctggagtgccgccctcccgagcgcgcccttgctgcccggcgttcaccagcgccagggccctggagtgccgccctcccgagctcgcccttgctgcccggggttgtgtgctgccttcacggccaacttggtttttgtttcttgggggttttttgtcctgctttgacaacaacattctgcctgtcctgtatcctactaagggccaaactggacttgttttttatgcttcctcttattattgagatgtaattcacacaaaaattcagcgtttttaaatgtacagctccgtggctattaacaatattcgcggtgcagccatcaccactgc

SEQ ID NO: 500887 - DNA, 527 bp, Homo sapiens
tgctggctgctggctgtccggttcatcacggccaatcagatatgagatggtgtaaggagaagtactacaagaatgacggaatacgagagctgttttacaaaggaactgcagcaatctatgaaagacttccaaagaatgtagagcacagtacgtaatacacttgcgctgctccctctaccccttaccccacaacgtgcaactgacactcccacccagtctctgctccacctttcagcccacgtcacgtgtagtgtccattttgtgaagccctgttgtgccacagagtgtagccaggtccccctgcagctagtcctagtgaacctcaccccgaggccctgcatgggccagcccctccatctgtacttggtccaactgcaactcatcatcggtgactggttatcacaccatcgctggcccctttgggccctgcatgtagtgtgggaggctcctgttagctcctcactgtggtaaatgccacacacctttaagtagataagcagacgatagttatctgttcttttgactta

SEQ ID NO: 500888 - DNA, 276 bp, Homo sapiens
  misc_feature (196)..(196): n is a, c, g, or t
  misc_feature (214)..(214): n is a, c, g, or t
aagactatagtaaagtttgccacattgatttgctctttcatgaaagacttctctgtagaacgcgatgctatttaatgatgtttacccacaggagaacttctttcaatattggagccaatcctctcaaaccttgctgctggctttatcaactaagttgatataatagtctaaatcctttgctatcatttcaatggtncacaggcatctccaccangcattgaattccatctcaagaaacccactttcttttcttttttttttggaaacagcatatca

SEQ ID NO: 500889 - DNA, 138 bp, Homo sapiens
  misc_feature (69)..(69): n is a, c, g, or t
gcataaaaagtgctctctccataaaactcagcacttgagcagatgttgtattatataagcatgccaatntacttatctgccacatacaaagcatccttccaggtgctagtgaggcgcacacacgcttgcagcattggt

SEQ ID NO: 500890 - DNA, 274 bp, Homo sapiens
gctgggccaaccacaagagaagagggatgcacatctcccagaaactattaaatagctgtatctcaactacagtgtcagaatttacgaaccaccaattcaagatggaaatatgcagcgggacgagttatcaaacaggtaacagaattggactaagagcatgaactgtagaactcttacgattacaacgagctccctggaaggacaatgaggcatatggacgcagacagggaacgcagggacaccggctgagcatcgtttacttacaccaacctct

SEQ ID NO: 500891 - DNA, 216 bp, Homo sapiens
gtatgtatatcatcatattatcatcagtggtgtttcttctcaatattaaatcaattctttcaaaaccaacaaaaaagcccaacctgctcacctatttgagatttgcaaattagactaataacttttattgtttctgtatactttgccaacgattaaatgcatcttcatcctgcatcatcctaaaatactcaacatctctatttacaatagcaccgg

SEQ ID NO: 500892 - DNA, 788 bp, Homo sapiens
  misc_feature (19)..(19): n is a, c, g, or t
  misc_feature (67)..(67): n is a, c, g, or t
  misc_feature (72)..(72): n is a, c, g, or t
  misc_feature (75)..(75): n is a, c, g, or t
  misc_feature (86)..(87): n is a, c, g, or t
  misc_feature (100)..(100): n is a, c, g, or t
  misc_feature (110)..(110): n is a, c, g, or t
  misc_feature (113)..(113): n is a, c, g, or t
  misc_feature (131)..(131): n is a, c, g, or t
  misc_feature (134)..(135): n is a, c, g, or t
  misc_feature (137)..(137): n is a, c, g, or t
  misc_feature (142)..(142): n is a, c, g, or t
  misc_feature (145)..(145): n is a, c, g, or t
  misc_feature (154)..(154): n is a, c, g, or t
  misc_feature (159)..(160): n is a, c, g, or t
  misc_feature (167)..(167): n is a, c, g, or t
  misc_feature (174)..(175): n is a, c, g, or t
  misc_feature (182)..(182): n is a, c, g, or t
  misc_feature (190)..(190): n is a, c, g, or t
  misc_feature (197)..(197): n is a, c, g, or t
  misc_feature (213)..(213): n is a, c, g, or t
  misc_feature (222)..(222): n is a, c, g, or t
  misc_feature (259)..(259): n is a, c, g, or t
  misc_feature (267)..(267): n is a, c, g, or t
  misc_feature (270)..(270): n is a, c, g, or t
  misc_feature (289)..(289): n is a, c, g, or t
  misc_feature (291)..(291): n is a, c, g, or t
  misc_feature (293)..(293): n is a, c, g, or t
  misc_feature (298)..(298): n is a, c, g, or t
  misc_feature (300)..(301): n is a, c, g, or t
  misc_feature (325)..(325): n is a, c, g, or t
  misc_feature (365)..(365): n is a, c, g, or t
  misc_feature (379)..(379): n is a, c, g, or t
  misc_feature (386)..(386): n is a, c, g, or t
  misc_feature (414)..(414): n is a, c, g, or t
  misc_feature (420)..(420): n is a, c, g, or t
  misc_feature (422)..(422): n is a, c, g, or t
  misc_feature (451)..(451): n is a, c, g, or t
  misc_feature (456)..(456): n is a, c, g, or t
  misc_feature (478)..(478): n is a, c, g, or t
  misc_feature (481)..(481): n is a, c, g, or t
  misc_feature (490)..(491): n is a, c, g, or t
  misc_feature (540)..(540): n is a, c, g, or t
  misc_feature (547)..(547): n is a, c, g, or t
  misc_feature (563)..(563): n is a, c, g, or t
  misc_feature (569)..(569): n is a, c, g, or t
  misc_feature (594)..(596): n is a, c, g, or t
  misc_feature (606)..(606): n is a, c, g, or t
  misc_feature (670)..(670): n is a, c, g, or t
  misc_feature (675)..(675): n is a, c, g, or t
  misc_feature (767)..(767): n is a, c, g, or t
tacactactgatatattanacaaaaaaaaaacctttagaaaaattatgcacaagacatgatattggntttanacnctggatcccannattttacacactnggaaaaaatnttngactaggcatgtccagtnaannanccagnaantaaaaaaanacacnnaaaacanccacctnnctcaagnggcaaatncagtacntacagcattggcagangtgcgtcanaggtggcagaacaaattcacacaaaccagttgaaganaacacaanaanaaaaccatccagcaacagnananagctntnnatttaacaaaccattcttatttcnaacttcaggagttgatgtttttcccagtccatcttaaaanattactgctttaancacagancagaaaaaaaggacaacatgcacaaccnccaccnanaatcctgttgtagcctagacagtgaaaanaaatnacatcagaagactttaaaaatncancaccctttnnaacccccaaagtgtaactgcacacctccacaaacgggcctcttcctcanaagtcanagtcaccctcacaagntcttanattccattctttcccaaaattcaannnacactaattnatacatcatcctttattccttaaatacccttaaacattttttaaacttttttcaccctcctaanaatcntcaataaactctcttccaaaacttctacatatattccaatatcccattatttttatccttttatttttatcacctcaaaatcactctcaacnaccttctttttaacctctttc

SEQ ID NO: 500893 - DNA, 463 bp, Homo sapiens
  misc_feature (178)..(178): n is a, c, g, or t
gtgagtcacgtctcagtaggaagtagtaatcagggagcatcaggcagctgattgccagagttgctgatagaatcactttgttgctgcagtgggctatcacatcactacataccagggctgatgtataattaccttaaacacagagtggcatttaaccacgccactgtttatgtgcccnaatcagcactcagaggaagctgccttttaaactttaattttttttttaatgataccttgacattgcatgtgactttggctgggaaaataagcctggctgtttgtgcttgatgttataactcaaaggctcagaagtggtggagttggatccagcagccaacccacaatagagctgtcttgacatcctcactggtccagccatgcaaaccagcttctcgtggggatggagcttttctgcttagcttttctgcctttctcttatagtgatgaactcgaaccccgtgtg

SEQ ID NO: 500894 - DNA, 87 bp, Homo sapiens
ctagaagattcagcaaagtacttttgtgctcttggggagttcctacgtccccttgtactgggggatagacggtcagcacaactcttc

SEQ ID NO: 500895 - DNA, 338 bp, Homo sapiens
ccatattaaatccagatctatacaacgctcagccgccgctgttgtcgcgaccaggactgtgcgcacaaacccttatgtcgacagcgttgtgactatggaggatatgaaccagtacagcaatatagaggaattcgcagagggatccaagatacaacgcgagcacgaatcagcaggaggacggtgaaatggttataggaggcttgagctcggataccagccagaacgatctgacagagaacctggctcgatttagcgaagatgtagactgcgcaagtgatgctgctagtgctgatggtttggaactgagagaacactgactggatggccttgagagttct

SEQ ID NO: 500896 - DNA, 474 bp, Homo sapiens
agagctgcctggagcttcacttggtactcccgggcaacctcctctgtgaggaacgtgtggtgaccacggtgctcttgagaccgctcacaaagccagcaaatgaccttcccgtcccgccccctgcgcccaactcgccctccaccagcttctccaccacgccccctacctgccgatcagcctgcacgctctcagcctggtaactgatccggcacccagggcagctactctctccttccgtctagcactggacttacttgtggtcttgcagtgagggcatgcttggcagaagctgctggccgcagtccaggctcaggggttgtgtcaggagttccaggcagatggggcaggtcacctcctcctttacattaaccaggattccagaagccatagtagctattccaccgctacccccgtagtatacgccgtcccagcggcgcccacctcccacccccccccgcacgcgccccaccctcc

SEQ ID NO: 500897 - DNA, 403 bp, Homo sapiens
taatgttttgaaaggaatcttttttttgtttctgggcagtagatcttaacggtgagcttaaaatactcagtaaatcgttttaaacagatgtgctgtcatccaggctttgtttcattcatacagcacaggcagagtatatttagtgtaattcttcagacccctaggattttcagaatggtaaatgagcattggctttaacataaagtcactggctgcactagcccctaacaagagagtcagccttttgaagctttgaaggcttctcttagaagcgatctagctattggctgggcgcattacgtcacgcctgtaatcccagcacttcgggaggctgaggtgggcggatcacgaggtcaggagatcgagaccatcctggctaacacggtgaaaccccatctctact

SEQ ID NO: 500898 - DNA, 289 bp, Homo sapiens
gaccctaaatccaacccccgcatgaccctgctaaggttcacagagttgtgtggatatatggtatccttttatttatcttttttttttgagagggggtcttgctctgtcgcctaggctgcagagcagtgacaagatctcggtacactgtaacctccacctcccgggttcaagtgattctcatgcctcagccactcaagcagctggcattacaggcacctgtcaccactcccagctaacttctgtattttcagtagagatgtgtttttttgtttgtttgttttccttgaga

SEQ ID NO: 500899 - DNA, 144 bp, Homo sapiens
tccttccccctccatacctcgtcccctctctcacaagtaggatgagtgtggcgctttgctatgtgaacccaggaagcacttttttgtgggatgcccggacccatgctcagctagggggtgcagtgttaacaggcgagagtccct

SEQ ID NO: 500900 - DNA, 255 bp, Homo sapiens
actacttagtaggtattctatatagagatttctggtcaacgaggataataatacataatataatttaagccctgcgtagttgggttgattaacaacatccttgttaagtttcccaagcctaatttacagggaaggtcttgaagggtgggggagggaatcaactttgtaggcttcagggagggtttgagggtctaacaattgaggccaaagaatttgttgccacctgcacgttccactccctggggtgaacagagg

SEQ ID NO: 500901 - DNA, 340 bp, Homo sapiens
  misc_feature (325)..(325): n is a, c, g, or t
gaaaacaaattaaaaatggcagtagtaagtccttatctatcaataacaacattgactggaaataaactaaactctccaatcaaaagacattgagtagctgaatgggttaaaaaacaagacctaatgatctgttgcctacacaaaacatactttacctgtaaagatatacatagactgaaaataaagggatgaaaatagatattttgtgaaaatggaaactataaaagagcatgaatagttagatacaatagatttcaagacaaaaactattaaaaagacaaagtcattatattaatggacaagggttccaatttaggcaaatggntgtggaccagttttt

SEQ ID NO: 500902 - DNA, 254 bp, Homo sapiens
  misc_feature (147)..(147): n is a, c, g, or t
  misc_feature (216)..(216): n is a, c, g, or t
  misc_feature (235)..(235): n is a, c, g, or t
acccccattgacccacagggctgtgaggacacatgtgctcagagcctggctcactgcatgccaatagcatgagatcccgaaatgtttgttgctcagagttgaacaaatttctgagtgcctttattactaatcctgaagaataatgtnttttcagtatcacacattaagacatggaaagaaaaccccattttaaaaatacggaagaaatcattatanaatacacatcctaaaactngggtcctcggtggttcggt

SEQ ID NO: 500903 - DNA, 342 bp, Homo sapiens
ggcactttagtgcttatgcctaggccaaggaaacacgtagcttttcacaggtggtagataaggctctggccatgggagtgttgaggacagagttgtgataattcattttgttctttttttttttggaaaggaagtttcatccttttggcccaggcggaattccaggggcacaatctgggctcactggcaacctctcggccctccggggttaaagtgatctccggcctcgggttcatggagtagctggaattacaggcacattgcaaccacagcgggctaatttaatattttaagtaaagacggcgtccaccttgtgggtcaggcgggatctgaactcttgac

SEQ ID NO: 500904 - DNA, 351 bp, Homo sapiens
  misc_feature (300)..(300): n is a, c, g, or t
  misc_feature (315)..(315): n is a, c, g, or t
gagtttcaactcttgttcccccaggctggaatgcaatggcgtgacctcagctcaccgaaacctctacctcccgggttcaagcgattctcctgtgcctcagcttcctgagtagctgggattacaggcatgcaccaccacgcctggctaattttgtatttttagtagagacggggtttctccatgttggccaggctagtctcaaactcctgacctcaggtaatccacccgcctcggcctcccaaagtgctaggattacaggtgtgagccaccacacccggcccacaagtatgatttataacntattctcctttaaanaggaatacaggactctctgtattaagtatgaccaga

SEQ ID NO: 500905 - DNA, 287 bp, Homo sapiens
actttagagtatccccgcatgagggacggcggatacttccttccagacgcagataatggacgggcggattattcctttcaggtacgcagataatggaccgggcggatgacttccttccatgtacgcagaatatggacgggcggattacttccttccatacgcagataagtggacgggcggatgattccttcaggacgcagatgagtgaccggtggatgacttccttccagacgcagattaggaacgggcggatgatcccttcaggacgcagaggcggttcccgggtt

SEQ ID NO: 500906 - DNA, 958 bp, Homo sapiens
caggctgagtgcagtggcatgatctcggctcactgcaacctctgcctcccaggttcaagcgattctcatgcctcagcctcccgagtagctgggattacaggtgtgtaccaccatgcccagctaatttttgtatttataatagagacggggtctggccatgcggtgctatggctgtgtttcaaactccttgaccttcacggctgaatctgcctgtgtccgccatcccaatgtgctgggattacaggcatgatgccacctgtcgcggtcacatttgcatgtttattaaaagtgggtataaatgtgggtgccagacgtgctccggagctgaatcctgtctgcctacagggtaagaccatgcatctgctgggcggctagtcaacagggttcgtaaagaattagcgcggtatcagattataatgctggttgatcgtatattatcctttcaggcttgctcctttgagggttctttctctgctgccagcgccagggcagggtcgtcatgggctccggccgctacttgtggggcttgcgtgggtctgtatcacggttgttctgtgcttgaagtcaagcccaccttgtttgtgtgttgagacgctcttgtctctgtcctccgtgggtggtgatcctgtggtgttgatctcttgctcactgggatttcttccaccctcctaaggctcagcgatcctccagcggttaggcttctgaggaggctgggactgacaggcggtgcccccagggccccggctaatgttggatttgccgcgggccgggtttagcccggtgtcccgggggcgtgaacccggaaaaggcggcgccaaccatgagtcctcaaggggggaaataggggtaccccctgtgctgattggccgttgttagcaagggcccgtctcactaagagcgggggatataccgaaggggacaacactgcagttggcagcgaaacttcccatataagcta

SEQ ID NO: 500907 - DNA, 544 bp, Homo sapiens
ccgggttcacaccattctcctgcctcagcctcccaagtagctgggactatagcgcctgccaccatgccaggctaatttttttgtatttttagtagagaggggttttcaccatgttggccaggatggcctcaatctcctgacctcgtggtctgccagccttggacatcccaaagtgctgggattacaggcgtgagccactgtgcccggaccctttctttcttatcttttttttttttttggaaatggagtctcaatctgtctcctaggatggagggcacagggcgagacctgggctcactggcaccctccgcctcccagattcacgcaatatctacatgcctcagcctcctgagtagctgggagataacaggggcccgcaaccacggccgggacacaccaaacaacacacacaagacaaaacaaagagagagaaacaaaggaaaggacagaagaaaagaaagaacggagacgagcaaaagcgacaagacgagaacagagacaaaagaacgacgacacagaagaggagaaagagaagagacaagcc

SEQ ID NO: 500908 - DNA, 818 bp, Homo sapiens
  misc_feature (255)..(255): n is a, c, g, or t
  misc_feature (339)..(339): n is a, c, g, or t
  misc_feature (393)..(393): n is a, c, g, or t
  misc_feature (420)..(420): n is a, c, g, or t
  misc_feature (471)..(471): n is a, c, g, or t
atatgtctcatgtctcgttccttcttaatatgatttagctggaattcattttcttttcgtttcatgtttaatttcataaaacgtttaacaatggcatatatacttggcattcctgtccaccaaggatgtaatccaagcctgggaaaatcttaaatttctttttacttaaatctggaaattgtctccattctgccaccttttttttttttttttttatataggggaggggaggaaaggggggtgataccttgcagnaagtaagtcgaaatagcttgcctgaaatttgtgaaacagaccatttctaacacccagggtctgtgtttataaaatactggaganttacctttaagtgtgggaatcaacagatgcggaagaattataacatactctttnaaaagctttcataaataccagcagcanttggtaagcaattctacaagggttctggaacctttctatttatttacaaantctggaaaagtccttagagggttcacctaatcaggaataaagggcatttattccatgcagtatgattcacaggtatcctggagattcttgctccagtgtcctaatcagcaccggtgttcacaaaaaaatcttccaaattccctaatattttctacctatggttgtgggaacttgttccctgtatggggacaacatgtggtcacatggcaggtggtgtctactttacaggtataaacccctgtgtgttgggtgaaattcccgataacgtgtgtgcgggcgcctatttttccctggcgtgttactgttggaacggggttatttgacaagccggcttgccccgctgtgtc

SEQ ID NO: 500909 - DNA, 122 bp, Homo sapiens
ggggttttttcacacaaaaaacctttttcatttcggggggggaaaacccctgggggttttttccaaaaaaaaacctttttttttttcctgtggaaaccccctgggggctttctaactaagaa

SEQ ID NO: 500910 - DNA, 113 bp, Homo sapiens
aagatttcagtatagggtagtatagatcagtcagtatagataggtcagtatagatacttcagtatagatagcgtcagtatagataagtagtatagatacgtcagtactagata

SEQ ID NO: 500911 - DNA, 241 bp, Homo sapiens
  misc_feature (42)..(42): n is a, c, g, or t
  misc_feature (88)..(88): n is a, c, g, or t
  misc_feature (164)..(164): n is a, c, g, or t
  misc_feature (197)..(197): n is a, c, g, or t
  misc_feature (200)..(200): n is a, c, g, or t
caaaaaatgtacaggaattagccaggcatggtggtgcacgcntgtagtcccagctactctggaagctgaggtgagaggttctcctganctggggaggtggaggttgcagtgaaccaagtttgcactgctgcactccagcctggacgacagatcaagagcctgtntcaaaataataataataataataataataatantantaataataatgtagggctggccatggtggctcatgccatta

SEQ ID NO: 500912 - DNA, 144 bp, Homo sapiens
cagttgacttgaggctagctgagacaaaatgtgatgcctggttgaggcttggattgtatgactcctgtcgtagctctgccggcttctgtatcttaaatccctctagctggcctggcacagcggctcatgcctgtaatcccagca

SEQ ID NO: 500913 - DNA, 183 bp, Homo sapiens
tgaatgaacgtctcccaatgatgataacaactacggcatttagttaaggtgaagtccaaacaaaacacgtctgcagactggatctgggagaatcacctgagcccaggaggttcaggttgcagtgagccatgatcacatcactgccctccagcctgggcaacaaagaaagaccctgacacagtt

SEQ ID NO: 500914 - DNA, 149 bp, Homo sapiens
gttactgagtccaacgcatgaggttaaaatcatttagatgttttcaccccttaagctttcgttttcccaagatttctctaagcatttctggggccctctcactcagaaggcaaattctaatcattctaacggaaaacgggtcggacacg

SEQ ID NO: 500915 - DNA, 536 bp, Homo sapiens
aggctgggccagagagtgaggaaaacactggagcagagggacacagacccccgtcagggagagttgaggctgcgctttggtctctccctcctcgctgttacatcctccttgcaagtagcggctgtaaagcttctctgcctctcctaacatgccatcctccactcctgttgcctcaatctctcttcatgcccagctaatccacctttttgggtcttcagacatatcgctgcttcattgatcctctctcctgtatagcagctctctcccctctgcctatgcacagctcttcattccagaacagttgatgtaagcctgcttcccctgtttcttcactgcctttcctctttgtaaaacatactttcacccagagtctcttgaacctatgctcctaaaattcacaaggagagcagggcacagtggctcatttctgtaatcccagcactttgggaggccgagtcaggaagatggcttgagcccaggagatcaagaccagcctgggcaacatagtgagaccccatctttacagggaaaaaaaa

SEQ ID NO: 500916 - DNA, 379 bp, Homo sapiens
aacaagcaggaagccaatccaatacatcagagaataaaaggaagagctaccatctagagaatcaagagcggagagccgaactactttgcatcaggtgtgtaatataaaaggttatacataagcttatggtagaggcgtgtcatctagagatatagtagaactagtacctcgagatagcttggggccttcttgggtgtcctgcagggccctcaaggccagaatgtgggcccaggccacattgccaacatagactgggttaacagtggaggactttccaacacttgacaggatcccattgttgtacagggcctcgtttatactagcagaaaggaatcggcttccttccccatagatatacatgggtcgtaaggcacaagtg

SEQ ID NO: 500917 - DNA, 204 bp, Homo sapiens
aatacctaattacggaaacatctcattatggaacttacctgttctagtctgttggtttatctcccaatttacatttagaaagttcaaaaacaagcaaaactgaactattagatttaggcatgcataacaatcactgggatgatggaatgctaaagatatacaaggaagtaattagcaaaaggtcaggatagctgtggctctatg

SEQ ID NO: 500918 - DNA, 352 bp, Homo sapiens
tcagcttttcctggtactccagtttcctcagcctttgcaaggcactcagggtggggggcagcaggatcaagacaacccgttggagcccctgtgttccaaaggacctgatgccaaggggtaatgggcccaccagtgcctttggagcccaggccccaacacagccccatggcctttgccagatggcttttaaaaaggtgatccaagcaggcccccttatttgtacatagtgactgagtggggggggctggcaagtgtggcaactgcctttgggctgagcacagcttgacccctctagcccctgtaaatactgggtcaatgaatgaataaaactttcctaagaatttcctgggga

SEQ ID NO: 500919 - DNA, 354 bp, Homo sapiens
  misc_feature (1)..(1): n is a, c, g, or t
  misc_feature (27)..(27): n is a, c, g, or t
  misc_feature (29)..(29): n is a, c, g, or t
  misc_feature (34)..(34): n is a, c, g, or t
  misc_feature (271)..(271): n is a, c, g, or t
nctgtttggaacttcacgccgtgctgntnggggnaaacagattctggtgcagccccctggggttagctgttgaacatggaccatatgttcctgactttcttcagagattactgtgtgcgttatattgacaaaccaactgcccaaaacacttctggataactttatattacaccaacagcttgctaatgagccatggtagcagttgccatattataaaaatatttccctcccgttatgaggcatgaaactgtattggtttagctctgcgatncactagttcaaagctagaaggttttatttttgaaaataatcatttgtccttgccacccgaaaaaactggcctcgttggcctca

SEQ ID NO: 500920 - DNA, 689 bp, Homo sapiens
aagggctggtacggcccggaataacgggtctcgcagccgacgcggtagcggaggtcctggccgtctgtggcgacttcctgtgtaggcctgcagcggggtgcgtggcgcctgacggtgcgagagccatgtgatgcgatgcgagctgatgccagagccgagcctcccgccgtcgccatggtgccagaacgacctgatgggcacgtgcctgaggactattgccgaccagttacctccgtgtcacaaagcagtacctgccccacgtggctgcgcctactgtctgatacagcaccttcctggaggacggcatcctgtatgtggttccagtggagcgagcagcgcgactacatcgacaccacctggaactgcggctacctgctggcctcgtccttcgtcttcctcaacttgctgggacagctgactgggctgcgtcctggtgttgagcaggaacttcgtgccagtacgcctgcttcgggctctttggaatcatagctctgcagacgattgcctacagcatatcatgggacttgacagttaagatgaggaacctggccctgggaggaggcctgtagctgctcctagcagaataccgttctgaagggaagagcatgtttgcgggcgtacccaaccatgcgtgagagctcccccaaacagtacatgcagctcggaggcagtgtctatgctggttctga

SEQ ID NO: 500921 - DNA, 155 bp, Homo sapiens
aaatgatccgcccgcctacagcctccaatgtgggattacaggttcgagaccagctggacaacacagtgaaaccctgtcccttctaaaaatacaaaaaattagctgggcgtggtggctcacgcctatagtccaagctactcgggaggctgaagcag

SEQ ID NO: 500922 - DNA, 806 bp, Homo sapiens
  misc_feature (1)..(1): n is a, c, g, or t
  misc_feature (596)..(596): n is a, c, g, or t
  misc_feature (617)..(617): n is a, c, g, or t
  misc_feature (628)..(628): n is a, c, g, or t
  misc_feature (638)..(638): n is a, c, g, or t
  misc_feature (643)..(643): n is a, c, g, or t
  misc_feature (645)..(645): n is a, c, g, or t
  misc_feature (648)..(650): n is a, c, g, or t
  misc_feature (657)..(657): n is a, c, g, or t
  misc_feature (661)..(661): n is a, c, g, or t
  misc_feature (667)..(667): n is a, c, g, or t
  misc_feature (669)..(670): n is a, c, g, or t
  misc_feature (687)..(687): n is a, c, g, or t
  misc_feature (706)..(706): n is a, c, g, or t
  misc_feature (788)..(788): n is a, c, g, or t
nccgcagtgtgctgaaagggtggaacaaaagctggaaaatgagcaaaaatgagttggtggctgtggagatggacgctttgccccttggtcctactcacctgtgggctgcattccagggagagccttgcagcacagactttggcctgggacaagataatcctcagcccaactcatgaatgaatgcttgcagcttgtaggtcttctgtcatctcaaggcttcctgtgctgtctctgtgtcttcccatggaggacttgagggactctgggtcacctagtgccccacccctgcccagtccaaccagccagtctcaggaccatgatctccattgtcactatctctgacaatactgtgcttgagattgatgataacagcagtttgtaaccaaaggcctctagtctcccctccttccatgcctcactgtggcagtctcttcctggaaacacctactgtgtgccaggcgccatgctgtaatttatagccatctgccccatggctttcagtctaatcctggcaccatgctatggaggagatagcattttcttgcttgctgcactcccaggggctgtggcacagataagacaggctgcagcctctntataaatctccagggggttangttgtgagtgntttatctctnattcngnaannntttgttnactngcagtntnngagagtgatgtcattgnagacaaaacactgaatccncggaaattttttttttaaacatcctttcctgatttaactatttccagttacaactgttgtcaacacactgccatcttctganatgtgtgtgatgtgcctc

SEQ ID NO: 500923 - DNA, 463 bp, Homo sapiens
gagaacatgcaaaatcaggaaaggctgtaccaaggaaatataccttaatcaggctgatttggagtgagccagaaataccataaaaatagaaccgtctcaatgatcggggtggcctaatgataaatgtcagggcgtaatgtaacgcgacataaagaccaaaagagacaacacggaagacaatgctcgacagagcttccaaaggttttctcacaacgttgtacaaaagtgctctctgggctagaacatgtgctacagtgtgcggccacatttgggtctctgtggccgtgaacgttgctaaaaattatacatgtggtcacccgtggtaaacgaactgttcgcaatgcaagacatatatcaagtggcccaagaaagaatcctgggttacccgcatgtaaagcatgccgcggattcataaagttcccctgtgctgggacatgtgggctaggaaatccaacaaagtcaa

SEQ ID NO: 500924 - DNA, 881 bp, Homo sapiens
gttttgagggttttctcttatttccgttgcttcctcgagggagagtaatccagtctaatttgcatttctcttacttttaagctgagctgctgcgccctcacgggacacagtcatggggagccctctgccccatggtgggcattggtgaagccacagtggtcccgggggcagacctcaagggtgcacagcagcagccccttgggccctgcctgcccaagccccacctggccccacctgccctgtgttggggactttgtatttcagcctccatgcagggtgacgctgggactccccagcttccggttcacggcttcagggtccagcaggttctcctgaagccccatctaccgctggcttcctgctcactctcccctctcccgctctgtctctccagaggaggccgggcctgtggaattaggcggctgcttcacctgaactcactgcagtgccgggaaaggagcctctggaactagacccaggagcggatctgcaaaggctactcagggttctcccagcggtctgaaccccgaggcaactcgccctccaatcactggcccctgaagcaggcggaggtccctgtgctcagtgggcctgtggcccatttggttcaggagtgatggtgacacggagttggttcatcgagggctcctggcagctttacctctctaagatagtcttagaagcctcttggaagattcacgttccaccgttgcctccaaccaaggcctctcccccgggggcaggtcccctatactattttccttggacgttcccctggtccgcgggggcggtggccccagggcccccgggcggaaccccgctttgggaaggacccggttttttacgcctgggggcccccccccggttttaaagcgcctcgg

SEQ ID NO: 500925 - DNA, 181 bp, Homo sapiens
ggcgcgatggtggcgtgctcctttaggcagctgaacaggtggatttacgcccgtgaagatccgcagtccatccagcgtgcgtgggtagagggcaagtcgggacctgtgtatggggcctggagtcatgcggctggcgtgctgctacggacttgtcctgatccggccccgctattgagtgctg

SEQ ID NO: 500926 - DNA, 114 bp, Homo sapiens
attacaggtgtagccaccacgtccagcctacttccttcttttcacatgataggtatgaactggtaatggaataaaataggccgggcgcagtggctcacatctgtaatcccagca

SEQ ID NO: 500927 - DNA, 186 bp, Homo sapiens
agtatccctactggtcgcagcggggaatgctggcagattgtcatgggtatggagacatatcactactaagttactgctagggtgagtgcgtacgaacgtattttcataggaggtgtatgaattggtcgtagcggaatcgggggtatgctgttcgaattcataagaacagggaggttataaccaggg

SEQ ID NO: 500928 - DNA, 418 bp, Homo sapiens
  misc_feature (274)..(274): n is a, c, g, or t
cagggtgtgtgtgtgtgtgtgtgtgtgtgtgtttatgtgcacgcatgtatatgcatccccacgtagccaggaggggcctgttggggtttgagtcactgggatcttcctggtgagaggtaaaagaagtcactgggcttagctgggcctttgaggcctgtatggaacttttggttgctgaggcacccatggacctgttgctaggaaatagttggggaaggcccaaggccgcccagggcaaaaaaaggagacgaaaagtttgggccagtgggggagnaaatgggaagggatgggatttttgggtcccagagcgggtgggatactcacgcccagctttttcactggtggggggtggggcccccattatttttccctggtcatgatttacaaaaagaaaaataaaactgcttttggaccccca

SEQ ID NO: 500929 - DNA, 234 bp, Homo sapiens
  misc_feature (17)..(17): n is a, c, g, or t
  misc_feature (60)..(60): n is a, c, g, or t
  misc_feature (85)..(85): n is a, c, g, or t
gcggtggcgcaccgaanccgcccatgggcgaggtcgaggtggtcttcaccgcccctgtcngagctcggcatcctcgatcacgacngtcttcttccccgatggcacgatcgtgcagaactcgctgcgggtgctgcgcaacgccgacggcgccgagatcgtcttcaccctgttccagcacccgggcgtgagcgacgaggcgttcgaggccgacgcgacggcggtggccgccgacct

SEQ ID NO: 500930 - DNA, 442 bp, Homo sapiens
agggatgcctcacgctcacaggcatgcatcactaggtggtgcgagacacacagcctctgcacacctcccggggagccaacgctggttagagaataacatcagggcccccttatctggccagaaaccagagaagagttgaacacacccagcagctgacactaacatattggctatgagtgtactgtcacccaactgggacacagtaacgcagccagactacactgtgtgactttgggcaagccactccccttctctgagccccagtttccttatctatcccatggctgatattacatgactgtctctcctagggttgtacccacacctgaatgaccttctagatgtgagctgctgcccaggggacaatgctcagcacacacagcccaccttcaccgtctctgcgtcacgctactctggtccctgatgctctctggaccctgtt

SEQ ID NO: 500931 - DNA, 345 bp, Homo sapiens
  misc_feature (258)..(258): n is a, c, g, or t
acaattgagtggtgacttattgtagagcaggccatggggatgtcagcagcggtctgcactgcgtatggcaggatcttgcttcagattgcccaggtgaggcagaagctgattctcacactgctacagcaaaataccctgctctggtgtatccacaattatcgctcttattgtagtttctgcaagacaggcacagacacacttgcccgctatgtagacaacccccaccaagctcatggcatcagctctccatcatgactnggcgatgcagctcggtggctctgctgatacacactctatttcctacactgttacactccactcacacacttgagtagatcacttggc

SEQ ID NO: 500932 - DNA, 804 bp, Homo sapiens
  misc_feature (503)..(503): n is a, c, g, or t
acctttttggagcaaatgagataaattctctctttcaaaatggtgtatcttccttaatcctatttcataattttcctttggccagttttcacatatcttggatatgtgagcaacatttattatttacattagagtataccttttagtaataaaatgatggaaatcatattattttaaaagcccttggcttctttcataacttataatctcctctaaaaaacctctgcatgtttttaaataaaggcatttcttgtcaaataatggacttttttctaaacagaaataatttcctataattgggcaaagtgatgattcactttttttaacttttttcggattatcagagtacttagtaaatgtatatagttaagtctaagatagtcccaggattaaaaggttaagaggaaaacacaaatcaccaaatttctgataatgtttatctcctgaacaatattttctcactcatattcctctatcttatcattagtaaagacagctaaatntcccaattttctgtccaaaatatgtgtgatttaattgtatataagccttctcattttgccatgtggttgttgatcttacaagttagatgttactatacctaacaatttattcaggtggagttgtgaccacggttcgtggttcatagaattaagaatattggttgggcccagggtttcacggtttgggttaatgggcctttattaattaggctaataatatagggtttggaggaattttaaagtattttttaaaaatttttttcaaattacagttgcgaaattaagttgagttaaatggctg

SEQ ID NO: 500933 - DNA, 1025 bp, Homo sapiens
ttctaaagtcctcctgtatgcagagtgtagacaaatgtttcctcccaggggtgatcagtgcagagatatgtcacaaagcccctgtaagcagaagctttgacaaaggttacatcacctgtttgatcagtggaaatgtatatcacaaagccccctgtagcaaagcccagacaattgttacatcacctgggtgggcagtggagagatctgtcgcaataccctgtaggcagagcttagagaagggttacatcacctgggtgatcagtgcagagattatgtcaaaacgttcctgtaggctgaacctagacaggaattacatcacctgggtgatcagtgcagagatatgtgagaattcccgtgtaggcagagctagacaagtgttacatcacctaggttatcagtgcaggtataagtcataaagcctcctgtaggcagagcgtagacaaggcttccctccccagggtgatcagtgcagagacgtgtcacaaagcccctgtaggcagaggctacacaagagattcttcacatgggtgatcaggtcagagatgtgtcacaatgtccatgtaggcagatctaggacaagagtccatcacctgggttatcagtgcagagatatgtaccaatgacccctgtaggcagtgcccagaaaagagttgcatcacctcagagatcagtgcatagatatgtcacaaagccttctgtaggcaaagcccatacaaggcttacatcacctaggtgatcagtgcagtgatatgtcacaaaaatccctgtagacagagcctagaaaagagttacatcacctgggtgatcaggacagatatttgacacaatgcccccatagacagagcctagacaagacttccatcatctaggtgatcagtgcagagatatgtcaaaaatctccctctagggcagagtatcgagaagggtcccatcacctgggttatcagtggagagatatttcacaatgccccctgtaggcagagagaggacaagagttacataacctaggtgatctatgcgagtct

SEQ ID NO: 500934 - DNA, 394 bp, Homo sapiens
  misc_feature (112)..(112): n is a, c, g, or t
cgttaaattggtgtaaactctgaatttacattaaatctgtgaggtcaatttcctcatctgcgtgttacagatgaaattatccgtatactacctttcaggagtaagttgccanaatagtcttaaggttttattcattccaggtcttaacaggctgtgctaacgaatagctgctggtgcttgatacatgtttgaatgactgactagagtgcacaggatttaaacaacaagtgtttgacgagggtaaacgcgcagagtagttgggggtggccctattttaccctctccttgtcaggctgcggggtgtcaaggacggggttgaggggacggagaagccaattgcacccctggtccaaacaaaatagtccagcagcagggtaccgaggctcgagattcg

SEQ ID NO: 500935 - DNA, 182 bp, Homo sapiens
cgggggggggggggccccccctttggggagggggtttttttttttccgccccccgggtttttggggttgtgtttggaactggttccccaagggggttttccccccttccccggcccccccccggttttttttttaggggggggtttttttttttttttaaaaaagggggggggggttttgga

SEQ ID NO: 500936 - DNA, 565 bp, Homo sapiens
aggactatgaaggaactttgaccccattctgtcccctccagtaaccataaagcaaacagtaaacacagatactggtagtacaaggatcctgatttacaaagctactgtgaaacagctccaaaggcaaagaagaagcctttgtcagggaactactccaaaagggccttcaccttttttccctatactctcataccgcttgtagatcagctcccggcgtaagtagctgtcaatctcctaaagcagtgatacgctcctgaagtggtagcgtggcatttataaaattgggaacctgtaaaaaagttcaacccattccatggatggcacttgtcttccaccttatccactgccccagtctgtttcttcagcctctcaaactccttggcaaagaacaggtctaagaaaggcactccaagggacttaatgttcacttcaatcagggagctgaccatgagcatcaaccagaaaggcctcttgcgctccaggttccgacaatattctgaagagccaaagctttctattgaaacatgattgtgttacgactcaattttaatatggtttgtattac

SEQ ID NO: 500937 - DNA, 298 bp, Homo sapiens
cacaccacctgagtctgtgctggcctctctctgctgacgacactggtgacgcacataggaagtctgtggtgtgtgatgacttgcgtgcagtcctaagcgtcagttggaaaattctgaacacatgatgggtgatcttcagcccagaaggtgtgcgggcttgtgagcactaattatgccttgtccatgtctgacagctaccacaatgtctccccttgctagggcagctgcgaggagacgtgtccagtgatgactggcagaatctggacaaacggacatcactgcaagggtctgtccacct

SEQ ID NO: 500938 - DNA, 189 bp, Homo sapiens
gttctagaggagccctcacgccgtgtcagaacaagcaacacacacggcgtggacatacgcacctcccctgccatacgaacctccccgcgtgaggcttcgcggcgtgcctcactcccacccccggcgggccaaggcctcacgagcaggagcatggtggaccagtccaggccatgttaatgccccgcagca

SEQ ID NO: 500939 - DNA, 1291 bp, Homo sapiens
gatggagggtgtagaacgagaagaagagggaggttccggcggtgccacgagaaccctctagagaagaatagcgaaggaatcgcgcagagctgcaaggatcagcgcgcctgagagaagaagtttgctcgcgaaagagatgcgtatcgtaaaggcaaaggcaggaagcttatcgtatgaaagaagcatcagcgactatggaccaagggaatatgaggcggatgtacagaacttgaaattcgtaatggcagaggatggtcaagagaagcatggataacattctatgtagcgcgtcgcaagaatcccaaagttgggcgtttgtcactcaggaattcagatggtatcacatcggatgtgagccgccaacatggtgtccgaagaggtgtcgcacgcttgcttcgacctatcgtcaagatcttcaatgagaaccttggtgaagctcaataaggcttcgaatttagacaatgcatggagggatgtgtcagagcccatcatgatcagcaatggcgggtgaccccgaatctggaagtcgagtgaaaatggaaagctcaatcattaccacagccgtgggtcatagtggcccagaacatctacattcagagcatacgcagaacttgactctctgacgacggatacacgctgtagcattcggcgtcgactctcctgtgggtaagactcacggccatccaatttgccatggaggcattcgcatgtccatgacgaatcctagtactggtcgggagcaaaccgacttctaagagcaggcgaccaataatggttccatgttgagacccccttttccatagatcgtcgtttgcgtcgccatcggaagggtcgtggacacttggacacgacaataaacagtaccctagcggccaatattgggtcaacgaacatgggttgggacgaacttgcctgggcggcatagccaaggggaaggtgaagcccaaggaaattcaaccgcgaggggctttagttttacgcaacgaaagtagaaaacgtaagcgggtggtccttaaccccaggggaaggatcaactcttgcgcgctaaaaggaccagggatctgggtatacacctaaatacccaggctaacccggtgcctcctcccacacacgtcgcgaccacactacttcatccgcccgcggcaccccggcggcacagactgggacgcacacaggacgacgaaacgcgtgcccccccgggcccgctgggcgtctcccccctgagacttaacggggggcggccacaagcgtcgggcgcggtgactaccacaagcgcacacgcccccgacat

SEQ ID NO: 500940 - DNA, 352 bp, Homo sapiens
gcacgctgaaaaacaaaacaacagaaagaaaagaaacaaaaagccggccaggtgcagtggctcatgcctgtaatcccagcactttgggaggtgaaggtgggcggatcacaagatcaggagttcgagaccagcctggccaacatggcgcctgtctctactatacagagccaggagaatcccttgaacccaggaggtggagcttgtattgagccgggatcgcgccactggactccagtctggtttacagagcatgtgtctgtttctatgtattatagagctaatgcgcttacctagaactgaatacattgttcatgattatgcttatgattattatgggtgttattatggtgtc

SEQ ID NO: 500941 - DNA, 560 bp, Homo sapiens
acttcttttaaatttggattgagcgggagtgaaacggccatcttctggaaaagaatctcaggcaaaagtgagcgcagctcctctggactggtggagtgggaatccaagaacgatgccctggagactttgggcttcctgaaccattaccagatgaaaaacccaaatgggccaaacccttaccctttgaagttgtgtttttcccctggtcagcccccctcctaattaggggcctaggaaaagtcccatttgagcaggaaaacatttttttttcccttaagcccttttttgtttttggtatttgcaaaagattttggattccctttttttttttttttttttttttttttaaaagcaagggttgaagagggcttccctcccccttaatggaaaccctggaaatttgcagggggagggagaggggaactgttatttcccaagattacccttcccttttaaaaaattattggacatgggatttttttttttcctgttcaaacatttgtgctgcccatgtacttttggcccatttcaataaaattgtttggaaaataaacccagca

SEQ ID NO: 500942 - DNA, 1291 bp, Homo sapiens
  misc_feature (380)..(380): n is a, c, g, or t
  misc_feature (382)..(382): n is a, c, g, or t
ggcttgtaacgcgccatatcccatgtgtcccaagcagaactcggcagccggacgtgcttgtccgagcgggacgagcaatggttccggacctgacatgagtcgcttcttgcgtgactgtcaaccaaaagcttcttgcgtaggtgtcttaatcagcgaggaatgaatagacgcgtgtgtcccacgatcggaagtgcacgccattgaatacaacgcggttaggacgcaagaggcaagaagaaggtcggataggaatgattctagccccgcatgtggagcccaaggcatcgtgacactgtctacttagacgcttcctgaagcgtaggcgagtgggacgtaagaatccagcagacgacgcctaggctctggatatcctagccacntnttcctccgattaattcagacaagggattagccttgaggctgccgaagataggagggacaaggcctagctagtccaaacctgagaagatagggctgggtcgggttagcacccttgcgaagttgaagagcccggaagcaaggagcatggacaaggcaaagccatgttaaccacttagcaaatgtggaaggtcttgcccgtgggtcgggtagcctaatggctaggtaccttgaaaagcccctaactaagaagattcgttgcctaccgcggatggaaattattctcaaagggaccgaagagaaaaggaattccaactaaccataaggaacacgtactcccgaagggctttctttggcggacgtccacttgaaacctaggcatctttccctttgaatagtgggttaccacaggaagggagttgggggttgggcgttgctgtaaatgggctttacctccacaatcacgtttcggaattgttttcgcccagttccttttccaccttgaagaaggaatggtttccattttgggacacccgcaaaaatactaaagaaggccgccggtttgaaagcagccggggaacgccgttttccggagtccgacattgtggctgtgcacaatggaagttgaacacttctgtttggtgccctatttccgaaggaggaatgcccagcgaaaacgcggctgggattaaccttgggcaatcacaagggccaaccaacgggccgaagtgaggccgattttgaagtcacaatgcgagcctgcctgcctgaaagagcctgtttcctttgcgggaagccaacggtgaaagtcctttggtgacgggcctttggggaaacgggaagcccagaggcacgcggggaacgggccttttaggcagcaccttgctcagagctgtgagataggaattcccaa

SEQ ID NO: 500943 - DNA, 2473 bp, Homo sapiens
atggcagactccagaggatcctcctcctaccccacggcactataaaaatgatcctggagaataatttggctagactttgcaagaatgacaaaaatgattataagaatcagttgtctcactttggggaatacattctgggaaaataatgtaagagaaaaaatatttgcatacagacatttgaggctgctctgtatattacaggcaagaactggaaactgttcggctgcagggtgacagctaactagattgtggtttattaggggaatgagcctttctttgtgtatgacaactatgaaaactattgagaagaaatagttacgtgatacagtcataatcctcaaaaacggagaatcaggaattatgatcaaatagtgatagtaacaaggaaaacatctgtctaaataattactgagtagaaataggttcggaatttgtaaatagtcattaatttgggagattggggtttttttgttttgttttttgtttgtttttcattattttgtgctattattcatacgtgtacatttctacttcagtttttattatccattacataacatacatgcttgattatttgcttcaaggaaatacacctttataagtaatactcaataactactgggtttgagaatgaaggtgtcagaacgaatgagattgtcctatgaaagaagaggcaggagccagggaggaggatcccacccggccggggctcagccaggaggcagggccattggggcagggtggcagtccaaggaaccgctctgggaaggtttgcaaaggtcggggtcccccctgccaggtgatcgaattatcgtggagtgtctggaaggcgggggaagttttgttgagttcaccaaataactcagaccaactggaaaccaagtggagtttctacaggaccaactagaatagggatcagctacatgggggcggggggaggggggcagggaacggtgtctgtcttcattgcagctctgtctgcagagccagcactgtgatacctcatagtaggtgctcagtgaatgtctgtgaagtgaattactatctagacaaggatgagactggtatgactctccaaagctttcccacctccaaaacctcggcttgtggggaatctccagtagggggcactgtggacacggttcgcatctgcctcccaaggctgggctccgcgtcaaaaaaaaaaaaaaaaaatgagactgagccaggtgcagtggtcactcctgttatctcagcactttgcgtggccaaggcgggaggatgtcttgaggccaggagttcaagactaggctgggcaacatagcaagaccccatctctacaaaaaaatttttaaattagccagaggtggtggcatgcacccgtagtcccagctgctcgggaggctgaggcagaagattgctcgagcccaggagttcaaggctgcagtgagctctgattgtgccactgcactccagcctgagtgacagagcaaaacctggtttcctaagggggggataaaagagggagagatgagatcggggtgtcccgcttctgtgcatgtggagggggtaactgggaaccgtgtactgtaggggatcgcacaccttggggtggaaacagcagctctccggagttgcatgggagccatgggcagtggtcctggctggtgaaatgattctagccacgtggcccacccagggggcaaaacaatagaaaccttcagaaatgaaacgtcacctggctgcaagaagatagtcccacaggcgccctagagatggggatgccaagtggcttctcgggaagctgtaagaatccacagggcattgtaagatggagggaaatattaagttttcttcgtaaagaggtgaggggggcgagagcagcaaaggacactggaaaatgagaagcatggatgggaagtgttgcattgagcataatttggaggtaaaatctccaacaccgtaactgagtggcctggggacctgatagaaagccttgctcaggactaaggcagagttcccagttatatcgcagatacaaagagaccaggaacacgcttgtaatcacagcacttagggaggctgaggcgggtggatgacctgaggtcaggagttcgagaccagcctagccaacatggtgaaacccccatctctactaaaaatacaaaaattagccaggcgtggtggcacatgcctgtaatcccagctactcaggaggctgaggtgggagaatcgcttgagcccgggaggcaggggttgcagcgagctgagatcgtaccactgcactccagcctgggcaacagagtgagaccctgtctcaaaaagaaaaaaaaaaaagagagaaatcaggaacatcatgaaagatacagcaaaatgttttaccccagcccactgcaccacacctgggattgtgacaattaacttgataaattgatgtaaacttgattattttattgctaatttaaaaataaaaatgactttgtattgattgtga

SEQ ID NO: 500944 - DNA, 361 bp, Homo sapiens
  misc_feature (357)..(357): n is a, c, g, or t
aatgtcataaaatgagtcttaagtaaaaaattgttacaagagacaaacaaggacattacatgttgataaatgtgttaatttgtcaagaagattggcccaggtggtgctcatgcctgtcatcccagcactttgggaggccaagatgagtggatcacctgaggtcaggagtttgagaccagcctggccaacatggcgaaaccctgtctctactaaaaatacaagaaattagccaggtgtggttgcaggtacctgtaatcccagctactggggaggctgaggcagaagagttgtgtgagccttgtggtcagaggctgcagtgagatgagattgtgccattgtactccaccctgggcaacnagag

SEQ ID NO: 500945 - DNA, 713 bp, Homo sapiens
cagacagaaggtataatttttttgacacccttgcccaccctgcggcctatgctaggcttgtcctgagaacatccctcgtagcttgatattcacatgacctacacggatgtcccactctgcagggctgaatcaattggggaacacccgaggctacaccgtagctcttcctgctactcggttaatgagcttggccggttctttgtctccgctgaattcttatcatggaaccaccagccagccaccgctaggaaatcttcaagtgtagtgtctgtgctaaccccagtggtaaatccccttagatcccctgctggtctctggccagtctcccttgattttgggtacccatgtatattttccgctttgactttaacgctttctaggatagggtaagcacccctaattcaggcactgtcccattagcttcctttgccaaggctacttatggcccggtcaccaatccaagccactctagacagagcccaggccaatatcctcttgcccctggctatgatgtccagaccagtggatgggctcccagccaaccagagaccaaaataactaaaggcctttgctctcctctgacattgaggcctggggcttaccgtttggaataccacaagtgaaggtttttgttgttgtttgtattttttagatgtaaacttgattattttattgctaatttaaaaataaaaatgactttgtattgattgtga

SEQ ID NO: 500946 - DNA, 927 bp, Homo sapiens
gaggcattgaggcagccagacgtgagggggcttcgggtgagggggcaggcggaggtggaggaacaccgcagagtaagtgtgtgctctcttggagaggatacgacgataattagcaatttatttaagaaattatagtcaaataggtactaaggaatatggctatagcgtgaagtgttgtaagggtaattttacactacgctaaagactttgacaggaagaaaactttggtgacacgatcgttacaacgacgtacgcatgagaggagggacactgagactaaaggggttttctaaaacgagtgacgggggggttggagactgacacgtgtctctaacagtgggggtaaaaaacgtgttttgaacaacgaactcggttggaggagaaggggacagtagagagcctgtgaatttaagtaccagttagagagggcagatgctttgagatgaaaagtgagggtgacttaaaacaggttaaaagtaagagtgcacacagttgtagtgtgcttaaaactaatttggaagggcgagtctggttacaaaggagattaacgtgagggttggataaacgacgacctttgggaacatccaatgagcgccgggacggaaaatgcggtcaatacaaggcctaagttaccggcatttactaaaacccccagaggaacgtgcaccccatactgggcacgggcaaggaagaacactggcggaccacttacagtttggaggggcaccttgcagcacgaacgcggggagggcaacaaccacacacaaaggagaaaagtttggggcctgccgtgaagaatacaccagtgggcgccccaagagtaacagaaggtctagacggcgagggggttcaaccggaggggacataggtgttgcgcccaccggcgctgcgggtgaaacccataccctgtccctcaggcaggcagag

SEQ ID NO: 500947 - DNA, 2876 bp, Homo sapiens
atggcagactccagaggatcctcctcctaccccacggcactataaaaatgatcctggagaataatttggctagactttgcaagaatgacaaaaatgattataagaatcagttgtctcactttggggaatacattctgggaaaataatgtaagagaaaaaatatttgcatacagacatttgaggctgctctgtatattacaggcaagaactggaaactgttcggctgcagggtgacagctaactagattgtggtttattaggggaatgagcctttctttgtgtatgacaactatgaaaactattgagaagaaatagttacgtgatacagtcataatcctcaaaaacggagaatcaggaattatgatcaaatagtgatagtaacaaggaaaacatctgtctaaataattactgagtagaaataggttcggaatttgtaaatagtcattaatttgggagattggggtttttttgttttgttttttgtttgtttttcattattttgtgctattattcatacgtgtacatttctacttcagtttttattatccattacataacatacatgcttgattatttgcttcaaggaaatacacctttataagtaatactcaataactactgggtttgagaatgaaggtgtcagaacgaatgagattgtcctatgaaagaagaggcaggagccagggaggaggatcccacccggccggggctcagccaggaggcagggccattggggcagggtggcagtccaaggaaccgctctgggaaggtttgcaaaggtcggggtcccccctgccaggtgatcgaattatcgtggagtgtctggaaggcgggggaagttttgttgagttcaccaaataactcagaccaactggaaaccaagtggagtttctacaggaccaactagaatagggatcagctacatgggggcggggggaggggggcagggaacggtgtctgtcttcattgcagctctgtctgcagagccagcactgtgatacctcatagtaggtgctcagtgaatgtctgtgaagtgaattactatctagacaaggatgagactggtatgactctccaaagctttcccacctccaaaacctcggcttgtggggaatctccagtagggggcactgtggacacggttcgcatctgcctcccaaggctgggctccgcgtcaaaaaaaaaaaaaaaaaatgagactgagccaggtgcagtggtcactcctgttatctcagcactttgcgtggccaaggcgggaggatgtcttgaggccaggagttcaagactaggctgggcaacatagcaagaccccatctctacaaaaaaatttttaaattagccagaggtggtggcatgcacccgtagtcccagctgctcgggaggctgaggcagaagattgctcgagcccaggagttcaaggctgcagtgagctctgattgtgccactgcactccagcctgagtgacagagcaaaacctggtttcctaagggggggataaaagagggagagatgagatcggggtgtcccgcttctgtgcatgtggagggggtaactgggaaccgtgtactgtaggggatcgcacaccttggggtggaaacagcagctctccggagttgcatgggagccatgggcagtggtcctggctggtgaaatgattctagccacgtggcccacccagggggcaaaacaatagaaaccttcagaaatgaaacgtcacctggctgcaagaagatagtcccacaggcgccctagagatggggatgccaagtggcttctcgggaagctgtaagaatccacagggcattgtaagatggagggaaatattaagttttcttcgtaaagaggtgaggggggcgagagcagcaaaggacactggaaaatgagaagcatggatgggaagtgttgcattgagcataatttggaggtaaaatctccaacaccgtaactgagtggcctggggacctgatagaaagccttgctcaggactaaggcagagttcccagttatatcgcagatacaaagtgccgagattacagcctctgcccggccgccaccccctctgggaagtgcggagcgtctctgcctggccgcccattgtctgggatgtgaggagcccctctgcccggctgcccagtctgggaagtgaggagcgcctcttcctggccgccatcccatctaggaagtgaggagtgtctctgcccggctgcccatcatctgagatgtggggagcacctcagccccgccgccccgtctgggatgtgaggagcgcctctgcccggccgcgacccagtctgggaggtgaggagcgtctctgcccagacgcccgtctgagaagtgaggagcccctccgcctggcaagcgcccgtctgagaagtgaggagccctccgcccggccagccgccccgtccgggagggagcgcgaagacgacagcaccctacccggccagacgcgccgaccgggaacgcgcaggagaccgagtcagcaccaccgcccgccaaaccggccataaccaaaaaacgccccgcaccacacccccgcccaacaaagcaaacacgaccaggagacagaaaaagaaaaaaacaatacaaacggcaacaagaacaagaacagcaaccagaacagaaaaaaacaccaaaccaaaacaaaacagaaaacgaaaaaacaacgacacactaaagcaaaccaacacacaacgcaacgccacccaccgacaacaaaaagaacaccatcgaacacaagcaacaacaacaagagcgaacagcgaagagcagaccagcaaaccaaaaaagcgacaaagagaagaacgaacaacccaaaacaaccaccaacaaaacaaaacctacacaataaaacgcagaagaagcagaagcaacaa

SEQ ID NO: 500948 - DNA, 503 bp, Homo sapiens
gacactagtgcaatgtgcatgttgttctgtcatttctccccatgtagattcctgtgaccagcatcagggtcaaggtacagccctctcccatccatcactcaaggttctcccctttataatcctgcctacccctgcccaccagcaatccctagcccgtagcaactgctgatatgttctccatgtctataattttgtcatttaaagaatattaggggccaggtgcggtggcttacacctgtaatcccagcactttgggaggccgaggtgggtggatcacctgagatcaggagttcaagaccagcctgggcaacatggtgaaaccccgtctctactggaaatgcaaaaattagctgggcatggtggcgggcgcttgtaatctcgctactcgggaggctgaggcgggagaatcgcttgagcccagcaggtggaggttgcagtgagctgagattgtgccattgcactctagcctgggtgacaggctgagactccatctcaaaaaaaaa

SEQ ID NO: 500949 - DNA, 211 bp, Homo sapiens
  misc_feature (6)..(6): n is a, c, g, or t
  misc_feature (134)..(134): n is a, c, g, or t
agaganagagagagagagagagagagagagagagagagagagagagagagagagagagagatgctttaagcaaaagatattagcagctttgactgcagcattagcaattagggaaaacaataacgttccctgcngacatgtaactttgccatcagttttgatgtggaaacactgtgatatataaatgttgttgggaccacattagttttta

SEQ ID NO: 500950 - DNA, 400 bp, Homo sapiens
  misc_feature (23)..(23): n is a, c, g, or t
  misc_feature (213)..(213): n is a, c, g, or t
  misc_feature (319)..(319): n is a, c, g, or t
gacggactacaaaaggaattttntcccataggtctttcattcaaggggattattaacatatgtcaagagtctaccgtgtgctggacactggcagatatttatgtgtctttttaacttataccagccctgtaagtgggctcatacccatatcctcccttaccccttaatggacaaagaaaataaagattctgattaaggaacttgctcaacatngtgcagctagtaaaaatcagaactaagattttaacccaagtcttcagagctccaaagtcaatactctaatggagcaacaggacttaagcaaattacatattaacanaagcttaacaatgaattttgtaaaatgaaatatcagtgtgtttcctttatccttttgcactccaaacatgattccttaaga

SEQ ID NO: 500951 - DNA, 842 bp, Homo sapiens
  misc_feature (19)..(19): n is a, c, g, or t
  misc_feature (54)..(54): n is a, c, g, or t
  misc_feature (350)..(350): n is a, c, g, or t
  misc_feature (756)..(756): n is a, c, g, or t
  misc_feature (770)..(770): n is a, c, g, or t
  misc_feature (773)..(774): n is a, c, g, or t
  misc_feature (780)..(780): n is a, c, g, or t
  misc_feature (789)..(789): n is a, c, g, or t
gacttgttttgcacatgtntcctctagttctttgttcatagcccagtagacctngttacttctgaggtaagttaagtaagtgattcggtatccccccatcttgcttccctaatctatggtcgggagacagcatcagggttaagaagactttttttttttttttttaaaactaggaaaaccaaatctggaagccaaaatgtaggcttagttggtggtgtggtctcttgagtttggtcgctcatgtgtgcaacagggttatggactatctgtctgggtggccccgtttctgggtggctctgtgggcaggctggccagctccaggcgtgccggtggggccgccgccttctttncaagcagctcggtgccgtggtgttccagtgcgcctcaggggccagtgctgaggccttgggccgtgtgccacgttgggaaaacgcccggtgttgaacaagtgaagtgctgggactcagccttcagaacagagaggactgtagggagggcggcaggggcctggagatcctccgtggagaccagcgcccgtcctgtgcctgtgtggcgccgtctccaggggctgctttcctccgggaaattgtgacgagggggtgtctggggcaagagcttggctctgagcgcctccatccaaggccaggttcctccgtatagctcctgtgtggcccacaccctggggcccgtgggctggaatcaggaatatttcccaaagagtgatagtcttaggcttggggcaaaactctacttatncagtgggtttcccngtnnacgtanatttcccanatgtaataacttacctccagggaccaactccatccccaacaacacacaacctg

SEQ ID NO: 500952 - DNA, 113 bp, Homo sapiens
  misc_feature (100)..(100): n is a, c, g, or t
tcgagcccagcaggtcttgagcatggcatctggcgacatgcgcacctcgcagtgggggcgcttgaacttgcccgcagatcaaatagcttctggttcatgnctccagctccttg

SEQ ID NO: 500953 - DNA, 618 bp, Homo sapiens
ggtattatgtccaaagtggtactgcctatgatgtcataagggtgtctagagtcatgggtttcacatctaagtgtttaagcatctagagttgatttctgcatatggtgtagcaaggggtctagcttcaatcttccacattacttatttttgtcagctttgtccaagatcagatggtcttaggtgtgtggccttatttctcggttctctcttctgttccattgatctatgctcctgtttatgtgaattccagaggaaaaaacaacccattatgaagtgggcaaagtatatgagcagacccttttcaaaagaagacatacatgcagccatcaatcatatgaacaaaagttcaacaacataactgatgattagagaagtgctagccaaaaccacaatgaaataccatctcacaccagtcagaatggctattattaaaaaagtcaaataatagcagatgctggtgaggttgtggataaaaaggaatgcttaaacattgttggttggagtaaattagttcaaccactgtagaaattggtgtggtgattcctaaaagacctaaaagcagaaatacaatttgacccagtaatcccataactgagtatatcccccaaggaatataaa

SEQ ID NO: 500954 - DNA, 523 bp, Homo sapiens
ggctgcctggcaagagtgcagaagctctgtaccccagagaatatcaactgcagagacacccagggcagaaattcaacccctctgcacctggcagcaggctataataacctggaagtagctgaatatcttctagagcatggagctgatgttaatgcccaggacaagggtggtttaattcctcttcataatgcggcatcttatgggtagtaaaagttggattccaagacctcctttccagcttgttgtaatgattaaatgagaccatgcatgtggaaattgcattaactaatgtaaggcattataaaaatgcaagcatgttgacatagcggctttattgataaaatacaacacgtgtgtaaatgcaacagataagtgggcgtttactcccctccatgaagcagcccagaaaggaaggacgcagctgtgcgccctcctcctagcgcatggtgcagaccccaccatgaagaaccaggaaggccagacgcctctggatctggcaacagctgacgatatcagagctttg

SEQ ID NO: 500955 - DNA, 616 bp, Homo sapiens
gagtttggacgcgtgtactatgttacagtgcgccggccttgtgattggccccgagtcacctttgcaaacacagggtgaagtgcttgataactcacccagtgggtgtcccccgttatatcccacctttgtggagaagtggccctcggggataacccccatgagaaaagtagtagggttcccccgcacgtgtttaaaacaccgagtgacactaatattggttcatttaattctgtgttctttggtagttattatttgtgggttcatgctgtcgggcgtacgatgttaacatttttttttaacaacaaaccaccttgggccggaggaactccggcggcgggtttggggcaaaaatatattgagcactttgggaaaatccagcaaagattgtctggcagtgtctccgggcagtctttgttccggctaggggtggcacatttcgctcatcatgttcgcactggagggcgtctattctcgctcgagtgcgctgttagcactgacggtagtgacaccaaccactaccgcgtgtgagaagccatcgacccagtagactctctatacgactcacaataggcgcgctttctccaaccgaccgacgagcgcagcgaaaacaaagaag

SEQ ID NO: 500956 - DNA, 997 bp, Homo sapiens
gagggcgctgcccgggtggccgcggcgctggacgacggctcggccctgggcgttcgagcggatgctggcggcgcagggcggtgatcccggggtctggcccggagcccgtgtggcttcggggaatgtgtcccgcagaacgcggggaaggttgttggctttcgcggcccgggggaggccagggaaggagctggttgggcggcccggagatgggccaaccggggggagctggggtccgagggggcggctggccggtttggggtctggggtggtgtgcacggaggcttcggggggccggggggggccaaccccggcgctgggaggcgacggccgggcgcccggcgggggcggggtgtgggcgcagccaagaaggttgggctgggggttcaggactggtgggctctccacaagaggtgcttgagcggctggggggggacccccctcgtgggtcttcccgggcggttgggccacggggggagaggggcccccgggcgcatcaaggggggagccccggaggaaagaggacagggccccttggcaaaggagaggggggggaccgggaactctcctcagggggaagcggggggcgcgccatttgccggcgcgggccgccacttttcgtcctttgcggggaagaagggtctccgggtatcgttaggcgggcgggaagaaaataaagaagggttcctggggggcggaggaaaaacaaaaagacgtttgacgcacacgacatcagcacgacgcatcgagagacaaaccaaaagagatctgtgtgtgcgtgggggcgcgcaactggtgccccgacagagagaaaagaagtttttttttgaaaaaacacatcttcggcgggggggggcgcaggacggcgcaccccccatgagagtgttgatgacaagtcgacggtggtgccacacgaggcggggcgcccccgaagagaacaaacacccggtggacaacggacgacggggggtgggggtttttctctcccaacaatttacgc

SEQ ID NO: 500957 - DNA, 169 bp, Homo sapiens
caagtggtctttgtatggcaagctggcttcaaataaaggagatctgggacacttaactaggcttttaaagttcagacagtgcacagttctcatttggatggtaggctgcgatgatcgtgtggtgcggtaattccgacctgagtcgtacggtcggctaaccatacaacca

SEQ ID NO: 500958 - DNA, 766 bp, Homo sapiens
  misc_feature (17)..(17): n is a, c, g, or t
  misc_feature (78)..(78): n is a, c, g, or t
  misc_feature (94)..(94): n is a, c, g, or t
  misc_feature (97)..(97): n is a, c, g, or t
  misc_feature (102)..(102): n is a, c, g, or t
  misc_feature (169)..(169): n is a, c, g, or t
  misc_feature (205)..(205): n is a, c, g, or t
  misc_feature (209)..(209): n is a, c, g, or t
  misc_feature (211)..(211): n is a, c, g, or t
  misc_feature (221)..(221): n is a, c, g, or t
  misc_feature (226)..(226): n is a, c, g, or t
  misc_feature (228)..(228): n is a, c, g, or t
  misc_feature (254)..(254): n is a, c, g, or t
  misc_feature (270)..(270): n is a, c, g, or t
  misc_feature (284)..(284): n is a, c, g, or t
  misc_feature (299)..(299): n is a, c, g, or t
  misc_feature (333)..(333): n is a, c, g, or t
  misc_feature (339)..(339): n is a, c, g, or t
  misc_feature (349)..(349): n is a, c, g, or t
  misc_feature (366)..(366): n is a, c, g, or t
  misc_feature (488)..(488): n is a, c, g, or t
  misc_feature (491)..(491): n is a, c, g, or t
  misc_feature (511)..(512): n is a, c, g, or t
  misc_feature (515)..(515): n is a, c, g, or t
  misc_feature (518)..(519): n is a, c, g, or t
  misc_feature (528)..(528): n is a, c, g, or t
  misc_feature (539)..(539): n is a, c, g, or t
  misc_feature (542)..(542): n is a, c, g, or t
  misc_feature (547)..(547): n is a, c, g, or t
  misc_feature (642)..(642): n is a, c, g, or t
  misc_feature (653)..(653): n is a, c, g, or t
  misc_feature (718)..(718): n is a, c, g, or t
  misc_feature (742)..(742): n is a, c, g, or t
acaagattttgccaggntataaaaatgagcgcgctttctatgagaatccacttaatagtttccgagtcgaatggcagnccgcgcgtagacacanctnaaggnggatggctgtttctcccagtagctggacgcgggttgctgaaaaggctgcgagcacgccggacataancaagcctttattggtgcttgtgtcccaggtggcgcngacngngcactgtcgngtccngnatacagaagaatatctgttgtaatgnaggtagacaacctggntgtacttatgcgcngccagcccaccaggnactctggtaagcttgtagttgtccaagtcaagcnccctcngatggggcgngtgggccagagagccgntgtcgacagcggatatgctgttgagaactcaatgcccagcttagcgcgggttattcagtcctttcaggcgtagcgtgcggcgaactctgctgattttgttgccatcaagatgtaattccgtnagngaaggaggaagatcttgagnnatnctnnttatattgntatcagcaatncgnatgtnggagagcttcttcattccctggaaagccccattttcaattcctgagctcttcagcggattggtgcccagtgctatgacaatcatctggttcagtncattgaaagtnactcttcgcactttggtgatctcattctcatgggcacgcagctcctgaagagttttgggcatttnttctggcaatccccttcagctgantcttggacagataaagtcgttcca

SEQ ID NO: 500959 - DNA, 160 bp, Homo sapiens
gagtgagccagatacaaaatacattaacagtctcatagatttgtagtggcataattataattcagcgttatttaatgcacataaagaccaaaacaaaacgaaaaaaacacccaaacactccaatcacaagacaagcacggcttttaaccccggatcaaaa

SEQ ID NO: 500960 - DNA, 663 bp, Homo sapiens
atgaaatgctggcaaggaggcagcgacttcagatgacactcgtgagcgctccgggaactggacagcccggcggcttcccgaagccggggcgcagtgcccggggcgagggggagaaagggagagagggagggggagggcgggcgaagcgggagagccagagactcctcgtgctgctgagctgcggctggcggcccgggcagacccacgcccctgcactcgcagcatgcggccgacgcaatgaagcacatcccggtcctcgaggaacgggccgtggaagacctgtgtgcgtgaaggagctgaacggccttaagacagctcaatgcggaaaagtgcaaggatgccggctgcggctgctgcagaaacgggctagtaaacaattttcctgaacatggacgtatggaaagccgcccgaggcccggagaccgtaggcaaacaaagggacttgcagggacaaggaacacatcgggcctgacaggaacgggttcccgggtaacccggattgcagagaatgccaaggtaccccagatggacggaccgaaccggggtcccaccacaaaagaagggggggcaaggaaaaaaagtaacgggtggaagcgacgagggagacaactagaggagaacccgaaggataacagaaacgcgcgggaaaacgaccagatatac

SEQ ID NO: 500961 - DNA, 232 bp, Homo sapiens
gtagaggatcccctgttatgactcactctcaagtcatcacgactcctaggagcacggggcagttgccagcacagtcagcagtcgcaagtcagatatactaaaagtatccatctgggcggtgtagtgatcaagatttgctttaaagttaaattaccactcccctctctaaactagaacttctctcaggagagaagaggggggggtgggataccggagctcgaaattcgatagg

SEQ ID NO: 500962 - DNA, 431 bp, Homo sapiens
ggaaaaagccccgggggcccccccgttttaaaaaacggcccaaaaaaatttttaaaaaaaacgccccctctttgggggcgttttaaaaaaaaagaaggaagaagggttttttgtgggccccctccggggggtctggggtttttttaaacttttttccccgggggtttttaaaaagggtttaaaaattaccccccagactttcccagaaaaaaacaggggttttttttttttgaaaaaaaaaaaatttgggagggggggggctttctcttgtgcgccccatggggggggaaaggggggtctaatataaaacccccccaaggggggtttttccccccgtttttccccgggggggttttaaacaaaccttttacaggccccccccctttggggaaaaaagtgttttctaaaaaaactggggggtttttctttta

SEQ ID NO: 500963 - DNA, 163 bp, Homo sapiens
tctgcatcgctaatcctttgatgaagcttggactgaggagcaagcgagcaagcagcagttcgtggtgaagagtggacaagagtccaggagcccgtgcgatttggtgaaggaaagctccgaagaaggaaggagcgctaacgatttggtggtgaagctaggatcc

SEQ ID NO: 500964 - DNA, 294 bp, Homo sapiens
  misc_feature (40)..(40): n is a, c, g, or t
  misc_feature (87)..(87): n is a, c, g, or t
  misc_feature (96)..(96): n is a, c, g, or t
  misc_feature (138)..(138): n is a, c, g, or t
  misc_feature (257)..(257): n is a, c, g, or t
  misc_feature (271)..(271): n is a, c, g, or t
  misc_feature (286)..(286): n is a, c, g, or t
ttaggctggggacgatggttcacgcctgtattccccagcnctttgagaggcttcagtggatggatcccttgaggtcaggagttcaanaccaccttnaccaacatggtgaaaccctgtctctactgaaaatagaaaaantagccaggtgtggtgcaggcgcctgtaatcccagctactcgggagactgaggcaagagaatcgcttgaaaccaagaggcagaggttgcagtgagctgagaacgtgtcactgcatatcancctgggcaacagangttaagtccgtcccnaaaaaaaa

SEQ ID NO: 500965 - DNA, 356 bp, Homo sapiens
ccatgtctatagatagtttaaattctttgggaataatcccaaactgttttccatagtggctgaactattttacattcccaccagcagtgtataagtattcccttttctctgcaacctcaccagcaactgttattttttgactttttaatgatagccattctgcctggtatgagacagtatctcattgtggttttgatgtgcatctctcaaaagattactgatgttgagcattttttctcatatactcgatggccacatgtatgtattcttttgagaagtgtcttttcatgttctttgctcattgtttaatggggttggtcggttgttttttgcttgactgatctataggagtggtg

SEQ ID NO: 500966 - DNA, 343 bp, Homo sapiens
  misc_feature (17)..(17): n is a, c, g, or t
  misc_feature (52)..(52): n is a, c, g, or t
  misc_feature (70)..(70): n is a, c, g, or t
  misc_feature (230)..(230): n is a, c, g, or t
  misc_feature (249)..(249): n is a, c, g, or t
tttgccaagagcatcanccttttgggtggctttgtcctttatggtgaagtgnccaatggctttgtcatgntgaaaggctgtgtggtgggaaccaagaagcgggtgctccccctccgcaagtccttggtggtgctgacgaagcggcgggctctggagaagattggccttaagttcattgaccccacctccaagtttggccatgggcgcttccatctcatggagtatacctntgcatttctccgcccttgnccaccccaccccctcccccaccaagggcgcaagagtagcggtccaagcctgcaactcatctttcattaaaggcttttttttcaccagcaaaaaa

SEQ ID NO: 500967 - DNA, 887 bp, Homo sapiens
  misc_feature (19)..(19): n is a, c, g, or t
  misc_feature (22)..(22): n is a, c, g, or t
  misc_feature (43)..(43): n is a, c, g, or t
  misc_feature (47)..(47): n is a, c, g, or t
  misc_feature (57)..(57): n is a, c, g, or t
  misc_feature (59)..(59): n is a, c, g, or t
  misc_feature (76)..(76): n is a, c, g, or t
  misc_feature (94)..(94): n is a, c, g, or t
  misc_feature (97)..(97): n is a, c, g, or t
  misc_feature (100)..(100): n is a, c, g, or t
  misc_feature (109)..(109): n is a, c, g, or t
  misc_feature (167)..(168): n is a, c, g, or t
  misc_feature (171)..(171): n is a, c, g, or t
  misc_feature (179)..(179): n is a, c, g, or t
  misc_feature (186)..(186): n is a, c, g, or t
  misc_feature (198)..(198): n is a, c, g, or t
  misc_feature (202)..(202): n is a, c, g, or t
  misc_feature (212)..(212): n is a, c, g, or t
  misc_feature (223)..(223): n is a, c, g, or t
  misc_feature (228)..(228): n is a, c, g, or t
  misc_feature (234)..(234): n is a, c, g, or t
  misc_feature (236)..(236): n is a, c, g, or t
  misc_feature (240)..(240): n is a, c, g, or t
  misc_feature (242)..(242): n is a, c, g, or t
  misc_feature (244)..(244): n is a, c, g, or t
  misc_feature (248)..(248): n is a, c, g, or t
  misc_feature (250)..(250): n is a, c, g, or t
  misc_feature (253)..(253): n is a, c, g, or t
  misc_feature (263)..(263): n is a, c, g, or t
  misc_feature (269)..(269): n is a, c, g, or t
  misc_feature (290)..(290): n is a, c, g, or t
  misc_feature (293)..(294): n is a, c, g, or t
  misc_feature (317)..(317): n is a, c, g, or t
  misc_feature (327)..(327): n is a, c, g, or t
  misc_feature (335)..(335): n is a, c, g, or t
  misc_feature (340)..(340): n is a, c, g, or t
  misc_feature (350)..(350): n is a, c, g, or t
  misc_feature (352)..(352): n is a, c, g, or t
  misc_feature (380)..(380): n is a, c, g, or t
  misc_feature (401)..(401): n is a, c, g, or t
  misc_feature (446)..(446): n is a, c, g, or t
  misc_feature (448)..(448): n is a, c, g, or t
  misc_feature (481)..(481): n is a, c, g, or t
  misc_feature (486)..(486): n is a, c, g, or t
  misc_feature (505)..(507): n is a, c, g, or t
  misc_feature (526)..(526): n is a, c, g, or t
  misc_feature (570)..(570): n is a, c, g, or t
  misc_feature (679)..(679): n is a, c, g, or t
  misc_feature (775)..(775): n is a, c, g, or t
  misc_feature (813)..(813): n is a, c, g, or t
  misc_feature (865)..(865): n is a, c, g, or t
tgaagactccagctctgantgnatatggagaccaggaccccangggncagaccagcntngagcacctgaagcagcngcccaaccaccgggggcngancangaagggggnggggcaccccggggaccgggacaaaccagaggaggggcagacaggggggcgggacggnnggnaggggggncagggangcccagcacggnggcngggggggggnggccggccggngcggngcgcgngngggnangngcgngnggngcgcccaggngcgggngcaggcacaggcaacaggggnggnnggcgagaggggggggggcggggngggggggggngggggggnggggngaccgcgggngngggcagggagagacggaggggggaaaancaagagaaaaaacgcgcaggnagcaaggaacagaagccgggggaggggaagccaggacaggagcgncnccggggcggccacgggccggccgggcgggcacnccggncccggcgcggcccagccgnnnccgcccacccacgccgccngcggcaaaggcccggaaggccagcccttaccccaacacccactnccccacctccttaggccccagatacatacatgcccacatgcacgcttacatgtttagagccatccttgtttccaaatatgacccttcgcttgagggcaactgcataggnacatctaactctggactggcatgcacattgtcatgtgcagctttgcatatacacacatgcatacatgagcctccacacaagcacttgcacacatgnggactcctaaccatgctaacctcactggctgggaaggnggggacccatgggccagcccttgcaggaggcccttttgcaaggcttaggggngtggccagccctgaaagctact

SEQ ID NO: 500968 - DNA, 235 bp, Homo sapiens
gatgggtcgaggtctcagcttatcattccaaaagttcctagtcaagaaagcaaaaatgtattttagtacaaatcttatatctatagatattttgtatatttatggcttttattgttagttaccatcctggaaaatatgtctaattattaaatgtttgtttcccctacagcaatggtagatacaatcaaaggcataaatgattagagaaatcaaattaaatttatatcttgtgtgg

SEQ ID NO: 500969 - DNA, 851 bp, Homo sapiens
tagcataaataaaggttaatgggccagttggggtgagtgacaaactgacttggccccagttcattattccaattttccaagcccctgaggtggcaaaaaaagctaacttattaagggggggcaaggggtgaaaggtggaaaggacttgaaggcctcggagggttaacagggctaaccgggaccggaaccaatgtcccaggaataagtccaggagggaaaaggcaatcacccagggcgggaggtctgggacgattcgggatcacccctaggacggctatcggctccgtagtcgggtacaggagtctctgtccgggccctcatggtccaccacagcggggctcctccattatcccatcgggttaggagatctgggcccacagagatgctcttgaaataggattggggctggggctgtaaaaccgggcaaagaccctctggggaacaccgtggaactcaggatcatggcctctacggggctcaagaatgggggtccataggcaataatcatcaaacctatgaaagtggctctgggagcccagtctggtgctgatgggggggaacacaatcttgcatcactcctccaagacccccccaaaataagcgtgcgcggggtgacccactcgagatacttacagcgatggagtcccgaagggtttttggcccctgccagtgagtctccacaacgtggtcctgaaaacggaccggaaatcaggcagattggtcaaaggcaggcacggacccaaatcgcgtaaacagcttatgacactcgtcaaggataacaaacaccaagtatggggaagataccccacggtgtaatagaaacaacaaacccagggggtgcagagactgcc

SEQ ID NO: 500970 - DNA, 791 bp, Homo sapiens
  misc_feature (106)..(106): n is a, c, g, or t
  misc_feature (471)..(471): n is a, c, g, or t
  misc_feature (524)..(524): n is a, c, g, or t
  misc_feature (679)..(679): n is a, c, g, or t
  misc_feature (687)..(687): n is a, c, g, or t
  misc_feature (703)..(703): n is a, c, g, or t
  misc_feature (734)..(734): n is a, c, g, or t
  misc_feature (748)..(748): n is a, c, g, or t
ctgaaatctgtggatgcaaaccactagttgtcatgcccactcgtcctagcaagttacattccccgtaacaaatgctttgaaatagaggccgcgtattgtacccatnatagctacccccttcgtactctcccatcatatgagcacaagaataagaaaaagattagaaacaaagaatagaaaaactatgtcttggagtcggctcgatcggcctctcttcatagaagattgtattgaacacactattgggttggggggagcggagggatccgtaagatgtggactcaggaaagataggagtggcgagacaagagtgattcgataagagaaaagtcacgggtggcatgagtagaagggggtggcgaatgtattcctcgcgcaagattaaagagaaaaatagtgcgctggagtgcgaggcatgcggagtggtgttgttgtagagagaaaaaaaatattcacaacgtatgcgtgcgntgtctacgaggaagggtctattaaagttggggagggtatgtatattctcactnggaaggtgttgtactcaaggcgtgacatgagacgggacattgtaataattagtcttagatgagctcccggcggtagtggtgggtttaaaaccgacttgtttttatcaaagcgtggtaaattgatttgtttttaaaaaaagagcctatacaacgtnaaagcgcngtttggaattatcggntcaacagcaatttggttcatcgcgggagggnccaacattgtcttntcaaaagttaccaggactcaaaaggggcacaatcagaaaccct

SEQ ID NO: 500971 - DNA, 669 bp, Homo sapiens
  misc_feature (73)..(73): n is a, c, g, or t
  misc_feature (77)..(77): n is a, c, g, or t
  misc_feature (89)..(89): n is a, c, g, or t
  misc_feature (91)..(91): n is a, c, g, or t
  misc_feature (96)..(96): n is a, c, g, or t
  misc_feature (106)..(106): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (120)..(120): n is a, c, g, or t
  misc_feature (128)..(128): n is a, c, g, or t
  misc_feature (133)..(134): n is a, c, g, or t
  misc_feature (138)..(138): n is a, c, g, or t
  misc_feature (144)..(144): n is a, c, g, or t
  misc_feature (157)..(157): n is a, c, g, or t
  misc_feature (162)..(162): n is a, c, g, or t
  misc_feature (165)..(165): n is a, c, g, or t
  misc_feature (169)..(169): n is a, c, g, or t
  misc_feature (171)..(171): n is a, c, g, or t
  misc_feature (173)..(173): n is a, c, g, or t
  misc_feature (182)..(182): n is a, c, g, or t
  misc_feature (224)..(225): n is a, c, g, or t
  misc_feature (238)..(238): n is a, c, g, or t
  misc_feature (277)..(277): n is a, c, g, or t
  misc_feature (285)..(286): n is a, c, g, or t
  misc_feature (296)..(296): n is a, c, g, or t
  misc_feature (310)..(310): n is a, c, g, or t
  misc_feature (312)..(312): n is a, c, g, or t
  misc_feature (316)..(316): n is a, c, g, or t
  misc_feature (320)..(320): n is a, c, g, or t
  misc_feature (327)..(328): n is a, c, g, or t
  misc_feature (341)..(341): n is a, c, g, or t
  misc_feature (347)..(347): n is a, c, g, or t
  misc_feature (349)..(349): n is a, c, g, or t
  misc_feature (353)..(353): n is a, c, g, or t
  misc_feature (357)..(357): n is a, c, g, or t
  misc_feature (361)..(361): n is a, c, g, or t
  misc_feature (387)..(387): n is a, c, g, or t
  misc_feature (395)..(395): n is a, c, g, or t
  misc_feature (404)..(404): n is a, c, g, or t
  misc_feature (422)..(422): n is a, c, g, or t
  misc_feature (457)..(457): n is a, c, g, or t
  misc_feature (491)..(491): n is a, c, g, or t
  misc_feature (518)..(518): n is a, c, g, or t
gggctgggaggctagctgttgtcgtggttgctcggatgtgcacgtgtgcagtcccggaagcggcgatgggaanctgntccgcgcgcgcngngggangaggaaccgnccggnccnttnggngtccgggnccggnngggncatggnttcaatgcctgangcccngcngtcncngntgtcttctngcttcttcccttgctgctgctgctgctgctgctgctgccggnncccggagctgggnccgagccaggccggagctgaggagaacgactgggttcgnctgcccanncaaatgcgangtgtgtaaatatgntngctngtgngagctgnnagtcagcctttgnggaaancnggcnagancaanggaggtgattggcacgggctatggcntcctggancagaagtgnctctggagtcaaatacanccaagtcggacttgcggttaatcgaagtcactganaccatttgcaagaggctcctggattatagcctgnacaaggagaggaccggcagcaatcgantttgccaagggcatgtcagagacctttgagacattacacaacctggtacacaaaggggtcaggtggtgatggacatcccctatgagctgtggaacgagacttctgcagaggtggcttgactcaagaagcagtgatatgtgctggtggaaga

SEQ ID NO: 500972 - DNA, 842 bp, Homo sapiens
aaactccagtgcttaagacacgcctctggacctgaaggtcttagtaggctaggacagaaacctgtcatggagaatgatggctggccacgtgccatatgtgagaatgcttttatgtggtacatctgggaccctggaggaggtccacatgccacagaatgtggatcaaccaccctggcatcactgcccttgtgcccaggctttctgctgtacaaccccctgactgcgggtcatcaacctgaatgacaacaccttatcactgagaagtggcgccgttggccatgtgaccgagaccttgaagaccttgctggctatggtggagtgtgattaaattatggggacagcctggtgacgctaccaagtgtgtgcaagttgccatatgcaagcatgcccatccagcggccggcctgaccaaagcatcacaggcagacagaggcaagcaagaggaagcaagaagcacgcaggaggaggaagatgaggaagcaggaggcacgaagcaggaggcaggcaagaggaagcaagcagccgtcacaggagagatactaggacccagtaacactagggggatgccacgagtccccgtagcatgtacctcacacaaacataccatggtaggacgtctcaaaacactaccctgagcgataacccatccttccaagaaggaggctgcttggcgcttaaaaggcccaaaaagccacctagtgttagatcagtccagtacaaactgccacggtaagaccccgagtaaggtgggaactgacctcctacgagggtgtaaagtgatcaagagcgacacaatggggagatagcgacggggtgaggtagatcgaatcgaagatcaaccg

SEQ ID NO: 500973 - DNA, 222 bp, Homo sapiens
  misc_feature (117)..(117): n is a, c, g, or t
  misc_feature (153)..(153): n is a, c, g, or t
cgttatgctcctcactacactttggtgggtctgcttgaccccacactgtattatctaaaaagatgaaaattgcggtcatttacttcaatggataagtagctttggaactcttgaatngtgggtcaactttgcatcacgttggccccataatgnataatttagtaagttactcattgctgtaggtgtttgagaaaaatgatgaccagcaatttgaggaacact

SEQ ID NO: 500974 - DNA, 508 bp, Homo sapiens
  misc_feature (85)..(85): n is a, c, g, or t
  misc_feature (164)..(164): n is a, c, g, or t
  misc_feature (228)..(228): n is a, c, g, or t
tttggggagggggggggtcgcccccccttcccccccgggcgcggggggcccccccctttttgaaatataccaaagattttttttnagaggtttgtggtttcccccccggtgggtttacaaagggggtggggttcccgcgctttataaaaatccccccaaaaacnctttggggggtgtggggggggccccccttttggggttttgggggaccacgggggaaaaggggcncccctttttttcccttttcccttggggtttttttggccccaaaaaaatttttgccttttttttggggaaaaaagggggctttttttcccccccgcgcccccaccccccttgtccctgggggcccgggggggttttgttttttttggggggggggggggggccccccctccccccccccgttttttcccccccccccccggcccccgggttttttttttggggttttttcccccccgggggggggggggggggccctttttaaatttgggggcccccctta

SEQ ID NO: 500975 - DNA, 137 bp, Homo sapiens
  misc_feature (132)..(132): n is a, c, g, or t
agtgagaaatgggaccccactatgggtgggacacggatagagcctctgacatttggaaggggaccaagaaattaatgctgtcacccacaccggtaatattaatacttgtgaacaaacctcatagagaccccngtctc

SEQ ID NO: 500976 - DNA, 256 bp, Homo sapiens
atgtgcacaattgaccatttgccagaatccactgctttcttgattccatgattgaattaaaaaaaaaaaaaaaaaaatattaaaccacaatgcagcacccacccctttttcccccaccagggttgtatgtgtgatggggaaaaaaggatgggcagcttcaccaatggcgcaaatgcttctgctcgctctgtgccatggtgagctatggttgaatatgcatgggtgctcccctgacaagatttgctgggggtgtggt

SEQ ID NO: 500977 - DNA, 513 bp, Homo sapiens
tgggtgataggacttcaaccagatacacgagtgaagacgatgcggtcagtcagtctcaggccagcttctctgtgacccctttactcctactgggagggctctgtgggagagagatacagcggaaaggagctgttcttcaatggtccccgtcaaacatgagacggaacgagcgaaccccagagggtcatcacgcctgtatcagcttcctttcttagtcttctcagcatgatgaaaactttggcgtctggcccagtttcaggaccatcattcagcttgacagaaacacccatcttagtgctgtgcaagcgcatgggcttatcaggggacttgacggtcaccatgggacattcaggcgaggctcacgcttgctaccctgccccagacctgatttcttctacagggaggaggacaatggtgcgcgaccagggcacaggagagccagaccgggctggatgcacaggggcctcatacccacaaccatggacctccgatgcccatcaccccgagccctag

SEQ ID NO: 500978 - DNA, 166 bp, Homo sapiens
tgatggaaaagggtactaatggttgtcctccgatcaggtaagaatgaggaggtctgcggctaagaatcaataaagtgattggcttaatgggcgaaatattatacttttgttggtttggatatatggaaggatggggattattggctaggattgaggattggatagt

SEQ ID NO: 500979 - DNA, 418 bp, Homo sapiens
gctcgtctctgatggatccctttatgatgttgcccctgttgtcaccggtggggtctgcaagtgaccgagtcaatggcttcagctgccctgcccctcgggcttcagcggctccacgtgtccgctgtgacgttgacgaatgctgccagcacgccctggaggaatggcgccaaatgcgtggagcagcccgatggctacgagtgcctgctgtgccgagggcttatgagggcacgcttgtgtgatcgcaacgtggacgactgctcccctgtcccatgccaccatgtgtctctgcgtgtcatggcattgccagtttctcatgtgtcctgtgctcctggttacatgtgtacatgctgtgagagccaggtggacgaatgccgtatccagtgcctgccgtcatggcggcaaatgcctataattggac

SEQ ID NO: 500980 - DNA, 152 bp, Homo sapiens
acgaccacccttcctcgtttcatcaggctttgaagatgccatggatggcctgccttccctcaggcctgtaattgagctctgcatcccttcctcgtgggtgccaacccaggctccccctggctgccatgtagtctccctcttcactcagtaca

SEQ ID NO: 500981 - DNA, 738 bp, Homo sapiens
  misc_feature (16)..(16): n is a, c, g, or t
  misc_feature (211)..(211): n is a, c, g, or t
  misc_feature (213)..(213): n is a, c, g, or t
  misc_feature (219)..(219): n is a, c, g, or t
  misc_feature (318)..(318): n is a, c, g, or t
  misc_feature (478)..(478): n is a, c, g, or t
ctagtagccgtgttantcggcacgagggtacgtgacgcgttagctgggggctccggcgcgggggaaccctgtctggctgaaccacagaatggctggcgtgagcttggtggaggccaaaaacatggtgatgagttttcgagtctcgaccttcagatgctcctgggtttcgtgggccggagtaagagtggactgaagcacgaagcgtcgttcnanccaggnccctccagctggtgcagtttgactgtagccctgagctgttcaagaagatcaaggagctgtacgaaggaacgcccgggggcgtttaaaagcccggggggnccaagaagaactcggagcctgccccacagccgcaccggcccctggacccctgaccatgcactccacctacgaccgggccggcgctgtgcccaggactccgctggcaggccccaagttattgactaccccgtgctctacggaaagtacttaaacgtgaccnttttgggggggggggggacgggttgcccgccaagaccctcaagccagaagttcccgccttggtgaagctgccgttctttaatatgctggatgagctgctgaaagccccaaagccccggggaaatttagtcccacagaacaacgagaagcttcaggagagcccgtgcatcttcgcatttggacgccaagacaggtggagttgatccggaactccagggaactgcagtccggagttaaagccgtgcaggtcggtcctgagaa

SEQ ID NO: 500982 - DNA, 545 bp, Homo sapiens
  misc_feature (2)..(2): n is a, c, g, or t
  misc_feature (9)..(9): n is a, c, g, or t
  misc_feature (22)..(22): n is a, c, g, or t
  misc_feature (36)..(36): n is a, c, g, or t
  misc_feature (47)..(47): n is a, c, g, or t
  misc_feature (59)..(59): n is a, c, g, or t
  misc_feature (73)..(73): n is a, c, g, or t
  misc_feature (78)..(78): n is a, c, g, or t
  misc_feature (232)..(232): n is a, c, g, or t
  misc_feature (317)..(317): n is a, c, g, or t
  misc_feature (386)..(386): n is a, c, g, or t
  misc_feature (445)..(445): n is a, c, g, or t
tnctgttgnaatttaactaggnaacactcacagtgnactggtatagnacagttgaaagncattcttgaaaatncctgnctctgctgcctttaaaagttaacaatctcttttatcagatgtcaagggcaagggtaatgcagtttctgtaaatttatgaaatttctttttctatgtacatgaagtacatttagtaagtaacacccccccttcccatgcggcacatgtgcattancacacacacacacacacacacaaacacacacactgtcataaagctaatgatttgggactttaaaaaataggatgtcctccggggncaatcataaatttatgaaagaaagagtggtttacagactcccctgaaagaagcagtgtatatgtgaagncagtgcaaaaatctctttgccatgtatattatagcgtattcattggtgtgaatagtcanatgttccttctggtccaactctgtgtttgcaaatttccaagaggcattgttttcaaaagctcccttaaaatgtactggtttttgagtagaggttccgttt

SEQ ID NO: 500983 - DNA, 343 bp, Homo sapiens
ttgatctagaggatccctgaatatgctggtctcagcaatagaatagaacaagtagaggaaacaaattcagagctcgaagactaggtctttgaattaacccaatccgacaaagacaaagaaaaaaagaataagaaaacatgaacaaagcctccaagaagtctgggattatgttaaacaaccaaacctaggaataatgggggttcctaaggaggaagagaaatctaaaagtttagaaaacctgatgacaatgagcctaggcaatcatcttttggtgatgaatttcccaggtgttcttggtgcttctggtgtttggatgtctaggtctgtagcagggtcagggaag

SEQ ID NO: 500984 - DNA, 406 bp, Homo sapiens
  misc_feature (176)..(176): n is a, c, g, or t
  misc_feature (188)..(188): n is a, c, g, or t
  misc_feature (273)..(273): n is a, c, g, or t
cgcctctgcccggccgcccctactggggagaggagcccctctgcccggccagccgccccatccgggagggaggcggggagggaggcagggaggtcagccccccgcccggccagctgccccgtccgggagggggcggtggggtctgttctttgtttgttctgttgttttgtctggtntgtgtggtttgnttttgttttgtcgttttgttttgtgcttgttgtttgtttttctccgtgtccctcgctttttgctcttcctttcggttttccttcnctcgcttcttctcttttctccttgtccctcttcgctttctcttttgttgccctctccctcctttgtccggtcctctcttttccctttgttgcctctcttcttccttctcgtctttttgttccgcctggcttcg

SEQ ID NO: 500985 - DNA, 266 bp, Homo sapiens
  misc_feature (55)..(57): n is a, c, g, or t
  misc_feature (77)..(77): n is a, c, g, or t
agcacgattagcacatttaaggaattaaaaaaaaatttgtttggtcacctctgcnnnatgtacctgggtgcacgcanggctgagtccaaaaaaggaggcagcaaagggttgtgggattaccattggttcttataggttttgggataggaggcggagttaagagcaatgtttttggggcagagggtggatctcacaaagtacattcaagggtggggcgaattataaagaaacttcttaagggtgggggaaattatcaagaacattgt

SEQ ID NO: 500986 - DNA, 637 bp, Homo sapiens
  misc_feature (271)..(271): n is a, c, g, or t
tagcgaaaatgtcaagttataatctgccaaatatacaagtgggattggtggcagcatgtttggccggggtgccccacagtaaacagagggttcgtggcaaagtgactcaagtgggtatagggcgtgaaaagtgggcacgtggcccttagcccgagggtgagtttaggacaccgggcaggggaagggcgaaagaagggtgaggcccgtggaggtgtcagtctcagaacaggaacgtgcacacagagggacacaaaagccagagtgatacctnctctcgagagagacaccccgagggggtccacagaggctctcccgagaagtgaattagcccccctctctctctgtgagagagtggagcccacccgcgaggtccacacaacaagactcccggggggctgtgtgtgtgtgtgtatgccaaaacacgcgtgtgtcagggcagcgctgtggccctccgcggggggaacacagccaacccgccccctgtatcacccgatggcatatctctaatatgctctataaccccagagaacacacatgtggtataggggctctcgtttcttttttacacccccaaatctctccacagagagaaccccccccccgagaacagagggggctctctggggaaactttccaa

SEQ ID NO: 500987 - DNA, 355 bp, Homo sapiens
gatccccacgcctcggccgtaaggttcctgcgccatgagagcgaagtggcggaagaagagaatgcgcaggctgaagcgcaagagaagaaagatgaggcagaggtccaagtaaaccatcttgtgcacccacgaagcctgcgggagcagaagtaagggatgctgaagcccggaacaagtggttggactgtatgctgctgtcggtaataagtctcagtagacccggaatgtcacctcgccgagatcagctgggaaaatgactaccttcctcacaaccaaaacagtcccgctggccctctgccctggacctttggcattctggactagttctgttctcttgtggccaagtgtaactcgt

SEQ ID NO: 500988 - DNA, 131 bp, Homo sapiens
ccacaccaccagctcggtcagggaatgggaagtgccgcagaagaatgcccacctcaaggacagcgatatcaccaagcccgtagccgccattcaggccctcgcagcccttctggcggcctcagactacacaa

SEQ ID NO: 500989 - DNA, 318 bp, Homo sapiens
tacttcaacttaagctaagaacagggctataaaactgagggagaagaacagggtaagagaaatgtgaatcaggagtatttctgagatctctagactcccaaagcaagtaggtgtctagcatcttatttttccttcctcagtaaaatgaacaagaaaagatacttgtagtctcgacaagaagaggaaaagtttgagccatgagggaatcagtggttcggcgaagtggggataatttcagattcaggagggtacattcggaaatttctcaacagttttggttgtcacaactggaagtgtcactgatctataggagtggtg

SEQ ID NO: 500990 - DNA, 446 bp, Homo sapiens
tgataatgcagattgttgggaaatctataaggaagtaactgactctaggcaaattgttttcttcctcctacccgcccaaccccctacccgtccgtcaccttttaggaacacagtatgccagtgtaatgtgggaaccattgagactgtatttgccctgagtaccaaactaatttaagtgaatttttttttaaacatactggtaaatgatgtccacaaatttccttagatatattttaattaattgtcttaaaatacattgatatttattaatcattggatttggggacagatttttgactgtggcagatggtagggaacagaacagtaaacagttggatgagatcaatcagggcgaattacatttttctggttacactggtgatcatttgagaattgatttacctcagtgtttaacagtttttgttttggttttaaaatactaacta

SEQ ID NO: 500991 - DNA, 445 bp, Homo sapiens
  misc_feature (89)..(89): n is a, c, g, or t
  misc_feature (113)..(113): n is a, c, g, or t
gtaaataactggaaaacattttgggccccccccccacccttttttcggggagagaggaaaatccccaaaatatactctctttttagtgngcctcaattgggcctcacagctcncaggacaattacaaggtcacctcttttttttggctgtccccaaaattgttgtgaattcgagattaatctccccccacgctttgccaggaattttttcagacctccctagcacaagcccggttgttccttgtcaggagaatttgtagatcattttcccttcaaattcctgggggggaaacttttttcattttgccccccaacctctgtaaataaatttaccgcatttacggcggcattttgtaagtgggcatggtttcctaaaggaggagggttccttgtataataagttattcccctgagtatgcaaaaaaaatgtgggggcccctctttta

SEQ ID NO: 500992 - DNA, 192 bp, Homo sapiens
acttcacatcgttacatggttctgtgtatggccatgggtttatgtgtataaagcgaagctgtttctgtgaaactgtatattttgtaaataaatatattgctactttgaggttcatgagaaaaagcaaaaaaaaaggggccgctaagtatccctaggggccagtaggtaccattttgcagggtggccctatag

SEQ ID NO: 500993 - DNA, 722 bp, Homo sapiens
  misc_feature (304)..(304): n is a, c, g, or t
ccaaaagctcccatttggttattaaatttagaggggccaggcttttaagatgggtttcaagttctgggccattccagcaccagccctcagagaatcaagatgcctcttgaatattcatccaaaacattccaagaagccttctttgccccagcaatgttttgcaaaactcctttctttcacaaatcaacagctaaggagccaagccaccagccatttcttcattttccacttcggcaaagcagttggaatttttcaacagaggtttttcccaggcatcacgtcagtttccctgaagaccgaatcnttgatttcccaggatatactgggcaagtccgccctgttcatcagcacatccagcggttctccatgacagcatcccgtgtggctttggtaagatctgtcactacctggaaacgtctgcaaactcagctttgggaatctctgctcaagccgagctactgcccatgctgtgagagctctttctccaaattattgagactggcacacttgagtctctgttggcaggcgaagccttcccttcatcccaaagttcttcgagcttggcaacagcaggccagctttatcagcagcttgcaaccattctgtaaaagcagctttatccctttagcaaaaaaaaaggagttccggggcataaaagtaagcatgtcatctggcaaatttcatataagtattttttcaaaaaatgtctcatcaccgtcatg

SEQ ID NO: 500994 - DNA, 182 bp, Homo sapiens
  misc_feature (79)..(79): n is a, c, g, or t
  misc_feature (114)..(114): n is a, c, g, or t
  misc_feature (135)..(135): n is a, c, g, or t
tggccggtccgtgggaactatgagttctatggtgccctatgagccctgtgcagctctatgggatcttatggggtagtantgggctctgtgggatgcgctctatagggtcctatngggtgtctacggggttccaangtgaggttacggagctctgttgggcggctacggggcactctggggtg

SEQ ID NO: 500995 - DNA, 340 bp, Homo sapiens
ccccctttctttttccccccccccccggggggggttttgcccccccccggggtagaacccccctttttttttggggtggttccccctgcccccggggttttttgggttttttccttttccccccccccttccttgggggggtcccgtttcccttttccccatgctttttggggggcccccccccccgggggggggggggagggcccccggggggtttttttttggggttttccccttgggcccccctctgttggggggggtgggggggggcttgggggtcttttgtggccccccccctggtttttttggggttgttttaaataaaccttgcttctaccca

SEQ ID NO: 500996 - DNA, 695 bp, Homo sapiens
  misc_feature (689)..(689): n is a, c, g, or t
ccgatggcgcatgcctgaagtctgtaaaattgcacatattttaccaagtcgcgtgaatcaagatcgggtagtgagtccatgacgtgaagagcgcgatcatctaggagctttgtagcagatgagtcacttattactatttagcgcccatggctggcaggacagtcgtatctctatacagtgggaatctagagatgactcgagagcagacatatatccgtatcatttgattacatgatgatgataatagttattgttagaagcgtcaacgttatactacgtctatgagtaggacaagtaatgagaagagaattctgaatactttacctacagatgacaatggccaatgtgtatatagtattggacgtaaagataacaaccgatctctgagcagcgtatctgccatgaggccctatagggagtcaggccgtatctgttctgtagtgcagcgattacaactgattgatagtatagacattctttgcgcagaaagactacaaggctaccgtactgtcagctaaggacttcggctgacttagcatataagtagtgacaagattacactatgcaatgtatcttggaatcctgccattaactaatgtaccacaccctaggctagagtagcaacctctgcaacaacttggctactaaccgggccgcttccttttcaccccggtggcctaccccctttngccccc

SEQ ID NO: 500997 - DNA, 283 bp, Homo sapiens
cgcctcccgggttcaagtgattcttccgcctcaacctcccgagtagctgggattacaggagcctaccaccacgcccagttaatttttgtatttttagtagagacggggtttcaccatgttggccaggctggtctcgaactcctgacctcaggtgatctgcctgcctcggcctcccaaagtgctgggattacaggtgtgagccatggcgcatgcccaggatgcagtttctattgcaacagaagtagttgatatacagtactccagcgcgtgagagagggaagat

SEQ ID NO: 500998 - DNA, 300 bp, Homo sapiens
  misc_feature (19)..(19): n is a, c, g, or t
  misc_feature (71)..(71): n is a, c, g, or t
  misc_feature (270)..(271): n is a, c, g, or t
tagaaaaaatagttagtanactttaactgaagttatatagacatatactttcataataatatacttgaaangttgttttaaaagtatttgtaataatattctaaaattaaaggtagtatcagagatctttcaattaaatacaaagttaaatgttacaaaatcaagacttctcctaggttcattttttgattaagcaaagtaatcaatactccaccacaacaattaatgaaaggagattttgattttttttttttttttttcttttttttnntaataactgggggtacggagctcgaatcg

SEQ ID NO: 500999 - DNA, 469 bp, Homo sapiens
  misc_feature (73)..(73): n is a, c, g, or t
  misc_feature (78)..(78): n is a, c, g, or t
cccccatgaggtggttccccttaatcccttaaaatttttaattagatgtgagcaaaacagtttaaaattccangaaanccctaaatatcctttgaagggtcacctgtaccctagtctgtccctcatgcctgcctgataaaagccatatcctgagactgggcaatttacaaaaggaagaggtttaactggacctcagagttcccacgtggctggggaggccctcacaatcatggtggaaggcgaggaggagcaattcacatccttatgtggatggcaacaggcaaagagagagagcttgagcaggggacctcctctttttaaaaaattagatctcataagactcattcactactatgagaacaacgcaggaaagaccagaccccctaattcagtcatctcccaccaggctcctctcaggacatgtggaagttgtcggagttaaaattcaagatgagaaccccatctcaaa

SEQ ID NO: 501000 - DNA, 226 bp, Homo sapiens
  misc_feature (153)..(153): n is a, c, g, or t
  misc_feature (181)..(181): n is a, c, g, or t
  misc_feature (190)..(190): n is a, c, g, or t
  misc_feature (201)..(201): n is a, c, g, or t
  misc_feature (221)..(221): n is a, c, g, or t
tccggtataagctcagggtagtagctatgtgaaacggagaaatatatgaagacagtaccaaggtaggatgaataagattgactgaacaattcttcacatttccactttggattatggaaagattttggatcctattgaaggttctgggtatcntagctgtgatccaccctatgcagacagngaacaccanatggatctcantactattccagcctgttaantggct

SEQ ID NO: 501001 - DNA, 147 bp, Homo sapiens
cccccttctctcctgcctggccttctgtctgcagctcctggatcacccttgggacccaggagtccatagaatccctgctttccagggggtccctctttgccagctgcaccatccgtaccaggttcgcctggggctccggctgtctga

SEQ ID NO: 501002 - DNA, 188 bp, Homo sapiens
tttttttttctctcttgtgctgcatcagtagacagaacttcggtagttttataatgcaacatcctaacccttgtttctggaaaagaactgcatgacttaagttgagaatgtgatacgctcactactcacccccactcagactgtaatctgactcttagctgcagctcgcaggcagcaggctagcagca

SEQ ID NO: 501003 - DNA, 884 bp, Homo sapiens
ataaaatattagcaatctacccatgatcaggggcgtaaccaaaacagaatatataaggagctcatacaatcctatagaaaaaaaaaaatctaataatctgataaaacataacaaaagattggcatagacatttctcaaaagaagatatacaatgggccaacagacttctgaaagggtggctcaacatcattatcagagacttgcaattaaaatttacaatgagatatcatctcaccccagttaaaagggcttaccattttacttttacaaagacagacaattataaatggctggtgagaatgttgacaaacggggaaccctcaaatactctgggtgggactgttagtaccaacccatctatgcagaacagtttgacagtttcctcaaaaaaaactacaacacattaggctactgtaggatccagaaatcccactgtggtatataccccaaaaggaaagaaactcagcaatcaaagagggtatctgcactacatgtcgtggcagtactcttcacaagtagctaatatttgaagccaccctcagtgtcatcaaaagtgcgggattccaaaatcacttccaaacttcagcagcatttaattcccccaaacgtgagccattcgaaacgacataaaacggcatcccattggtatagcgcaacataaaattaattcctgtggagtcacagaagggacaaaacctctatatggaagacggattcagacaaggggccatatccctcgggttccgtcttcgcctaaaagaatgatccggttgtcacacgtgtggcacagcgtttgtggacaccaaggaagaacgggattccattggggtgcaacacgcggctcgacgacacgcacatggggggtgcaaaaacttatctgcgta

SEQ ID NO: 501004 - DNA, 388 bp, Homo sapiens
  misc_feature (126)..(126): n is a, c, g, or t
  misc_feature (252)..(252): n is a, c, g, or t
  misc_feature (283)..(283): n is a, c, g, or t
  misc_feature (315)..(315): n is a, c, g, or t
tgtgaatattgtgtggagttaatattatggaaggtaaggtggatattgcgagaaatgttcttttcttgtggtgtttttggagcttatggattagctttcttagggtttacgtgttgaaatcctaantttaaatatgatgataggaggagatggggcttttgggaggtgatgaggttatgagggtggaatcttcatgaatggttttaatgcctttagaaaagagaccccagagaccttgctcccgctttttantgtgggagaatgcagcaagaagtcagctgtntatgaacaaggaagcaggtcctctccaggcantgaatgtaccagtgccttgatcttggacttcccagcctccagaactatgacaataaattctgttgtttaagct

SEQ ID NO: 501005 - DNA, 268 bp, Homo sapiens
  misc_feature (21)..(21): n is a, c, g, or t
  misc_feature (77)..(77): n is a, c, g, or t
  misc_feature (79)..(79): n is a, c, g, or t
  misc_feature (116)..(116): n is a, c, g, or t
  misc_feature (151)..(151): n is a, c, g, or t
  misc_feature (174)..(174): n is a, c, g, or t
  misc_feature (176)..(176): n is a, c, g, or t
  misc_feature (187)..(187): n is a, c, g, or t
  misc_feature (208)..(208): n is a, c, g, or t
  misc_feature (236)..(236): n is a, c, g, or t
  misc_feature (253)..(253): n is a, c, g, or t
  misc_feature (258)..(258): n is a, c, g, or t
ttagtatgcatattcttaganaagtaggaggcagatgcacctataaactttattcatcttaagagccaacaaatttnanaaaaaaatatggaaaaatttaccacagctgctaaganctgttccattttaaatgcaggtaaagacaaaattnatctttcaatagcaacagccttntnaaataatttantctgcaaaaataaattttatnattgaagtaacttatcaccattgtaagnattaagaaaatgcattnaaganattctcaact

SEQ ID NO: 501006 - DNA, 269 bp, Homo sapiens
ccggggggggggggggggggggggccccgggggcccttttttttttttaccccccccttttaagggggggggtttccgggggcccccccccctccagggccccccccccccccctttttttaaaggggggcccccccttggggggtccgggggggggggccggggtttttttttccccttgccccgggggggggggggggttttggggggggtgggcccccccccctttcgggccccccccccatttacccgtttttttggggggggga

SEQ ID NO: 501007 - DNA, 273 bp, Homo sapiens
atcccctagtctaccaaagttcctagaagggtggataccttcacatagttgttggtgtttgttttgttttgtttttttctccccaaagaaggtagatgacttaaatacagtggggaaggtggaaggaactcatactgtgcattctagcttcagcagactgattgcaagactcaaatttgatgtatgtgctatgctatgatcaggtgaagaccctctcccctgactgggatgaaacctcatttagatgtcttgaattaatacattgtgtgtaaa

SEQ ID NO: 501008 - DNA, 532 bp, Homo sapiens
gagcactgaaggaggagtctcttgcgggtgctggctttcctggtcctcagcagagtctgccggcacaaagaaccgacactttccttggccccgtcctcaagcaaatgtacatcacgtatgtgaggaactgcaagttcacctcgcctggtgccctccccttcatcagtttcatgcagtggaccttgacggagctgctggccctggagccgggtgtggcctaccagcacgccttcctctacatccgccagctcgccatacacctgcgcaacgccatgaccacccgcaagaaggaaacataccagtctgtgtacaactggcagtatgtgcactgcctcttcctgtggtgccgggtcctgagcactgcgggccccagcgaagccctccagcccttggtctacccccttgcccaagtcatcattggctgtatcaagctcatccccactgcccgcttctacccgctgcgaatgcactgcatccgtgccctgacgctgctctcggggagctcgggggccttcatcccggtgctgccttc

SEQ ID NO: 501009 - DNA, 817 bp, Homo sapiens
agcggagtctccacccggactacgccatgtcggggagcgagggtcgggtggccgctgctccggcctccggggtccttgcggagactcatcccttcagcgtcgctgaccccagctcagctcttactgcgggccgctccgcacggctggtccatcctgtcaggtgactatgcggcgcaaacatctccttcagccaataagcatggcgccgactaccgggcgcatcgtgtgcgtgtccttggctgctagtggtggacgtccagtatgactgagggactaccacctaatttctaacatgccctggcagagtgcgaaggctagggagagactcacgatctggttttccggcaggtggcccacgtcattctgggctgagagtcgacaggtaagagactactttgctagtgcgcagtggatacagaatggcttggttacgcaggccagaaagtactgtgcattctggtgcatcgcaatctaaatattcctgaatggctcctgcagactttgggcagaatcatgaatgtcatgaagaacctatttgatgaactgaggtcccatcaaaaccaaacaatttgctcccattgcatagcgtgagtgctaccagagttcgatggacactgagtgtacgagcaggaaattctggtgactggtatcaagggtagtcgaatctgctagctccctatgccacagggtggcgaaaatagcgcttcaaggtggtgctgcaagttcgccaagactggtcttgctcctggagttactcaaaaattgtctccaaagccatggtggttctccgtgattgctgatgtaggcgacagaacct

SEQ ID NO: 501010 - DNA, 379 bp, Homo sapiens
ggggaaggggccctgtgaatttttctaaaggggctatttaacctgggaggagagcgtgttcggctccagcccagcccggtggtccctttccaccctttttccacctgccttggggttttcgggcctttgctttccgacctttttcctttgaaaccctcctccacagatgcagcccatcctcccgggtccctcctagtctgtcctgggtcctctgtccccgggtttcagaggcaacttcccaaagcccaaagcagtttttccccctaggggtgggaggaagcaaaagcctctgtcccttttttgtttgggtataataatttgagatgtttttaatttttttgattgctggaataaagcatgtggaaatgcccccacctta

SEQ ID NO: 501011 - DNA, 152 bp, Homo sapiens
  misc_feature (115)..(115): n is a, c, g, or t
gggcaggagttggaattagttggtccccactgtcccccatgaggttgtgaacccccccccccaacttttcatgttttttaaaggcattttggttttttaaaatctggacagcaanagcaactttttctgtcaaataaaaatgagaaatgcca

SEQ ID NO: 501012 - DNA, 530 bp, Homo sapiens
  misc_feature (36)..(36): n is a, c, g, or t
aatctatgaatctataggctcggtgtgtgtaacacnacaccccctatcgttgtccttcaaatactcagcattaccattggttgaggccaaattcagagctttctcaaatcagatttacaatctccattttcattaacggggaaacatcccgagccactgagtgctgtgctttgtcactgaaggttagatctgaacccagggtgtcaacagctgctctcaactccccacctctgggcactgaggagtatttcccctcattctacctctctaaggctatgcacccctccccacgtcttcagcttggggatggggggagtcataggaaagccccatctccatctggatagggacttcatcagccttaacctggaaatgctgctgcccaagtgactcttggttcgtctccacatacagagcagggtgaggggagggtggtctagttagagggttccagggaagtagctctcctcatgcttttgtagtgtgctaggtgcttactcacacttggccttgaggactggagggctgaa

SEQ ID NO: 501013 - DNA, 1220 bp, Homo sapiens
ggcagcaaggtggcagaggaagtataccagcaagagccagagttagtccctcttggcatatacatctactgaattgtactgatgtcttcctctaatcgcggagagtctcgggtgactaatggctagcgtcgtgagtagtttggagtgtgctgagtgcatccatccaaacctagttgaatcaggagattcgattgtaatcattggcccagcaggacacgacacgacactcgatgtgatatgtggagtcgaatgggtcccgcgtagtattccgcgagcacacgtgagcatgctatgatagatgctgaaaagaaggatttcgggattgctcagaggcgcaggtagatatatgctatcagtagacttgatgacaggggtgtggcatgaagagaggtcatcgtggtgaccgtcagcgcgcagcgtccagacgtcctactgccgttctatgaatacctcgctacgggaagggactctgttggtgcctcgcagagggaccctaggcctactgtgctaggtgacgtggcagcggtggtccaatccagtcgagtacgtaaagcttgggcgggtcccacaaccaagtgccatttgcctgacggtggtggtgatttgagttcgcttgtcgtgcgcataaaggatccactcattgcaagcgacgagatggagaaccttaaaagagttcctcatttggagggcgctctgggatatggatataggtgcgccttgacttgcgctgcccacaccccagtcgagtgagagataaccgccttgggttgaaatcgttaaccttaagctggttctagatcccacttagctgtgattcgcggcgcgatctcgttgtatttggcagtcccatggaacgagaggggcgtcttgctcgcctgggcggcaagtccaaaatggcgttgaatatggacttccaatgtcgatggcgccacgtcgcggggtacacacctcgagaaacagtagggcttgtgagacgcaattgtggagccactttatatggaataaagatcttcgccgttggctcatttgaaggcgcaaatcgaattggatagaccacgtgtgtgggtaagaggggataggtcctaaggaagggaaattgccaagaatttaacgtaggaccccgaaaacaaccaccaccgctattttacttccaattacactccaaggaaccgggggctggaggagaaatccgccgagtgtaagtcccaagtctttgccca

SEQ ID NO: 501014 - DNA, 284 bp, Homo sapiens
gtggaaatgcacagggatgcagcccacgaggggagtgggctgcttctagcaaacactacgggtatgggccctctgacccagcaggcccacttctaggaacctatcccagagagcctcgggcagacacacatgcaaggctctttgatgccgtacggctggatccatgaacgatcagaaatgacccgtatgtccaacaacagggcgccagtccaataagctaggtggcagccatgtgagggagcgccgcgccattaagagattcagaagtcgggcgcagcctcgtg

SEQ ID NO: 501015 - DNA, 345 bp, Homo sapiens
cgaggaacacagctctgggggaaaggtgttatccacctcgctttaaaaaaaagcacatgaaggctgggcaccgaggctcacgcctgtaatcccagcactttgggaggctgaggcgggtggaacacctgaggtcgggagaatgagaccagcctggccaacaaggtgaaaccccatcgctactaaaaatataaaaaattagctgggcatgggggcgcacgcccgtagttccagctactcaggaggctgaggcaggagaaacgcttgaacccgggaggtggaggtagcagtgagctgagaacgcaccattgcactccagcctgggcaacaagagcgaaactctggctc

SEQ ID NO: 501016 - DNA, 332 bp, Homo sapiens
tgtgccaggcacagtggttcacgcctgcaatttcagcattttgggaggctgaggcaggcagatcactcgagtccaggaattcaagaccagcctgggcaacacagtgaaagctcatctctacaaaaaattagctaggcgtggtggtgggagcctttagtcccagctactcgggaggctgatgtgggagggtcacctgagcccaggaggtggaggttgcagtgagtcatgggttcgccactgcgctccagcctcggtgacagagtgagaccctgtctcaaaaagtaaaaccaaaacaaacattttgtattttgcattttttgctcagattatat

SEQ ID NO: 501017 - DNA, 662 bp, Homo sapiens
ccgcggcctgagttgtgctagcatttcccccaggtgaccgttgcagtcgtccaggcccacttctccacgactcaccatgtgcagaccgagaggccgtgatcggacatgcagacctgtcggaagagatgcaaaaggactcggtggagatgctcctacttcaagagcgctgggaacatactaatcatagagaacgtcatgcggctcagtatcaaacgacacgcactttgactacatgaatgtaacaagtccccaccctggccattgcatcgtggcggcacggaacttcggtcaggttatgtgacacatgaaaccaatacacttcatctagttctacctgggccaagtggccattcttctgttcaaatctggttgaaaagcatggactgtgccacacacccagtgatccatccaaaaacaaggactgcatgcctagattccaaataccagagactgagaattttcatgccttgctaagggaccatctcgatgtttgaaccttatgtgtgttttgtacagggcattctcgtgtactagtttgtcgtggttataaacaattagcagaatagcctacattgtgtatgattttctattccatacttctgcccacggttgttttctctcaaaatccattccttttaaaaaataaatctgatgcagatgtg

SEQ ID NO: 501018 - DNA, 133 bp, Homo sapiens
aggatccctcttactccactcacatcttggtcagatgtgaactcttcaatctcttgcactctatgcttgttaagatagtttagcgtgcattagttaacttccaactttacctactctactctgtatgggggat

SEQ ID NO: 501019 - DNA, 286 bp, Homo sapiens
cgactgtctctcacaacaaaaatcaacagttaatctacacagttttagaaaacagtgtacataccttaatttaaaaatattttattgctagaaaacgctaacaatagcggctgggtccagtggctcacgcctgtaatcccagcagtttgggaggtcaaggtgggtggatcacctgaggtcagaagttcgagaccagcctagccaacgtggtgaaacgcgtgtctattaaacatacaaaaaataagccaagtgtggtggcagacgcctataatcccagctactcagg

SEQ ID NO: 501020 - DNA, 144 bp, Homo sapiens
ttgcaggcgacctagaggatcccactacgtcgcatatcacagctgtcagccaaaataaacctttcttctttataaattatccagtctcaagtattctgttatagcaacagaaaatggactaagacaaaattggtactcgagaga

SEQ ID NO: 501021 - DNA, 219 bp, Homo sapiens
agtgctcatcttacgatgatttcaatatcaggccgagcacggtggctcatgcctgtgattctaacatactgggaggccaaggtgggcgatcctttgaggccaggagttctagaccagcctagacaacatggtaaaacaccatctctactaaaaatactaaaattacctgggaatgggggtgcatgcctgtaattcccgctactctggaggctgaggcag

SEQ ID NO: 501022 - DNA, 331 bp, Homo sapiens
ttttttttggatatggagtgtcactctgttgcccaggctggagtgctgtggtacgatttcagctcaatgcaagctctgcctcctgggtttaagcaattctcctgcgtcagctccccagtaggtgggactacgggtgtgcaacacaacatccggctaatttttgtatttttcgtagagacagggtttcacatgttggccaggctggtcttaaactcctgacctcagttgatccacctgcctgggcctcccaaagtgctgggattacaggcataagccactgtgcccagctgccatgtggccgtttttaatggttagttaagagaggtcgacg

SEQ ID NO: 501023 - DNA, 173 bp, Homo sapiens
ctacgaggcagagcagcagcatgccctggcttgtgctccgggcatctaagaccatgcgcagagcaatgcgcttatgcacggttccacttctccacggcagccgctagcagatatcagcagctgcttccggactcggagcaggccctggagcaggcccatcgcgcctctgtact

SEQ ID NO: 501024 - DNA, 309 bp, Homo sapiens
cttttttaaaaaaaaaaaaaaagggccggggggggggggggttcccccttttttccccccccttttgggagcccagggggggggtttcccaggttcggggtttggggcccccctgccccaaatgtttgacccccctttttttttaaaataccaaaatttgcccggggggggggggggggctttttatttccccctttttggggggttgggccggggatttccttttcccccgggggggggggtttccgtgggcccagtttgccccccttttttcccgcctggggccccagggccaaaaatttttttcca

SEQ ID NO: 501025 - DNA, 250 bp, Homo sapiens
agtggacacgacgaacggatttgacgacataggcactcactggttcagacctttgatcaggactggaggaacaaaggtttgtgtattagtccattttcacactgctgagaaagacatacccaagactgggcaatttacaaaagaaaggtttaatgggctcacagttccacatgactgaggaggcctcacacttgtggtggaaggtgacacggactgtctcacatggcagcagaccaagacgacagacaaa

SEQ ID NO: 501026 - DNA, 544 bp, Homo sapiens
gcaatcactctgacacagttacacatgctttctgatctcagtatttaccataataaatctgctcatataattgaggcataccatcctcaaaaacctttttgtaaacaggattggacccagttagaaaaagatgaacgtacttgtttaggaagattgctttgcagaacagacagaggtgctgcacaatgattcctatggaatcattattaattggtaccctaaggggatgtttagcttgaattgcacctctcagtctgcgtgccatggccacactatgttcagatgatctgaacaaaacggtcagatggtagaaatgataagaagtatggcaaaagttcctattatctggaaccgtggcggtatagtggcacctcaacctcaaatgatatggcctgctctagaagcttaacataaggatttgtggaaactattagatgttcttaataagatcaaaatttgggaaagaataaaaaggcatctagaaggacactctacaaacttgtttttggatatggcaaaattaaaagaacaaatatttaaagca

SEQ ID NO: 501027 - DNA, 494 bp, Homo sapiens
cgatcatcgtcaccgcgagcggcgcgacctggatcaggctcgtcggcgtgaatgcgcccttcgaccagtcggcgagacgccgcacttccgggctcaggaaccacacccaccacatgaagccgacatagcgcgccgggctcttgaaatacagccagatgccgaccgcgatggccagcaccgggaacgcgagcgtcagcaccttgccctggtggacggcgatcagcgcggcggtcaacgtccacagcccggcctgtccggcccagtgcttcggctcggcgaaccagcggcggttgcgcgacggggcgcgttcggcggtaatcgtactcatcgatccgctctcaacgcgacgacggacgcgaatccgcgagcggcatcgccacgcctgccgcggccggcgtgcggcgccggcgcagcatgtcgcgcgtgatccgcacgtgctgctcggcgaacgcctgggtggtcaggtcgcggtcgcgcaggcacgcggcggccgc

SEQ ID NO: 501028 - DNA, 747 bp, Homo sapiens
  misc_feature (382)..(382): n is a, c, g, or t
  misc_feature (395)..(395): n is a, c, g, or t
  misc_feature (401)..(401): n is a, c, g, or t
  misc_feature (431)..(431): n is a, c, g, or t
  misc_feature (473)..(473): n is a, c, g, or t
  misc_feature (719)..(719): n is a, c, g, or t
gggtctgcggccgcggctgaggctccagtgccgagcgcaagaaccctgcgcagcccagagcagctgctggaggggaatcgaggcgcggctccggggattcggctcgggccgctggctctgctctgcggggagggagcgggcccgcccgtggggcccgagccctccggatccgccccctccccgggtcccgccccctcggagactcctctggctgctctggggggttcgccgtgggccgggggacccgcgggtccgggcgccatgcgggcactcgctgctgcttgtcggtgctgcggcccgagggccccgtggccagtgggcattctccctgggctttcacccctgagcctgcgtcagcgtcacctgggtggaggagccgtgncggccaggcccgnccccancctggagactctgagctgccgccgcgcggnaacaccaacgcggcgcgccggcccaactcggtgcagcccggnagcgggagcgctgagaagcccggggccggcgaaggcgccggggagaattgggagccgcgcgtcttgccctacgcaccctgcacagcctggcatggcgccaaaaacggcgtcaaggacccgtacatcatgcacggagctgggcatcaggcagaggctgtggtggcggtgctgactctcagacagctgccacgctggcgtgtccgtgaccgcacgctgggcaccggctgaagcgtgtggtgtcctgancgggcgcacgggggcgctggcgccactg

SEQ ID NO: 501029 - DNA, 299 bp, Homo sapiens
  misc_feature (14)..(14): n is a, c, g, or t
  misc_feature (184)..(184): n is a, c, g, or t
  misc_feature (190)..(190): n is a, c, g, or t
  misc_feature (199)..(199): n is a, c, g, or t
attttaaggtctcncgtgatttaaaaccaggccaaaacatcagcctaagggctcatgtcagtatgaggagaaacatttcaaccatgagataaacccccatctgaccagaaacatgccaagcctgaggataacctcccctccagccagagatattccaactctgcaataaaactctccttcacanagaaanattcgcagnctgcggtaggctcccccttcctaaacccttaaatgcccttagtctgtaagagaatgtccctgaccgaaattggccagaagcccctctcaggtttattccc

SEQ ID NO: 501030 - DNA, 135 bp, Homo sapiens
ctaggggatcttattaataaatcagtgccgagagtatgttcagttcgcagtagtagatttattggaataaatattctatggtacatttctcagaaataggcttccaactaaaatacgtttgacccatttttaata

SEQ ID NO: 501031 - DNA, 148 bp, Homo sapiens
cctcatctcccttacgtctcccaagtaactaagactacaggtgtgcgcacacacgctactactttttgttttgctttctttgtaaagacagagccttgatatgttgcccaagctggtcttgaactcctgagctcaggtgatcctcctg

SEQ ID NO: 501032 - DNA, 1546 bp, Homo sapiens
  misc_feature (534)..(534): n is a, c, g, or t
  misc_feature (920)..(920): n is a, c, g, or t
  misc_feature (1251)..(1251): n is a, c, g, or t
tgccgattgttcgagcggttgtgctcctccggtggttagtttgaaattgttgttggctgtatatggtccctccctcggtagagagcgtttcttggtgtggtgagaggatgtgtttttcagcgtcgcgggggaccacaacattgtgtggggggcgttatccacgaagtgtgtgccgacggaggatatgtgggtttgtttccttcttgtcgacacaggcgaaaatttgttgttgtcgctttgtcagtgtggatggcacacacgacccttctttgtgctcttggggtgttgatcacactgcccctctcattagtttgtgcgcccccccgcccccaatcttggggaaaaatcactactgctcttggggcgttttgttcaatgctagggtgcttctacagggggtgggatgtttatgtgcctgtgtggggaaccacaatgttccaccgggggcccccctatatgttatagggtccgcccccccgcggcttaatattgggccccccccctcggtgtatatatctggtggaagattgtggnccaccaacaccaacacggggggcgttacaacacaaatgtttgggccacatacgacccaagagttttttgtcccttgggagagagcttgtagaaaggtgagaaaaaaaggaggttttttgtatattctcgccccccgctttctctggggttatataaaaatataggctctgggagaagaacgatggggcccccccttctaaaaatttctcctttggagaaagtttctttggggtgtagaatattgtcctctgccacaccattgtggtgtttgaaatataatgggggtttcctccttggggcaaaaaggccgcacgacattaggtggtgtgtttgtgagaaagaccttttcctctcccagagaccgttaatcccccacacctttgggngggtctcgccttttgcgctgtgttcctggtgagataattgtgagacacccagacacacagaagtgtgtgcggggttggggggtgtgtctcactctcacagagccccagatggtggcatcccacagagagagagcgtgtctctggggagaccctgggcgcacagaggtctctcccgcacagatctctgccccccagggaaagaccgctctcgagagagagagcgcttaatataggagatatatatgtatctcccccttagatatagcctgccctactctccccacgatctttttaatcacccagatgggtgtggaagaaacgcgtgtctccncagagaactcgttttggtgttgcgcaatatggcggccatattttaagattcttagattagattaaaagagactggtgttaataggataacaccaatagccatccgttaaaacactctcacgagaggaaaaggaggaaatgttttgtggagccacctcttggttttcttttttgcgtgtggcacgttttaaagttatattatgtctttttaaatcacgtaactttttaatgggaagcacacttgagcccaaaatttgtcacaggattttgagacccctttaaaaagtttaatgaga

SEQ ID NO: 501033 - DNA, 838 bp, Homo sapiens
gaagcggcaaatgttaaggattttggaatggctgtgatcttctttagaattattttatttttgtgtcttggttaccatttttgagatatataaggggcaggggagagtgggaggtgtttttttggtgcatcttcaaggaggaagcatggtagagggggaggaggaggcgtttggaagacagagaagtggcggtgggagtaaccattcctttctagctgcatagtctgagccagttcccttcttcaagctttataataataactgtatgggtatgggactgattcatctaatggtgcagagtgaatggtagcttctatattattactagatgcccaaaggagatggcaaaatgatttcacatcaaatgccaattcagggatgagagtggcctaaagcaggctttggaggacaatggcaggctaaatgggaaaagaataccattattattagcaatatgtgtaatgggcataggagtcactgtcgtgtggtatacttatccccagggtagatgcagtggcttttgtacttcacagctcacaaaaacctgtgaaagtgtggtattttacctctgcatgggaatgagaaacgacttcaaggtctccctaaaaggtggttacagaagccattcctggaacaagttcactcggaatggatttgtaaggtcaagaggggcatcctgtggatttagagaccagccccaccttggtacacatggggtctaaggtcttacattatcttgtatgaagagggatactctttgaatttatttgtgggcaggccgggagggttctttggagaaaaaaaaggggggggataaatgggggaaaagtaacatgca

SEQ ID NO: 501034 - DNA, 667 bp, Homo sapiens
ggagctccttccatcacacgcccgtggtaggagctgtataagcgttttcatgcttgctggaggggcccccgtgattcgatgggccgaggccgagactggaatgtggacctgattcccaaattcctcatggctaacggggcagctggtaacagatgctactgtatacagaggtgactcgctaccctggtactatcgacagggtcggtgcgatggtgcagacgtcttgattctacaaaggcgggagcgacacggatcgtacaaaagatgccacgcctagtgatggactgatggtccttcgcttgccgagatctgatgggctagtgttatgagaaagcggcagtcttccgcatagtttcctggatgctgtgtaggcaaactttcgatgagaatgaccccaagacctttgagggcgttgacccccagactaccagtatgcgtgacgtctaccggaagttgtgatctggggccaggatgtcatcgacttgtcactggccatgccctggcgctctatccgcatctgatgactaccgtggaccaggccatgccttgagaccgtgcaaccgtttcaagttgtacagtgagtccctgggccggtatggcaagagcccatatttatacccgctctacggtttgggccgagctgcccagggtttgcagattgagtgcc

SEQ ID NO: 501035 - DNA, 139 bp, Homo sapiens
caccgtcagacgctgaactatgtgacttgtgctttattcagcaaagctcatgtctgaaaattggttcagtgccattttaaatgtgtggttcccattgttgtgggcgtttatttcctccagttgctggcaaacgtctgca

SEQ ID NO: 501036 - DNA, 1318 bp, Homo sapiens
  misc_feature (255)..(255): n is a, c, g, or t
  misc_feature (258)..(258): n is a, c, g, or t
  misc_feature (347)..(347): n is a, c, g, or t
  misc_feature (349)..(349): n is a, c, g, or t
  misc_feature (464)..(464): n is a, c, g, or t
  misc_feature (469)..(469): n is a, c, g, or t
gaacttgagccgaagtacttgggtgaaagcgacgtaattcaggacagaagtagaaggaacagacacacgatcagtagaaagcactccagcggagggtccgatcttgcttgaccatacatagtttacgcatacactagaaagggcgctaggagcccacgaatggcacttaatagtatgtgacaccttgggacgagtggctgtgcgcagacgtagagtatgcactatataggaggtactagcacgcgtgaagctagnctnccaatgctgaggtaacttcgatggcgccttcatccacgtcgtcgagagcgacatggggacaatgggccactatatcaaataggcagagnanacacgaacttgtctagtctgagtttgctttgtgtatgaatttgcactatagttgtacagttgatgctgcaattttcaaggcataaaccataggtagatcaactatccctagcgtntgtgncatcgttgcacaaaggtctaggaaacaagtaagcttgaatatatattttcattactatatgttggtattaactgacataaacattgggctaggtatactacattttgatattacgatcttagtaactccaatatattttaaaatcgatgaatgattcgcaggtggtgcatggcccatacgtaggacacaatttaagtaagcgtgtagagcatagttgtgtgccggtgaacacccgtgtgcatctatacaatatgtgcctacacagacattacgcataaaggacaggcgcaatcatgcgggggtcatagatatcgagggcatatggaagacacaggccttaaacgctctttcggcataattttgagcacgtatatatggtttgcccactgcgtgcgtgggggccactcataggcgtaaggtcacgagaggagcgcgctcggcggtaacaaccacaaatagcacccgaactatcattgaagggcctaccaattcgtttaggaagggcaattttaaacgcaggtttcttgtggaagaggacctttggcagacataaataaactatacaactaggggcaaggaagtccaagagatccacccacgtttattaaatcgggggtcaatttagccaaccttttgggaaccccatgcctaatctattgggggaatgacccccgatcggaacacattataagagttcacgaaagaatatagtccatagaaccaaagggggagatcaagcgtaggcgacacattggggacaacatattgggtgaacatcccctgagaggggaagactatcagccaacggctgggcgagctcaatttaaaaagcgctgaaaaggaacacaa

SEQ ID NO: 501037 - DNA, 229 bp, Homo sapiens
gggctcggtaccctccctgacacggccatcacttctcgacggtatcgctgacacgatactgcttcgcctgccgttgatgacgtaactggccgtcgtgcgcgaaacgcccgcgagacgcgcgatttcatccagtttcacattaaccccttaatgacgctgaaaatagaagtgaaggctgtgctcggattaaccatgacatcccgtgcggttattcaatccagcctctgcg

SEQ ID NO: 501038 - DNA, 105 bp, Homo sapiens
  misc_feature (79)..(79): n is a, c, g, or t
  misc_feature (82)..(82): n is a, c, g, or t
  misc_feature (105)..(105): n is a, c, g, or t
gacaaaacataaaacgttttcagccagagggtcaaatccctgtcgttaacaacagacccagggccataccttcgtattncgntagttggacccagtgtcctagcn

SEQ ID NO: 501039 - DNA, 101 bp, Homo sapiens
tcctattagacatcgagcatttcttcaaagacatctgcccaccttttactgttctccacctgtgcttctctttcttctcgtgtacatatcaagagaagaaa

SEQ ID NO: 501040 - DNA, 213 bp, Homo sapiens
gtatatcagctcggtaccgcgtgggttcttgcagataggaaggagcagacattaatatccatgcaatcatgtgtgtacgctgaaagatacagaggaggtagagctgaagtttcctgcaccaggcaagcctcatgaacttccaacttcaatggtttaatctgatccaaacccatataggagtctgatctcagaaacacagtatactgataattt

SEQ ID NO: 501041 - DNA, 864 bp, Homo sapiens
catcagggccacaacttgcattgatccaagaaaggcatcctccagtatgcccacgaagtctaccctgatctgcagatcaccaatgtggtagaagccaaccaaccagtgaccatccagaactggtgcaagcggggccgcaagcagtgcaagacccatccccactttgtgattccctaccgctgcttagttggtgagtttgtaagtgatgcccttctcgttcctgacaagtgcaaattcttacaccaggagaggatggatgtttgcgaaactcatcttcactggcacaccgtcgccaaagagacatgcagtgagaagagtaccaacttgcatgactacggcatgttgctgccctgcggaattgacaagttccgaggggtagagtttgtgtgttgcccactggctgaagaaagtgacaatgtggattctgctgatgcggaggaggatgactcggatgtctggtggggcggagcagacacagactatgcagatgggagtgaagacaaagtagtagaagtagcagaggaggaagaagtggctgaggtggaagaagaagaagcgatgatgagaggagatgaggatggtgatgaggtagaggaaaggtgggaacctacgaagaagccacagagagaaccacacagaatgggcagcagcagacagacaccacacaagaagatccgtggaacgaggtggttcgacaggtgtgctctgaacaaagacgacgacggggacgtgcgaggcaatgatctccacggtggatactgcagatgtgactgaagggaagtgtgccccatacttttacggcggcatggtggcggcagacggcaacaacttctgacacagaagcactagtgcatggacgggtgc

SEQ ID NO: 501042 - DNA, 1186 bp, Homo sapiens
  misc_feature (109)..(109): n is a, c, g, or t
  misc_feature (361)..(361): n is a, c, g, or t
  misc_feature (367)..(367): n is a, c, g, or t
  misc_feature (578)..(578): n is a, c, g, or t
tgggacaattatgtttaaaatttatttaaaaagttaaaactcaatttggtaaaagggctacccagatcacagctccaccctcagcctttcacaagctattatttatacnaatctttattatcaacaaattatcaccactgtgatatcactggcactgggcaatgtatcacccctttggttcaacacagaaaacatgtgtggttttctcccatataaagaagagggattgtgcctcagaaccaccaaccgtgggtgttctcaagttctcgtggtgtggtgaccatatttctcatataccacatatagccgtgtgtttatagagttataatgtgagaatataacatataaatctctatcaccnctatanagatgtggagccacattataacacaaccatctcgagtgtctctcagagtgtggctttctctgtgagtgtctctatatattataatatacaatatacttttatatttctccttttctcttgtgtggtatgagaaaaaaacacacaaaacagagagagcggcgcggcgcgcgccctctctatagagagataatatctcccctctcgagagagnggcgcccccagagtctatatagcgcgcgatatacccccgagtctattctctgtggtttacacaagggggttggtcctccctatatatgagtgtgaagtgcgcgcatattaatatataagcgcacatgagggcacacgtgtggcgcgcgagcgcgttatatacaacacgcgcgcttgccggtgcacgcgggtgggaaaacacacgcgtgcgcatacgctctgggggaaacctctgtggggaacaaaggggacacctttataatctctgtgtgggggggggtgtgtgcacaatatatctgtgtgagaaccaaacaattatactctataaagaagagaatattttaaaaaagggcctcttaataaggggggcaacacattcttattaaaaaacactttgttctagtaaaacaggggtgtataaaatacaggtgggtctgtttaaaaacaatataaggaggtgagacaatataatttccattgagcagtggctttgtatacaaacaaggttttaggagacaaaaaccggaggaaaaatattagaacattagttgtgaacacaatattatttattaccaggacactcatataattataactataaaataagga

SEQ ID NO: 501043 - DNA, 624 bp, Homo sapiens
gagcggagcgcgggccgcggaacatgcgccgggagcggggcccgggcgggactccggagctggtactgctccccccgcgctccggcgccgggcctcgccgtgcggcctccttcctcccttcctcccgcccggctcggccggaggcggcggcggaggggcgaggcgcggcccctccttcggcggcacctcctccccgggcaggcgcgggcggagccgggcccgcctcagccagccgcggcgggagcatgcgcagctgcggcgccgcgggcagcgagctccgcattcgaacctccctcgcaaaagacagtctccgccccacaatgcaccgcggacgggcagcctttgaaaaagcggcgcggctcgtccaagatggcggagctcgacccagttgcctgacgagagctcttcagccaaaaagcccttgtcagtttacacccgaagggaacgcttatctaacacgtggcacactgacgcagtacagttctttacagaaaacacctgttttggaacggcaggactacaagctctgctgtggaaatgccttttcagaaatttcaaaacgaaagtcgacttttatctgatgcaacatgataggcaactcaattaccaggtcacctaaacgac

SEQ ID NO: 501044 - DNA, 1335 bp, Homo sapiens
ggtgtaatgggatggagctaaaggacaaggaatgctgggggctgtgggaaccaggaatgcagataccctttgaaggagcattcctgtaaaagaagctgaaaatgtagacctatgtgaagtgcgtctgatattctaaatatagagtagagcggtgaggagaagagaaagagatttaggacgtagaggggctatatattattcccacgattgatatgagttgatcttagtcgctgtatgcaagtatgataaggagaagtaaacgatgtcagcttatctggtccgaaaccgaagagaaagataacttacataaagaatatctcaatctatttatgaattttaggggatgtaggctgaacgatggtaatatatcagctgacggatctaatagactactttgaggctggaacgctgggaggggcaccatgtgcaccctgcccaccctgtacggcccgagcagacgcaaccttaaaggcccccccgcaaacgtgcacaccccacgtccacaatcatacacaaccgtccatctatccttaccccttcaccaacccctcacacccccccctacgcacacgcggcgaccgacgtcaccgtcaaccctgtaccgccgaacgtccttcaccttctaccgtacccatctcactggcagacgcgacacgctagcggcaggagcaccacgaccacgactatggaatttggccaacaaacagcacgacagccgcgcagggaccagcgctctggctcccgcgtgcaccgcaacttgtagtgaaactcagactgacgtacccttctggaccacaccaacccgcacacacacctgctcgcatccaccgtcgccctacacttccatctcgctgccctccttccccacacgccccacccccacccatgcacgccctctgccctgccgcccacccctagtcatccccagacatcacgctccacagtctgtatccacccaacctgtctcgggctgtgtaatgctaacacaatccgcacgtccttcccggcttcagggagtccctcaaccacctcggccctcttcccccgcgtcctcccccccatctcctctccgtcgcctccaccgcctgccctccgccacctccctgtcgccccgccacgcctccctctccccgcttcccccgccctcccgctcccctccgctccgtgatcttctcccttccctcccccgcctctcttcgcagcctgctcctgcgtgtccccttctcctctctctgctctctgcctgtcctccgggggtcttctcccgtctggtcggcgtcgggcgtggctgcgctccgtcctcgtctcctgccctcgttcgctcgcgcgtctggg

SEQ ID NO: 501045 - DNA, 197 bp, Homo sapiens
ctgccgctgatgctgctggtcgttctacaggatccccctcctccacgatcaccgtctgtgtgccagtgtccctgggtctgcctggtctagggctacttccccgaaccggtcacggtttcgtggcactcaggcgcccgtgactcatgctggcgttctcatccttccctgtctgtccctatctggtccttcatgactct

SEQ ID NO: 501046 - DNA, 275 bp, Homo sapiens
  misc_feature (5)..(5): n is a, c, g, or t
  misc_feature (22)..(22): n is a, c, g, or t
  misc_feature (84)..(84): n is a, c, g, or t
  misc_feature (180)..(180): n is a, c, g, or t
  misc_feature (188)..(188): n is a, c, g, or t
atctntacaaaaaatacaaaanttagctgggtgtggtggtgggtacctataatccctgctacttgggaggctaaggttcaagantcgattgaaccggggaggcagaggttgcagtgagctgaggtcgtgccaccgcactccagcctgggtgacaggcagagtgagactctgactcaaaantaaataantaaataaataaataaataaataaataataaataaaaaataaaggctgatggcgctacatgtttacatgtcagtaaccatgtgggaaa

SEQ ID NO: 501047 - DNA, 177 bp, Homo sapiens
gagcgggcgtttactctgttttttttattttattttttggggatatatggacagatctagtttttaaatggctctggattgactgtggacatttggagtaaaaacactttacgttattcattttttcatatggagtttcacacgttgcccatgcggcagtgcaatggtgcaattttg

SEQ ID NO: 501048 - DNA, 713 bp, Homo sapiens
  misc_feature (245)..(245): n is a, c, g, or t
ccgtccatggacgtgtgctctccccactgatatcgtgagtattcctggaggagggggattctagtctaggcaataatagtcaatagcctgctatattcaatgctcctattctaacagatattggtgaagttagttcacccccaatttgccgccccaaataactgtcagcaccgtttgctggtcccgcgaattcatctagtttatcgagaggtgagattgctttgagtctatcgtggtacatggcnagcaagctcgtctcgtcgcaattccccatcagattcggcattgtaggtggtggagtcatactgctctggggccaagtgttgtcattgtgcgggaaatactatgttgtacttgggaagcgaccgaagatgttgttgctacacatactgagaataccgtggacgaccagtatggcgctacgatcaaacgtggaaaccatctactccatagcacatcgattagccgtgctatactttgtccctagatcctttttgggctgtgccatcagttgttataagtcaagacagttgtgattcctggattcgtaaaagtggttgcttccgttactttgacgtgagagctaaccctggaaaacgtgtgcctgttgcgctataatccgaaaggattaaggggatttgaaaaagtgctaacaaggaaaagagttaaaaggtggcctgattattggggtacccgtttagggcctttgaggc

SEQ ID NO: 501049 - DNA, 190 bp, Homo sapiens
agccagattcggccgaggcagagcgagccgagctgcaacccgcgtggaaaggccgcctcgggcgccccatcccgctcgacggaggtaggtgagcagcgtgcggaagaaggctcagcgcaggggcgcagaccgcctggccaatatgcccgcattatacctttagggggcgggggagggagcgtcaatttca

SEQ ID NO: 501050 - DNA, 131 bp, Homo sapiens
  misc_feature (79)..(79): n is a, c, g, or t
  misc_feature (93)..(93): n is a, c, g, or t
gtagttgggttgagagggcccaccaaccaaggcccagccaatttttggtatttaaatataagaagagggggttacaccnactcttgtggccanggctgtggtcttcagaactctcctgtgaccttcatgtg

SEQ ID NO: 501051 - DNA, 1225 bp, Homo sapiens
tgaaaaatatagggtgtgatttcgtgtgttgtttgttattgtgttccctgcgcgtggtggggtgtgtctctctcgttcctctactgttttggtaattatacgtttcgggccctgatttttagtgtatctttgcattgtggcgcctgtatggggcccgcgctgtagagtgtattatctgtggctggattgattcatgcgattcgcgttccgttgtcttcttttatttttcccgaccgtttcccttgttcagggcgtatgcgtccctgatgttactatccgggaggtggtgcgcctttagcgtaccgtgtgtgttcctgcgcatacgtccgttgtatacccctttacgtcatccgaggcgttttggtgaacctggccatgtgccctcccaagggcggtgcgcttccttggtccacccggtaccaggcaagacactctggtgcccggcattgcctaatcggactgatgcgtgcgttcattcgagtttattcggatctgagctttgtaccagaaatatcgtcggtgagggggctccaatggttcgtgaactctttgaaatggccacgaaccctcaacagcctgccggtatcttgctttgtactgaaaattgatgctattaggaggggctcgttttcgatgattggtgctgcgaagtgtgaccaatgatatgtgcacgatgaacaatcgttgcaaactgatcaaatcagcttgatgtgttttgatcctcgaggcaaataattaaagtagctgatggccactaaccagaccatgataactttggatccatgcactgatgaggcccagggagatttggatagaaaaacttgaactttacgcttgcccgatctatgacgggtcggacccatcatatttacagattcaccgctcgttcaatgacgtgttgaaagagatatcagatttgaactgatcagcacgactgtgtccaaactagcactgctgctgagattagaagcgtctgcacagagcctgcgctatgtttgccatcagagcacgcgcgataataacttgctaccgagaaggatttcttggaacgctgtaaataaggtcattaagtctgtactgcccaaattctacgtgctactgcctcgttacatgacatacgactgtaccctgaaggctttcaagtgaaaaccttaaatttggaatccttaccttatatagagcttgtaactaaccagtcatactagtgggttttctgctgctgtcc

SEQ ID NO: 501052 - DNA, 392 bp, Homo sapiens
  misc_feature (62)..(62): n is a, c, g, or t
  misc_feature (318)..(318): n is a, c, g, or t
tgccagtaaaattgattatcgcgtctgaaccactggtgacgaggccaccgcctgcgcggaangaaatatggctatctgcaccgatagtggttgtaccaccacgaacttcgacgccattggcgcggctccagttacatcaacagtgagtgcattcgcgctaacctggccaaagctccagaggccgtgagcattatcgccattggttttaatggtactgtttgttccgagatcgacaacagagtttttctgtacgtttatccccatggcgctgtagccctgaacatccgattgtcaggtctgtagccgtaaaacgcgcanacccattgggcgttattgccgttgagaccaccgatataaacacctgtacttccatcggtcgtgattttacttcg

SEQ ID NO: 501053 - DNA, 159 bp, Homo sapiens
ctcttttacggtgaaaataaattaaccgtttatgcaagaatttatctcccacgtaacgtttttgagatagacacctatgaacaattgcgagagctagatggtaaatctagccatcttgatacagatatcatttctttaattagtaaagaaatgggtgtt

SEQ ID NO: 501054 - DNA, 103 bp, Homo sapiens
ttttcctgtgccactgaaagggggaaaaaactgccaattaacctgtaaaatgccaacatacatgggatgcatccaaatataagatagtaatatgtaagacaga

SEQ ID NO: 501055 - DNA, 386 bp, Homo sapiens
  misc_feature (94)..(94): n is a, c, g, or t
accttcagcccctccttgccttgggtgtgcccttttttgccaaggaaaaacacaagccccaggaaaaaatcaaaaccgtcatgggtaggccacnccgtccttttccctccccaagtgtttttttcctgacccagggttcaggcaggccttgtggtttcaggactccaaagacttccatgtttaactcagaaggggcaggtgttaaaaatgggccccaggactggagccccctccggagaccaaactccccatccctcagtcctccccaacaggggattagggatgcagccccctgtaggtcctttttgcttacccctcctgtggaccccttgccctttggctggccctttccaaagcccaaaaagtaaaaatgttttggtttttta

SEQ ID NO: 501056 - DNA, 378 bp, Homo sapiens
  misc_feature (325)..(325): n is a, c, g, or t
gacgccctaactcctagtacctcagaatgtgactgtatttggagagagggtctttaaagggataagattaaatgaggacaggccagacatggtggcttacacctgtaatcccagcacgttgggaggccgaggctagcggatcacgagatcaggagtttgagactagtctggccaacatggtgaagccccgtctctgctaagaaatacaaaagtgagctgggcatggtggcacatgcctgtagtcccaggtactcaggaggctgaggcgggagagtcgcttgaacccaggaggcggaagttgaagtgagcactccagcctgggcgncagagcgagactctgtctcaaaagtcgacgcggccggaatttagtagtagtag

SEQ ID NO: 501057 - DNA, 259 bp, Homo sapiens
  misc_feature (7)..(7): n is a, c, g, or t
  misc_feature (183)..(183): n is a, c, g, or t
ggtagtngggattataggcacccgcaaccatgcctggctaatttttgtatttttagtagagacggggtttcaccatgttggccaggctggtcttgaactcctgtccttgtgatctacccgcctcagcctcccaaagtgctgggattacaggtgtgagccactgcacccagtcaaaaatttttnagtgttagatttgcaacaacattttttttttttaatgcatgtgcatcagtaacttttatgtagacagttttcaaat

SEQ ID NO: 501058 - DNA, 490 bp, Homo sapiens
  misc_feature (275)..(275): n is a, c, g, or t
  misc_feature (281)..(281): n is a, c, g, or t
tgcactccaacctgggctacagagcctatctcaaaaaaaaaaaaaaaaaaaaaagggccgggtgcaacggctgtaatctcagcactttgggaggccaaggtgggcaggtcacttgaggtcaggaattcaaaaccagcctggtcaacacaatgaaaccccgtctccactaaaaatacaaaaaattaccggggcgtggtgatgcatgcctgtaatcccagctacgcgggaggctgaggcaggataatcgcttgaaccaggggggtggaggttgcatngagccnaaatcgcaccactgcactccaggctgggtgacagagcaagactctgtcttaaacacacacacccaaaaaaaaaaaactcttggggattccagcatgcagtcccatttaaaaaccactctttggggggatttctcttatggttgactccatagatacatatataaggaatacctatgatttggcccattttaccacatagttgactgcga

SEQ ID NO: 501059 - DNA, 364 bp, Homo sapiens
aggacgggggccttcttttcccattttatgaaaaaaatgaaaatctttttggaaaaatggctgtggaatattcacctttatatataaagaaaaacccttaagtgctggatagggaaggataaaataatggtttttttatttgggaaagattttaaaggattatataattattttggggggtttattttaagcaaggccctttaacccttgagctttgttatttttcccccccggagggggagggaggttttttgaatggtttttatagccaatatttttttttaaatgaaaaacccggggggggggagccaagcctctttttttttttgatcctgtttgggaataaaatttgtccctttgggga

SEQ ID NO: 501060 - DNA, 343 bp, Homo sapiens
ggaaataggctataaagtgctaagtacacagctatattctcatatgtttaggagaaatggctcacagaatttggctcgcctcgatttaatttactttatatttcagtgatagatgagtcttccaccttcactttcctgaggtgagatattaacacttaccctagactctgcaggtttgaggaactcttatgaccaggtacatacactagatttccttggctaacccaaatctttggccaaaccacaactctcagatttcatagacagtggtgcacaaaccttcgttagatgaagtattcatgaagtctagtcacccagattggtctcttctgtgctctggccc

SEQ ID NO: 501061 - DNA, 785 bp, Homo sapiens
atgacccaccaatcacatgcctatcatatagtaaaacccagcccatgacccctaacaggggaccctctcagccctcctaatgacctccggcctagccatgtgatttcacttccactccataatcgctcctcattactaggcctactagaccaacacagctaatccatataccaatgatggtcgcgatgtaacacgagaaagctacataccaaggtccaccacacacctacctgtccaaacaatggccttcgatacgggagtacatcgctattgtgattacctcgagaaacttttagttctgtcgcaggagtttatctgagccctttgtaccactccagcctaggctcctacccgcacagttatggcaggcggctcgtgagccaccctaagcagggaactcatgctcctgcttatcatccaccttagaaagtccacactcgcgtaataggacgatcgcgtaatcatcgtcgctactcaggagttctcagttcaactctggagactgcctccagtatgtgcgtagagatgcaccatagcaggcccgcaaagcacgataattgaatgtccaatggcgacgggggttttaatgtaacaggttctctacctaggagttcctccatatattttggcccatcacgtaaccaaggcacatctagaatgcttacttttcagaaaggttctcccacctgtcaacgctactccctccacggaaacgggacctttgttattggtgctttccaagccaattaatttattgggacgtccagcaagggtcgttcccacaa

SEQ ID NO: 501062 - DNA, 453 bp, Homo sapiens
  misc_feature (7)..(7): n is a, c, g, or t
cgaggangtctcatggttggctaccagtgtggtttggtcttccgggcatgctgtgtcaagaggggggagatcggagatttggatgtcgcgcgcctccaagaaacggataagatcattgaggttgaggaggaacaagaggacccatatctgaatgaccgctgccgaggaggcgggccctgcaagcagcagtgccgagacacgggtgacgaggaggtctgctcctgcttcgtgggctaccagctgctgtctgatggcgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggattcataactgcctccccgatttat

SEQ ID NO: 501063 - DNA, 403 bp, Homo sapiens
agtgacgcgggccgtcagagcaaggaagacatagaaggtatggtccaggaagctgagaagtacaaagcagaagatgagaagcagagggacgaaggtgtcatcccagcaattcacttgcagtcctatgccattcaacatgcaacagcgaactgattgaagcatgcagcaacacttccacaggcacagcattaacgcatgcaggcactaacacagcaagcatgctggcacaagatgtaatgcaaattatcgagctggacttgataagcaatccgcattgctgcagaaggcaagaatttgcaccatcaaccagaaagcgctgaagaaagttagccacccccatcatcaccaagctgtaccagagtgcaggaggcatgccaggaggaatgcccgggggataggaggt

SEQ ID NO: 501064 - DNA, 205 bp, Homo sapiens
cacatattatggagtagatgtgattttttccaatacacatatgtgaagtgattaaatcagctaattaacatattaatcccctcaaatacataccacttctttgtggagagaatatttaaaatccttttttttttttttttggttaggaattctggtggttttgccagggcggaagtgcagggttgtattcaggttcctgtgcacc

SEQ ID NO: 501065 - DNA, 366 bp, Homo sapiens
ggtcggtacccgggcagtacggatgtggtggtatcaactgcagtcagttactcaggaggctgaggtaggaggattgctggggcttgggagccggaggccacagtgaaccaagattgtgccactgcacttcggcctgggtgacagagcgaggtcttgtctcaaaaagaaatagtaactatgggccgggcgcggtgggaggccgaggcgggcggatcaggaggtcaggagatcgagaccatcctggctaacacggtgaaaccctgtctgtactaaaaaaatacaaaatattagctgggcctggtggcgggcgcctgtagtcccagctacttgggaggctgaagcaggagaatggcgtgaacccgggag

SEQ ID NO: 501066 - DNA, 227 bp, Homo sapiens
  misc_feature (194)..(195): n is a, c, g, or t
  misc_feature (213)..(213): n is a, c, g, or t
agcagatgccaaaaaagaaggccatatagcagcacatcccgagcatgataaaagggcggcgaccaaagcgatcggataataatcctgcaaaaagcaagacacttaatcgaccaatgcccagcgatgagataactatcgagacacccgcggcattagtctgccaagtgtctccagcgaggccatattcaggctcnncaaaggacgccatacatncacagacctggaga

SEQ ID NO: 501067 - DNA, 371 bp, Homo sapiens
tcctgaatcccagatttgattcagaggcctcgtgaccacggcccgtcccgacgagcaggcatattgacctatttgtccagcttctaccatgctttttcaggagcgcagacggtgaacatgccgccacccggatctgtacggtgctggctgtcaaccaagcagaacgagcaccttggtggaggactacgagaagctggccagcgacctcctggagtggatccggcgcaccatccccttgctggaggcccgtgtgcccaaaagactatccaggagatgcagcagaagctggaggacttccgcgactaccggcgtgtgcaaaagcggccccaggtgcaggagaagtgccagctggagatcaacttcaacacgct

SEQ ID NO: 501068 - DNA, 279 bp, Homo sapiens
gtctacccacaggctaatatcttgtttatttttttttaaattacaactctataattaatttttattttttcagaaagaaccatttcttctcatcttggtcaaaaggtttttataatggcaactcgttaaggtttaacacattcctataggcatataatctcattttggtggtggttggtggagacggagtctcgctctggtcgtccagcctgggagtgcagtgggcgcatatctcagctcactggcaacctctggcctgctggagttcaaagaaattct

SEQ ID NO: 501069 - DNA, 404 bp, Homo sapiens
  misc_feature (1)..(1): n is a, c, g, or t
nttaccataccctcttcatggatgggggaactcagatccagggacatgaggccccagcctccctgaagcctttgcattttggatgagtttcctgaaacaactatggaatgataactagcgaaatccattcacagttcttatgggccagactatgccacaagtgacttcctgtaccagctccaacactgcaaaggatcgtgtcctcagccattgcgaggagatccaaagagaagcccccagcataagaaccgtggaaccttgggcgagttaaagaccttggcaagctcttggaccagcccccacccgtgggtgggccaacaaacgaacactaaactatgcattggtgccccaaggaccatgctcatggacatgatgccacacgaaggaggctcacaggtggttac

SEQ ID NO: 501070 - DNA, 341 bp, Homo sapiens
ttacaacagctagaaaaaggaacaaagtaccgataaatgctacagcacaaatgaaccttgaaaacatggtaagtgaacgagagccagaaacaaaaggccacatgtacaattgcatttatatgaaatgtccagattaggcaaattcatagagatataaggtaggtcagtggtttcccagggctggggagaagagggaatggcaagtgactgcaaatgggtacatgatttcctttgggggtgataaaaatgttctagaattagatagtggttatggctgcacaaattcgtgtatatgctaaaaactgctgaactgtataccaccaccaagtacagggcaaacc

SEQ ID NO: 501071 - DNA, 378 bp, Homo sapiens
taccgtgtgtacaatgttgtcatgtagttcctagtatgagactttctgcatgggggccagctgtaacagatgtactaagtggtggaaaaaatatttgtcatcattaccgcttgtccagtttgttatagtcgccatccacataagccagttcttttgcatggaggatagcgagtatcagtttccagtactttgcgtgcatcattatgagttacagttgcatgttactgctgctctttctccatttttggtaccgtgcttacaccaaaggtcagaggttggccaaaactgtgaaaaatggcactggcaaaaacaaagatcattgaagcccgacatacgtctatgatcgaaactgatacattgtcttccttgagaatcgag

SEQ ID NO: 501072 - DNA, 987 bp, Homo sapiens
agcggaatgagaaggctgggacagagtgaatgggaaatgactgtgaggagtgcggaggggggctgcgaggtttcaagatggcggtagctgagtgtggttgagcgagagacccagttgacggcctttacgaagtgaaacgagagccgggacatcgcccccctaaccgcttctcgtagtccatgggagcacagcgagaacgtgttaatctatatttttaatgacacaaagtaaaaccatacgaaattagtacaaacaattgggacaggagaaatcgtacggagtcattcgcaaccaaatgaagatggaaaaaatatgacatggacaacccaacaggaggccaaaggcccgcgaaaaggggacaaggcccggcaaagacgaagaaattacaacagaaggaacagtaaaagaacgagcgacactgattgggtctcaagaaggctgaaagcgagtaagcgtactgcaaggtgaataacgcgagaggcgaggaataaattcgggtaggacgcagttgggcagccaacagttgggcaaatgaacaaattgagcgcgatagaaacagccgcacgatgccaaacaacgacacaaccaaaatagcaaatggcgtaacagatggagacggaggaaagaggcaacacaagaaccgcgatagaaacaggaagtgggagatggagaaaacgaaggtggaacccggtcaattcaagggagcactcgatatatgaaaagaaagcgaaagaaagaaacgaagaaagtagatcgctaagaacaaaggaacgatacgaaggcaagacagggcgtaacacaagagcagggacagaaatgaaaacgcagagacagaaagaggagacacaaagtagaaagacaaacacaaataggatggagagagagtgagaaaaaagacaagaggaaagcaggagaatgagtgagaaagcggggacgaaaagaaaaggggagaaaaaaggagaagaaaggcggtggcagcacaagtga

SEQ ID NO: 501073 - DNA, 229 bp, Homo sapiens
  misc_feature (10)..(11): n is a, c, g, or t
  misc_feature (25)..(25): n is a, c, g, or t
  misc_feature (132)..(132): n is a, c, g, or t
atggacagtnncggtcggggttcangcggtcttggattcctgcactgcagttcgtcgatcatctgctggcgcatcatgaacttctgcaccttgccggtcacggtcatcggcatctcctggacgaagcggatntagcgcggcacgactgcaggctcggggctcgaggcagatgcgctcatgtcttgtctcccggatgtgcttgtggtgtggacagggcaatccgccggag

SEQ ID NO: 501074 - DNA, 486 bp, Homo sapiens
ctcccttcaccctggcaaccactagtatgcttcccatctctgtggatttgcctattctggacacttcatatagatgggaccatacaacatgggcctttatgtgccttctttcatttagcatgtttctaaggctcatctatgttgtaccatataacaatttcatccattctttatggctgaataataatccattgtattgatataccacattttatccattaattagttgatgaacacaagttttttccacttttcggctattatgaatatgctgttacgaacagcatatttgtgtggacatgcttgtaactgtcttgggtatatatctaggagtagaattgctgagtcatataataacactatgttctaactttttaaagaactttcgagctgatttccacagtctgcatcattttacattcctgccagcactgtgtgatggttccaatttctctataccctcattaactgttgtcatagctgttt

SEQ ID NO: 501075 - DNA, 282 bp, Homo sapiens
cttcagttgtcggaggaaagccaactgtctccgtgattgcccctgggaactgaatgtctcggtataaaacacgattgtacatttgttcagttctgagcatgcggacgaagaaactcgccactagtgagttgggaggcgagacatgtttacagcaatgctgccttgttatcctttactccactgagatgtctgggtggagagaaacataaatctggcttacatgcatcgttccagttcccgtagttacctttccctttgaacttcattatgacatagattcta

SEQ ID NO: 501076 - DNA, 646 bp, Homo sapiens
agaaactgtattgtgacgaggtgtgctctcatgaacacgagacttgcgctaaacacagtgcttgagaactcctccttgaaaccttgtcacgatacacacataccactggaattaaacttacgaggacttcttggaccctacaaacccgctgctctaaagggtgtgtcaacggaagggaccgcaagtggagcctgtattttcctaaggacttgtgatttgctctttaagaaatctgggcctgagaacaccagagacctgaaagtactctgtgaataggactctgagctgaagataggcttcatgcaatggactgcctaaataaccgctgagtctggacatgcattgagctctctcaatggccgtgtagagtgctatacccgtgaatattaaggaggtgaccaaatcaccgtgaggaggtagatatggatgctctgcatcttacgggactatatgcaccagcgccagatagcaccatgaacttcttctgagctctgatatgagagaccacatttctgagtaattgcctcctcacattattaatgagaataagaattatattgaacggtctaacaatgacacttatatcacatgcgttctctgtggtgttctataagtgatatgtgaaatcaatagagccctttacggt

SEQ ID NO: 501077 - DNA, 130 bp, Homo sapiens
ccgggtgcctgctgctcattagagggtcataagaataacactctgagtaattgattgttcactatcctgtacgatgtatcttgatgtgatctgtcatgctcgggtaaagataacttaacattgttctgtt

SEQ ID NO: 501078 - DNA, 411 bp, Homo sapiens
  misc_feature (411)..(411): n is a, c, g, or t
catgattaaactatataatagaatgtatagcatctggtatacgctagaacggcggactacggtcaatagtgattggacatttaagaataactaacagagtataatcggattgtttctaatacaaaggataaatgcttaagggaaggaatactccattttccatgatgtggttattacgcattgcataagtgtagcataatagttcatgtactgcatagatatatacacctggctgggcgaggtgactcacacctgtaatcccagcactttgtgaggccacggcaggtggatcacttgaggtcaggagtttgggaccagcctgaccaacatggaggcctgtgtctactaatgatacaagattagctgggcgtggtgtcgcatgcctatagagacagttactcacgagctggn

SEQ ID NO: 501079 - DNA, 297 bp, Homo sapiens
gtgatctagaggatcctttctctgatcgctcaaccgactgctgtcacttcacgttccagtttttaaatcctgagtcaagccaaaaaaaaaaaaaaaaaaaaaaaaaaaaaaaaaaaaattaaggcttgccattttaatttggttttttggcgaaattaaggttttggccaggaaggggtgaaaggaaataagttcatagtcggcttaaaagatttgggggggaacgagggaggggcgggactcgtaatactcttgttggttgatccacttctgcgggaagggtggccagcgagcccg

SEQ ID NO: 501080 - DNA, 131 bp, Homo sapiens
agataacctgagctcttgtgagcactccgcagccaggtctggcccagcgactgtgcccagccagatctgcctacaagctgcatgtgctgcagaagagtgccgacgcagtgagatccagagcctgagagctg

SEQ ID NO: 501081 - DNA, 1109 bp, Homo sapiens
cccaaacagagggggtttatatcccgacacagggggtcaaatacccccgttctgggtggaccaatatatgcaggtgacccccgggagttttgctggggtgcggctactcacatggggggagcataaaataatctttgttgcccccccgccatatttttgtcaggaaggtgcacagagattggggcctacaaagttgtttttctgccctcgttgacacctttataaacacgggtaaacgggccccctttggattcgctgacaagaattttgtgggtcgcaccagttgtgttatggcccacgctggcaacgtatggcacacgggggcaacgggtttggaaaggggtggggagcttttttaaatccccccgaatcgccccaacggtttaacccgtctcacacaagtttctttatgacacatatcctccccgttcgaatttatccccacacactattgggacttgacaactaaatttatcccacggtttctttaacccgtatcacaccccccttatacacgtataccccacttttctttaaactttaaccctatttttaatacttattgcctaaaactatgtttatcgcgccaatttcactatataatctcacaacttttaaaactctccagtcacccacgcgaccccctcatctattctatttctttgcacaccgtgaaaccacacgctatacacactgagcttaaacacccccttataattccaagtccacaccctctcttctctcctatgggagggcctgcgcacccggcgtataaccggcttttttgtccccacaacatgggccacttatatcgaaagagaattcaccacacaaagaccacaataagcctcattcatatccccacacacactcaatatagccacaccacatcacacccctccttaaaccctttaactttctacctaacgcctaaatttaccttcaccctcaatcaccacctaactccccaatattctaacacaacgtataaaaatataaatgacacacgtttgaaacataccacaaacccacccccacttcctccccacactcatcgcccttaccacgctactcctacctatctccccttttatactaataatcttata

SEQ ID NO: 501082 - DNA, 348 bp, Homo sapiens
tgtatgctacattggagagtgtacatgcattaccaaagctcacctctccagcttactctgcaagtcagtatggatgataatcagtcattctgtcttttgtaacttcccatattaaacgagtttatcaagtctggtcattctccttcataaagcactcacaaatccatcactcatctccagcctcttctgccctggccttaattctgcctctcaaaatttctcacttagactcctgcagtgccccccaacttgtatctgtgcctcccccacaacttcccttgatccatctttcatgccagtgtcttcaatctgctggtcacaatccattggcaagtcacaaaattaatg

SEQ ID NO: 501083 - DNA, 100 bp, Homo sapiens
gaagcttgacgagcttcacttccagttcttggtccgcagcagggcagcccgcactgcttccgccgccacatacgggtcacgtcaacaatacggaatccta

SEQ ID NO: 501084 - DNA, 157 bp, Homo sapiens
gctgatctgactaaggatgcaccactcagctccgagtctggatacaggcatagcaccggccagcgctcctcttgtacacagacactactacatgagtttgcgtccctttcctcttccttatgtgcgagcacacccgaggcatactcttatcccttcc

SEQ ID NO: 501085 - DNA, 135 bp, Homo sapiens
gaaaaattaaggatgtgtcaaacaagcaggatgcaggtgatgggtattaacatcagatatagagaccagaggataaatgtaaatactgcgtgccgcaaaacgatccatgtaagtcaataaacaatgctttttaga

SEQ ID NO: 501086 - DNA, 323 bp, Homo sapiens
taaatgggtcaccccatcaactatcccccatggccaaagcctgactctggcccccagaaaacacaggcattcagctggacagcctcgccttcacgctgctgctgtcctcatgggggacaggcctcaggtggcaatgcacaattcattagttacgggcagttgtgacagttcccaaggagtgtattcccccgccccccgcccagtgaaaacagccctacccaggggtgggaaccttggggctctgacccgaagtttagaaaacgctggaaggacagcatccctgtctgcaagggcaggagcaaagttgccaggctatgacgaaa

SEQ ID NO: 501087 - DNA, 203 bp, Homo sapiens
tacctggacccgaacaggacagcagaagatgctgcaataactatgcccgagggcactacaccattggctgaggcaggagaatcacttgaaccggggaggtggaggttgtattgagccgaaattgtgccattgcagttcatcctgggcaacaagagcaaaattccgtctcagaaaaaaaataatgcctttgtctcctatggttg

SEQ ID NO: 501088 - DNA, 163 bp, Homo sapiens
acccactccaccttactaccagacaaccttagccaaccatttacccaataaagtataggccgatagaattgaaacctggcgcattagatataggtaccgcaagggaaagatggaaaattattacccaggcattattatagcaaggcctacccctatacctctt

SEQ ID NO: 501089 - DNA, 448 bp, Homo sapiens
atctgcctgcttcggctcccgaagtgctgggattaaagacatgagccaccacgcccagcctgtgtgtggcttctttcacttagaataatgtttccaaggttcatctgtgttgtagcatgtatctgtatcttatttatttttattgctgaatagtattccattgtatggataaactgcattttgtttattcattgattagttgttgatggacatttgggttgtttccactttttagctatatttacattactgcttgtgttttcatttctcttggttatatactaggagcagaattgctgggtcatatggtacttctacttttaacctttgaggacctgccagactgttttctaaagtggttttaccattttacattctcatcagcatatgtgagggttctggatttctctacatcctcaccagtatttgtctttgatcatagtcatcc

SEQ ID NO: 501090 - DNA, 207 bp, Homo sapiens
cgttaagtggccgaggagtaagaatgttggttgtggcggggactttgccccggggaagggactaaggagccagaggccaggagggaaacacacagagccagggcgttgaatggccacggaggcgttgaatggccacggaggcgttgaatggcccggaggcgttgaatggcccgggccattcaacgcctccgccattcaacgcctccg

SEQ ID NO: 501091 - DNA, 513 bp, Homo sapiens
cgggggtggcaggactgcttgactcccggagtctgagagcagatctgggcaaccgtgagagcctgtctacgaaacatcccggcatcaggtgtggtggcatgcacctgtagtcctagctactcaacaggctgaggcagaaggatcccacaacatacaaagagtccatctttaacaccaacaacacacacacacttttcaaaaaaagatgacctccaccttttttttgagtaactagccgaataacaaattgccatttacctaagatgacggaagactggaagggaccggcactatagggaacgtaagactccggacgtcggttaacgctgtagttggagatgccttttaagacatcaagtgggaaagttaggtagctgttatataaaagttggctgttaaagggagagaagttggagttggtgttgttagaccaataggtataatttaagaaatgagactaatgagatcttgtgagtgtagatagagaaaaaggttgaagcatgctctcacgcg

SEQ ID NO: 501092 - DNA, 491 bp, Homo sapiens
ctatatgatctaaggatccccgggcagtacggatatgcggcagtgtgctgggcaatggtgggcagagggcaaggtggtgagtgggagaggtgagctcagagagtgagataggagccaatacgcagtggctcgcaggaccttcaagtgtcctctgagttggggtgggatccctgtggagtgctctgagcaggggtgggagagggtctgagttggttctggcagggtcctctggctgcgtgtgaggaacaggcagtgtggcccagtactgaagctggggccccaggcatggaggtgactgcaatggcgcatggcaggatgatggggctagaccaggcagcatccaggagggtggggggacaggaaggagcctgaagctctggggacaagttgagaaagacttcagatgggcctagggccctatttctaggactcccattctcaagagttctatgaacctcttttctgacacaatgagccacatccgtactggc

SEQ ID NO: 501093 - DNA, 433 bp, Homo sapiens
aagaaatacagatacacacaaatatacatgcatatacacacatacacacacaatgggggtgtgagatagagacagaaaaacagtaagtatagcaaaatgttaacattaggtgattctgagaaaagggtatacagaacttcattttattctaaacttcccataagtttgaaattatttcaaaagaaaaagtttcttaaaaattatatcagttaagtgtaaaggggttttatgtctacttaaaagtgtcgtgggatcccttgcatttctgatggtgaatgctatgctgatttaggataggagcagatcaaaacaactttttgctccagataatggttattttgttgaagatctgatgatttcttttctgtttactgctggccaacacaatttccttgatttccctttcactgtgtaaaataaaccatacaccaca

SEQ ID NO: 501094 - DNA, 529 bp, Homo sapiens
  misc_feature (371)..(371): n is a, c, g, or t
acatagcccatgaatgcagttgctatgactgcaaatagtaggatgatcccaatgtttcaggtttctaggaaagtgtaggatccatagtatagtcctcgtcccacatggaggaataggcagatgaaaaatattgaggcgccgttggcgtgtaggtatcggattagtcagccgtagtttacgtctcggcagatgtgggtgactgatgagaatgctgttatggtatcagacgtgtagtgtattgctaggaataagcctgtgaggatttgtacctcggccgcgaccacgctaccctatagtgagtagaagagctgatagggctcgagcggcagcccgggcaggtacaattgcaagggcggcgataatgaatgggnggatgaagtggaatgcgaagaagcgtgttagggttgctttgtctactgagaagcctcctcagattcattcgactagggtagtcccaatgtaagggatagctgataataggtttgtaattactgtagctcctcagaatgatatttgtcctcatgggagt

SEQ ID NO: 501095 - DNA, 851 bp, Homo sapiens
ctttctggtgttagatcgagcaaccctctaaaagcagtttagagtggtaaaaaaaaaaaaaaaaacacaccaaacgctcgcagccacaaaggggatgaaatttcttcgggacatcctccgggcttctcccggttacggatcgtctgctccctagaagtccttcgtgaagctttttattcctaagaggagaaaatcagtcaccgggcgaaatcgttgctgattacaggagctggggcatggaatggggagactggactggcctatgaattggctaaacttaaaagcaagctgggtctctggggatataaataagcatggactgggatggaaacagttgccaaatgcaaggggactggggtgccaagggttcataccttggtgggtagactggcagcaaccgagaagatatttacagctctgcaaagaaggtgaaggcagaacatgggagatgttagtatttgagtaaataatggctggtgtagtctatacatcagattggttggctacacaagatcctcagatggaaaagactttggaagttaaggtactggcacatttcgggcactacaaagggcatttcttcctgcaatgacgaagaatacccagtggccatatggtcacctggggcttcgcgcagctgggacatgtctcggtccccttcttactggcttacggttcaagcaggttggctgctgtgggatttcataaacctttggacagatgaactggctgccttacaaataactgggagtcacaaccaaccatgggtcgggtgtcctaatttccgtaaaccacggcgcttcatccagaattccaaggtacaagtttggggaccccattcgtggaacccg

SEQ ID NO: 501096 - DNA, 1120 bp, Homo sapiens
  misc_feature (346)..(347): n is a, c, g, or t
tgggaagagagaaaaacagagggttcgattcgtgccctatttagtgttttctactcgggaacaaacgtgggtgtggtggtggtggtggtgtgttttcgtgtggtgtgggttttttaaagaaagtgggaagaagaaaaaaaatttctcgcgcccctttcctcgatctcgcttcccccctttgcggttctcttttcgaacgggttccccccttccctttttgtgggtccgtggagtgggtttgtggttgtgggctacgaagttccaaatttccgtggttgggtaactcctgggatgcgaccgcggtttccgtggtttcacaggataagagtctcctcgttatacgccnncaaaaaaaaaaacaacacaaacaaaaaaactgcggggaggcaatcctattggcgcggggaggcgcggaaaacaagagggaacagaggaaagggggcccagtggggccccatagagcgtgtgtattctcgtgtataccccgcaatttattttgtgtgtgtcaccaaagggtggggacaacactcggcggggggatcccccatattagggggggggagggcgatatatatatttgccgaataacgccccggtttaaccggcgggtttatgtacctttcggcgagaacacagttggagagaccaacaactaacaagagcacgtgcgaagcgcaacagccggcgacagagagatacacacgggaggcaatacaaaaaacggagagcacagaaccaaatacaggaggccagagagacacaagccgaaaggacacgtacagcccgcaaaattaataatttacaatacattattacacatctaaaataatttattattatattatatttaatcttaaattcaaaaatttaatcgaataaatcattcatattaaaaaaataagaaatttgatactttctttctttttaactataaatgtaataaaattattagtaaaatatagaaatgaataaacatatataccatttcacaaaacaaaaaaaaaataataagtgtttaaaataacaacaagataaaataaacatacacacaatcaatttttctttgcttatagacaaaaagactttacaactaatatattaatctacattccattatatt

SEQ ID NO: 501097 - DNA, 84 bp, Homo sapiens
cccagccccaaccagacctctctgtacttctgtgccagcagttgggacgttagcgggagggccacagatacgcagtattttggc

SEQ ID NO: 501098 - DNA, 166 bp, Homo sapiens
ctcggatcgagcgagagggactagctggttagtgccaagatagaatcttagttcaactcttatactttgcccagcagaaccactctaaatccccttggtgaatttgacgtgttacgtccagaagaggaacagcgtcttaaggacacataggaataataaccttgta

SEQ ID NO: 501099 - DNA, 1039 bp, Homo sapiens
gggaacatggggcggtatgctgcagacgtgcagagcgtgtgggcggcgtggagagccgccagagctctatcagaggggttgggtacctccagcgactgtccagaaggtgaagcagtgtacgcgccggtgtgcgaaacgcagcgctactccgccgtgctggatgctgtgatcgccaggcgccggactcctccgatgcgagtagaacgaagctgcggtcgtaccgtggtcaaggtgctacgtgtatgagtagtagtccggagaagaggtgctgttccgagcgagtgtgctggggggtcgatggaacggtctctagtggagtgacggcaccaggcgaggctcaacgggatgagtctggctcggttcacggtacatactggggcctgtgagccggagttgaggacctgttgggcaggtgggactctcaggcctggccccagcactcgccgatggtaggcatctggactaagtggcggtgtggcacggcgtctctacacgaggcgaggacgtgatagactagtacgatggacttatttgcaagagatcatggttgctcctaatcagggtcggggggtcgaagccctcgaatgactttaactacgcctctacatacagggaaggcatgtcctctctggatccgcttagatgccggagatgctggtgtgtcgccgccccatgaaagatctgaggttgaaacacccaatgtacgggggccgggccactcatactggagggacagggccaggtgactgcaaacgatgagagtggaacctcccgaagagggtcccagtgtcatgcgactgcgtgtgccggcccaggcaacaccacactcaggtggtgggcttggtgaagaccccgctctcggcctgactgggagcaggggtggatgctggcccggatggccggaagggacctgaaggaggggagaggtcgggagccccagggcaagtcatagcccacaccggggcaccggggcggaccagaaagggagcggaacacagaggatgcggaaaacacgcaaccgaggcaccacaagaggggg

SEQ ID NO: 501100 - DNA, 244 bp, Homo sapiens
atctagaggatccctcggattcaacatcagcgcacgcccatctctgtggctttctgagaggcgcagaggggtgggagagtgggagcaactgtgctcagtgaggcaggtgcctcttctccacgagtccaggtaccctctgcccgagcgtgacagctcacctttggcccaggacatccatccgctgtacgctcctggtcatctgtagctcctcctcctcagtgaacctgggacagcagggctccag

SEQ ID NO: 501101 - DNA, 173 bp, Homo sapiens
  misc_feature (96)..(96): n is a, c, g, or t
cggcagatcgccttttattctcagtgctgaggtacttagtgaattcattaatgtgagttgaaaaaggggaatagtgggagggggagattggaatanatgtggtctgatcgggagggatggtgtaaaaactgcgctccttggcatcattctgtgaaatacttgagggtcctgtg

SEQ ID NO: 501102 - DNA, 227 bp, Homo sapiens
atggctgttccagaggatccccgaagagccagttcatacaagaaagctagagaagaatatagcgtgggcagtgggtggcagtgcctcgtaggtcccagactacttgggatgctgaggtgggagaatctcttgagcccaggaagcagaggttagggtgagttgagatcacatcactacactccagcctaggcaacagagcaagaccctgtctcaaaaaaaagaaaaaa

SEQ ID NO: 501103 - DNA, 405 bp, Homo sapiens
  misc_feature (405)..(405): n is a, c, g, or t
tctggacctgccctaggcagaagggagcccagttccccgaagggtgagtctcagtacaggcagcagtcaccacaatctgactgaagagccttgagctttaagggaacattggtggcagcctggcagcattccccatggtcctgaggtggcagtgaccatgaggtaaggctcctctgcgtttggtaatggaagcgaagactgagaaggactgtgtcttgtggttcaagttccagctcagccacaatacaatagaataccaggtagacttctaaggttctttactctagtccctgactcccaggcatccatgtgcagaagaatgaaactagacccctatctctcaccaaatacaaaaatcaaatcaaaatggattgacttgaatctgacctctgactatttactacn

SEQ ID NO: 501104 - DNA, 785 bp, Homo sapiens
  misc_feature (6)..(6): n is a, c, g, or t
  misc_feature (211)..(211): n is a, c, g, or t
  misc_feature (253)..(253): n is a, c, g, or t
  misc_feature (333)..(333): n is a, c, g, or t
  misc_feature (337)..(337): n is a, c, g, or t
  misc_feature (361)..(361): n is a, c, g, or t
  misc_feature (376)..(376): n is a, c, g, or t
  misc_feature (388)..(388): n is a, c, g, or t
  misc_feature (390)..(390): n is a, c, g, or t
  misc_feature (416)..(416): n is a, c, g, or t
  misc_feature (432)..(432): n is a, c, g, or t
  misc_feature (436)..(436): n is a, c, g, or t
  misc_feature (439)..(439): n is a, c, g, or t
  misc_feature (450)..(450): n is a, c, g, or t
  misc_feature (466)..(466): n is a, c, g, or t
  misc_feature (559)..(559): n is a, c, g, or t
  misc_feature (578)..(578): n is a, c, g, or t
  misc_feature (592)..(592): n is a, c, g, or t
  misc_feature (630)..(630): n is a, c, g, or t
  misc_feature (643)..(643): n is a, c, g, or t
  misc_feature (646)..(646): n is a, c, g, or t
  misc_feature (670)..(670): n is a, c, g, or t
  misc_feature (772)..(772): n is a, c, g, or t
cgctanggagctacattttaggttaatagagcctggggcctagggccgctggggtcagggccctcagtgacgttggcagtcgtctggaacgagcccttggaacccaattctgtggagggcagggcaggggtgccgctcgcacgggggcggccagcagagggacagggtgtaaacacgcagactacacatcaatggcacggagtcacttggnaggggggctgggggggggcttgctggtcaggatctgacagtnttaaatagtttttctctaaaaagttttctagatttgcagtttttttttttttctttactttcatttttttaaaaagctangatnatgagcaggtggactgtggtttcnaggaatggtggcgtntcagcgcttctngngctttatcctttggggcctccgagcngctggggttgggggantggncangaggctccctntaaacatttggacttnggctggggcaggggctggtgttgggcaaagctgggggtccaggctggagtaagcagtggctccctccagtcgcagtcttgtgtgagactcatnatgtgcccccctccccttntcacagaacaagantatggttaaaaaccagaacagatgcccagaagggggtncatggccattgcnagnatctcagacaagggcaggcttcanacagggaggcctgtggcaacccctcccctacgtctggagctgaggggacagggggagctgagaacaaagagaggaaagaggagaaaagcggcgggggaacangcggggagcgtga

SEQ ID NO: 501105 - DNA, 675 bp, Homo sapiens
  misc_feature (143)..(143): n is a, c, g, or t
  misc_feature (223)..(223): n is a, c, g, or t
  misc_feature (227)..(227): n is a, c, g, or t
  misc_feature (251)..(251): n is a, c, g, or t
  misc_feature (266)..(266): n is a, c, g, or t
  misc_feature (278)..(278): n is a, c, g, or t
  misc_feature (280)..(280): n is a, c, g, or t
  misc_feature (306)..(306): n is a, c, g, or t
  misc_feature (322)..(322): n is a, c, g, or t
  misc_feature (326)..(326): n is a, c, g, or t
  misc_feature (329)..(329): n is a, c, g, or t
  misc_feature (340)..(340): n is a, c, g, or t
  misc_feature (356)..(356): n is a, c, g, or t
  misc_feature (449)..(449): n is a, c, g, or t
  misc_feature (468)..(468): n is a, c, g, or t
  misc_feature (482)..(482): n is a, c, g, or t
  misc_feature (520)..(520): n is a, c, g, or t
  misc_feature (533)..(533): n is a, c, g, or t
  misc_feature (536)..(536): n is a, c, g, or t
  misc_feature (560)..(560): n is a, c, g, or t
  misc_feature (662)..(662): n is a, c, g, or t
tacttcttgcacacttcgcagaaagccacgtcctttggctgagtcacgtgaacggtcagtgcaggcagccgctgtgccagagcagaggtgcagcatgctgcacaccagctgggggggggcttgctggtcaggatctgacagtnttaaatagtttttctctaaaaagttttctagatttgcagtttttttttttttctttactttcatttttttaaaaagctangatnatgagcaggtggactgtggtttcnaggaatggtggcgtntcagcgcttctngngctttatcctttggggcctccgagcngctggggttgggggantggncangaggctccctntaaacatttggacttnggctggggcaggggctggtgttgggcaaagctgggggtccaggctggagtaagcagtggctccctccagtcgcagtcttgtgtgagactcatnatgtgcccccctccccttntcacagaacaagantatggttaaaaaccagaacagatgcccagaagggggtncatggccattgcnagnatctcagacaagggcaggcttcanacagggaggcctgtggcaacccctcccctacgtctggagctgaggggacagggggagctgagaacaaagagaggaaagaggagaaaagcggcgggggaacangcggggagcgtga

SEQ ID NO: 501106 - DNA, 243 bp, Homo sapiens
gcaagcttcacgcgtagaactccatggtgggggctatctagtagaagtggttctatgcccaggtcatagctgccttcatccttcttcttcatacggtacatgagcagtaggattaggaagacggcacagaggatgcccacgatgccacccacaatcagagctgccaggacctccgctctctcacagatgctgctgcactgacacagtgctggacactagacattctgctgatccgcttaagga

SEQ ID NO: 501107 - DNA, 194 bp, Homo sapiens
  misc_feature (190)..(190): n is a, c, g, or t
ctgttgaatctctgctatatgtgtgattctaaatctttaataggtctctgagaactgctttctgaatctgggtgtctttgtcagggcatatacatttagaatagtaatgtcttcctggtgaattgagcctttttcaattatgcaatgccttcgttcttcttgatccttgtgctggttaacaggaccagcntttg

SEQ ID NO: 501108 - DNA, 353 bp, Homo sapiens
gggaataggctccaaagcactaggtgcagtgctgtagtcttagctgtacatgaacgatggctcactggatcaggctcgccctgattcaatttactggatctgtcactaccccagacgctgtcaggtggacgaactgtcacgaccagctgcgtacactagactaccgtgactagcccacatctaacatagtcagggccgcgtccatcacagacgcctggacctgatgacatatactgaccagacgcacaatctcgagaagccacagtcggggttgacacacgctcgtatgatgatgcactcgtcggagttagacgccaccagtgctctgtagatctagtctaactggcgcttgg

SEQ ID NO: 501109 - DNA, 199 bp, Homo sapiens
  misc_feature (87)..(87): n is a, c, g, or t
  misc_feature (154)..(155): n is a, c, g, or t
ttaagctccaacaagacacagaataaacttgactttcagtcaagggcagagagaggctcttccatgtcctggagttgaatgagttcnaagattggcataaagggaaaaagaaagccttacgggtatgacggggaacaagctttggagtttatcnnaacagtcacacctagtttctcttagcaacacggacacccctttt

SEQ ID NO: 501110 - DNA, 132 bp, Homo sapiens
tgttgggtatggagacaaaaaatgggatcccttactggatcgtgacaaactcttgtgtggtccccagtggggactgcactgggtacttcctcatcgagcgcggaacgaacatgtgtggcctggctgcctgcg

SEQ ID NO: 501111 - DNA, 492 bp, Homo sapiens
  misc_feature (15)..(15): n is a, c, g, or t
  misc_feature (26)..(26): n is a, c, g, or t
  misc_feature (41)..(41): n is a, c, g, or t
  misc_feature (43)..(44): n is a, c, g, or t
  misc_feature (49)..(49): n is a, c, g, or t
  misc_feature (79)..(79): n is a, c, g, or t
  misc_feature (86)..(86): n is a, c, g, or t
  misc_feature (88)..(88): n is a, c, g, or t
  misc_feature (95)..(96): n is a, c, g, or t
  misc_feature (102)..(102): n is a, c, g, or t
  misc_feature (110)..(111): n is a, c, g, or t
  misc_feature (139)..(139): n is a, c, g, or t
  misc_feature (147)..(147): n is a, c, g, or t
  misc_feature (158)..(158): n is a, c, g, or t
  misc_feature (169)..(169): n is a, c, g, or t
  misc_feature (191)..(191): n is a, c, g, or t
  misc_feature (209)..(209): n is a, c, g, or t
  misc_feature (225)..(226): n is a, c, g, or t
  misc_feature (231)..(231): n is a, c, g, or t
  misc_feature (237)..(237): n is a, c, g, or t
  misc_feature (241)..(241): n is a, c, g, or t
  misc_feature (246)..(246): n is a, c, g, or t
  misc_feature (250)..(250): n is a, c, g, or t
  misc_feature (257)..(257): n is a, c, g, or t
  misc_feature (259)..(259): n is a, c, g, or t
  misc_feature (272)..(272): n is a, c, g, or t
  misc_feature (294)..(294): n is a, c, g, or t
  misc_feature (298)..(298): n is a, c, g, or t
  misc_feature (309)..(309): n is a, c, g, or t
  misc_feature (325)..(325): n is a, c, g, or t
  misc_feature (346)..(346): n is a, c, g, or t
  misc_feature (349)..(349): n is a, c, g, or t
  misc_feature (355)..(355): n is a, c, g, or t
  misc_feature (358)..(358): n is a, c, g, or t
  misc_feature (394)..(394): n is a, c, g, or t
  misc_feature (396)..(396): n is a, c, g, or t
  misc_feature (400)..(400): n is a, c, g, or t
  misc_feature (403)..(403): n is a, c, g, or t
  misc_feature (407)..(407): n is a, c, g, or t
  misc_feature (473)..(473): n is a, c, g, or t
tgtaaaaaaaaaaantaaatttgaantaaaaaaaaaaaaancnnaagtntccaaaaaaaattgaaagtaacccaggggnttaaagngngtccaannaaaaantttggttnngggaatgggtatcaaaaaaaaaaaaggnaggagttnggaggaaaaangggggcaaaanaggggtttttttaaaacctttntaaaaaaaaaaaaagtanaaaattttgagttgcnnaaaanctgttnaaanggggnttcnaaaaaantntactgtaaacccnaagggaaagggaggaaaaaaangtgnaaaaaaaaggnggaaatttcttgaggnaggggaagaggagggaggttnaanattttnaangccctaagccccaatccctaaaaaaaaaaggaaaanangtanaantttnaataaattccctgtaaaaaaaaaggggcaaaaacccgcggggaaaaaaatttaaaaaaataaagcnggtaaatccggagttctat

SEQ ID NO: 501112 - DNA, 529 bp, Homo sapiens
agtacaagggggaacgttatattagttaaaaaaattacaatggataggactgagtataattagaagcaagcccatttttctagagccatagaaataaaaatattaataatgtgagccagcttgttgagttccagtctcaactgattattgtagttctccttctcaagggagtgttaagtcttattggaagactagaggacattacatagataatattttctccaggtcacacgttaaggatccatgattataggattgaaatattgtgcactattcaatctctagtcacccagtatgatctctgtagtcgacatggcttttctattttcagagaataaacatttcatctccactgagtatccaaggaatacaaaggataataaggctatatagcaaattaaataagtaaagaaaatgtaaatttttatgttagcaaagattgcaaaaagtatgtttagaatagattcaaaataagaccattacatactgtgtagaaaataactttttcttctgggtcaaacaataaatg

SEQ ID NO: 501113 - DNA, 374 bp, Homo sapiens
ctccgatttgtaagcacaatatcactctctttcacaagctgtgttctgatcacgttccacactttttatagcactctgtgtcaaatttccagagaccctgcctataggccaaacacttttcccaccaaagccaaagtgtgtggccctgtgaaattccatgtctcttaaaaggtccttgtgccggtgtcccatatagatagagaagcccgaggttcacagccagagagaagccaggtttcccgcgccaattttggtatgagtgtccatcgccactctctctcttcatgtgtgctctgtgtgtcctccttatatctgagtgcctctgtgctctgctctgtgtgcctagagcttcccgcgtgccgtactcgtacagc

SEQ ID NO: 501114 - DNA, 542 bp, Homo sapiens
  misc_feature (108)..(108): n is a, c, g, or t
aaaaaataaagatgttttaaaatgtttacttggaaaaggaaccatacaacaattttggaaaataagagcaaggcctggcttgtccgcaccagctccaacaactaaaantatgtggccctgtggcagaaggtggcaaagacaccactgcctggacaagtaacccggaaaccaacctgtgcataaatgtggggatttaatttatgttgagcatggcatttcagagagtgagaaacagacctttcaataagtggtattggggtgattggctgtatagttagaagacggtagagtgcgggtccgtctctcaaaaaaatgcacacacaaaaaacattaaacccaaaccatgtgagcactgagagagtatatgagagaatatttgggatctggaagtgataagtgcctttcgtaggccaaacacaaaatccttgaaggaaaagcctgacaaatctaactacagagtttttaaacatttctgtgcaatcaaagacacaaaaatgttaaacgacagcctgggcaacagagccagaccttgactcaaaaaa

SEQ ID NO: 501115 - DNA, 512 bp, Homo sapiens
agatatataagggaaactgattatctattaaaaactgactacttttcagtttagactgcatagttcattaaaacacagaggatgcctctgagtaactggtattgactcttgaagtctactacgagaagaagtctggactcggctgataaactgagaaaccaggtctggagtttcccagcactatgctccaattttcgaggaccgcgcttctatttgccagaactgtgaactcctcttttccaggactgagtgctgccatttcccagtactgtgtgctcgcataggtcacgtctgtatgcccattttccagtactgggctcctatcactcacggcgggctatcatttcttagtgctgtactgccacttctgagtactgtgctagcactttcgaggactgggctgccatgaaccaatactgagctcccattatgcagagctgtgagccctcatttgccagtactgagctcccatatgctagtactgtgctcccaattgcatcgtgcagcatttc

SEQ ID NO: 501116 - DNA, 1095 bp, Homo sapiens
agcgggaaggagaatccgcgcgcaccaggaaaagcaggtgccggtgcctgtccccgggggccgccatggccggtatccggagtcggaactgccagcgccgttgcgacttcccaaggtaagaacgcgtgcacgcaaggagccgcctggaaccataggacacaagtggaacacgaagacacgtgattccagggaatgcctacagttattcctcccatggacttactcgatgaacaagaaagagcttatagtaggctgaagacatgtgggagcagccgaagttcagtccttgctctccagctaggcaaggttactctcgaactataaccaagggttccccttcccctgagcccccatcttacaatagctgaggtggaagcggcttatcacccgagagttccgcaccccgctaaataaagctggaaagaggagcggacagtaaccctcatcacagagatggttgcacatcaattcccgggatttcaaggctcagtctgcatgattacgaaaacctctcaggcaacacagtgtgatgtgataatacgtcatgagtttccagcagagatgagtaccctagaaatcaacgtttgtggggctgctcatcgggcccagatgggaaacatcccttgaaagaaacataggagaacggacgttgcaatggccaacggatttattgacccgggggaacgaggtgtctgtgaaaagaaagcgggaaggttgggccgcaaagatggccagatgttgtcctggagaacgatgaaccacttcatgccctggttactggccagatcccatggacgaaccgtcaaaacaggcagttggaacagatacgaaaacattcttgaagcagggtatcggaagaacttccaagatggacccagaaatggatctacgcgaaagattgccagcgttcgcgaagttgggctctccttaaaagttggaccctttcggggagcaaacgatatacaggatgcttatagaaccttgggcggaggctagagaaaccgcgagcatttccacacccacaattgtgtgcccacttgtgttattggtttggcccgatggttcagcccgtaagtcccacagctcggtgtgccc

SEQ ID NO: 501117 - DNA, 499 bp, Homo sapiens
taaagatggggtgtaggtgacttcatcaagaaatggatattacttgtcaccacctttctcctcatgtagcacaccactaggggtggctaacttactgaatgcagactcagtggacacaggtttcaatagggtccaaatgaataaaccacacacacacacacacacacacacacacacatttatataatatatatggaccccacgtgacctgcctaagagaggcattggctcaatatatatcatatttgtgccccgtgattgcgcgagtgggttagatatccttttcagtatgtgacagtggataaacagtgttccgtgcacacagatgtcttggctattcgtgggtctcttgacgtgctatatgtctgtctccgtgcaatagtagggacgctagcccagggagaaacatctcagcctattacatagtattcacaacacgcactatatatgctctcttacgtagtgttgtgtgagccgtgtgatattctagaacacaaaa

SEQ ID NO: 501118 - DNA, 242 bp, Homo sapiens
  misc_feature (220)..(220): n is a, c, g, or t
taaaacactgacacaactaggctcttaactgacatagaagaaccatggactatagacttaaggaaaacggaacgactgactttcactaaacatgactgacacttggtaacgacactcaaccatactcaacaaacctactacttactaacgcccctctactaacacactgacacacacttacctacaaccacgccaactactctggacaaacggccaacgnctactactcacgactcgtaacg

SEQ ID NO: 501119 - DNA, 261 bp, Homo sapiens
tcctctaaaaggaaacccccatcccattaagcagatactctccattccttccttcctccagcccccagcaaccaccaatttgctttctgtctctatggatttatctattcttgctattttatataaatcgaattgtatgagaccttttgtgtctggcttctttcacttagtacaagtttttgagatttatttacatagtagcatgtatcaacacttcatttttatggccaaataaaattgtattatgtgtttatagcccca

SEQ ID NO: 501120 - DNA, 393 bp, Homo sapiens
ctatattcatcgatgtgacaatcttcggtattcacatatttggtagatttccaaacgtgttttcagagtccatttaaggtagatattcattgagggctatgttagatctgaaaagattactgaaattgccaacttctaataaactaggccaaggttaggttagttcccatgaacacagtgaggttaggttagttaccatgaacacatctgtacatagagaaaggtggtttctagatatagaatctaggattgctttctaccacagttcctgttgctctaggaagagaagaacagagttgattaatgtggaataaacagccatccctatttgtgagccacgattaggccctcccatattacaaggctggcatacaaaaaactatccttaggggt

SEQ ID NO: 501121 - DNA, 853 bp, Homo sapiens
tgcgcgacaaatctggtgtgtgtgtgtgcccccacccattggagagttgccctcttccttcgtggcagagagtaggggtcttccatacccgggtgtttgttccccctacgaggagggggcggcatccacacaagagaggagggtcgtgtcagacatgtttctcctccgcgccccccctcccaaccgagctggtgggcgggaattttactacaccacgagaaaccacgtcggtgcgggtgtattattctgctcgatacgggtccgtttctggtaggacaacacttcttttcccgggctctccgtctgctggtccgctggggcctcgcctagttgtcgttgcggcgggcggcgctgcctcccggcctacatctcgcccccccgtgtcacttccagataagatgtacccgcctcccctcctacaagtcctgtggtgggcagcggtcatcccagtcccccgccacgccgtgggcttcttggtggtgaggggggcgctcctcactggctatgtcctcccctggcgctcgtctttttttatgtttttctttttctttgttgtcgcccttgcctgaccgataatgagggcgggagggtcggtcgctcggtctctcggtgggcggctgtcatttttgttgttcttatttgcgcgcggcttttcggggagaagggcggcagcgatattcagctcccccccccctcggttggtgccccctccgcgtcttgttgcacctctcccccgcggcttggtgctcacattccgccgcctgttcttttttcttttttagggccccctttttttttttttggcggccccccccccccccccccccctcctttttggacccccttttcaaga

SEQ ID NO: 501122 - DNA, 555 bp, Homo sapiens
tgccaccttaatacatttgatgtcttccctagaataccggttatattggtgccaactcgcctttgttgggggcagattgagtgcccgcagcccccgaccctacaggtggatttttttatggaatttttgcccaatttcccccccctaaaggaggctatggaaggaagctctactcccgtaaagaactaagacccgtggttaacatgaagaaaaccttttgtttttgccccctgttttttgaatgggcccccagggtttatgttcttttaaccaccccccgaataaaacatgttcccttttttttgtaaaattgggttgagagggaactaatggggtttccttggaaccgtcctttgtaatttaaataaaaggattattttcccaaaccccggggttttttttgataatttcccgatttagctttttttttgttatattaactgctagcccccaatttttgttttgttaaagggtccccttgcccagaaaaaacatactgtcttgttttttttttttagcatagacttaactgaattaaaatggtgattcccggga

SEQ ID NO: 501123 - DNA, 370 bp, Homo sapiens
acctatggtccatgggcaaatgctggacccaacacaaatggttcccagtatatccgatctgcactgccaagaactgagtggttgtatggcaagcatgtattgtttggcaacgtgaaagaaggcttgaatattgtggaggccatggagcgctttgggtccaggaatggcaagacctaggcaggaagatcaccattgctagactgtggacaactcgaataagttagacttgtgttatatcttaaacagcagatcattccttctgtagctcaggagagcacccctccaccccatatgctcgcagtatcctagaatctttgtgctctcgctgcagttccctttgggttccatgttttccttgttccctcccatg

SEQ ID NO: 501124 - DNA, 445 bp, Homo sapiens
  misc_feature (206)..(206): n is a, c, g, or t
tataaaagaggtaagcggaaggggcctttagcggtttgtttttttaaaatttcaggcacgaggcgggagctggagagctggaccccagagatgccctgagcagccccacctgtcgcctgccggcctagttaccatcacaccccgtggatgtgagcctgcagctgcctgcagcctggccccagtcaccaatcacctgcaaaccagtngatgcatgctgatgtgctcgaagtaacccctaagacaagggcccgtggccagaaccgtaacgcaacctgtccgggaagacggtaccgcaaccggaccaccacttcagatagcgcagccatgcgccgtgaaagtgcacacaaaagacaacgacaagagtagcgagactatactgatggggccgaactatagggactgcagaaatgatgataagtaaggtagattgagtatcaactagacg

SEQ ID NO: 501125 - DNA, 887 bp, Homo sapiens
  misc_feature (53)..(53): n is a, c, g, or t
  misc_feature (62)..(62): n is a, c, g, or t
  misc_feature (78)..(78): n is a, c, g, or t
  misc_feature (80)..(80): n is a, c, g, or t
  misc_feature (102)..(102): n is a, c, g, or t
  misc_feature (120)..(120): n is a, c, g, or t
  misc_feature (138)..(138): n is a, c, g, or t
  misc_feature (142)..(142): n is a, c, g, or t
  misc_feature (149)..(149): n is a, c, g, or t
  misc_feature (155)..(155): n is a, c, g, or t
  misc_feature (170)..(170): n is a, c, g, or t
  misc_feature (181)..(181): n is a, c, g, or t
  misc_feature (190)..(190): n is a, c, g, or t
  misc_feature (237)..(237): n is a, c, g, or t
  misc_feature (239)..(239): n is a, c, g, or t
  misc_feature (242)..(242): n is a, c, g, or t
  misc_feature (253)..(253): n is a, c, g, or t
  misc_feature (300)..(300): n is a, c, g, or t
  misc_feature (317)..(317): n is a, c, g, or t
  misc_feature (356)..(356): n is a, c, g, or t
  misc_feature (422)..(422): n is a, c, g, or t
  misc_feature (450)..(450): n is a, c, g, or t
  misc_feature (562)..(562): n is a, c, g, or t
  misc_feature (588)..(588): n is a, c, g, or t
  misc_feature (591)..(591): n is a, c, g, or t
  misc_feature (665)..(665): n is a, c, g, or t
  misc_feature (667)..(667): n is a, c, g, or t
  misc_feature (683)..(683): n is a, c, g, or t
  misc_feature (735)..(735): n is a, c, g, or t
  misc_feature (778)..(778): n is a, c, g, or t
  misc_feature (781)..(781): n is a, c, g, or t
  misc_feature (851)..(851): n is a, c, g, or t
aatctgggacccactgccccacccacgcaatgtgcgtcccagtcctgggggcnggcggaganagggggggggtgagangngaagagccccgtgcttcctcantgctggggggttggagangcgcagcccccgttctgnggcnctcctcngggcgnctaggaaggagagcngatgaaatctnagagcctgnggcttctccacaccactgccccccaggttggaggggagctaagagangnganaaggggggagnggcaagaaagagatgattgatcgaagaaagatgagaatcaggggtgngggctgaagagagaatnaaagataaaataccagtttaaaaaaaaaaaaaaaaaggnggggggggggtgggggagagtggaggaggggaacaaaacacaaaatccaccccaaatccgaaccancctgggaaaaaatgaaagttctcgagtntcacggggacattatttggcgcggcaagctctgcggcaggagcgctcaggcctcagtccagccctggaggcaggcctctctacagctcgtccttggcctggccggggacatnttcctcctcatcttcctccttgtccnccncatcctcctcatcctcatctttgtcctcatcatcctccttgtcctctgcctcctcctcctctttgcgtttcttntnttcttcctcctccttnagcctctgctcctcgtcctgtttgtccttcatttgtttctctgctgcctttnttacgccccacgtctcgttgccaaactcctcagcgtatgcttnatngttggtgatgaggaagttgtcaaagatggtgccagacttgacctgccagaggtccaggcccagcacgccnaagttatcataggcatagatactgggatcgggagaa

SEQ ID NO: 501126 - DNA, 944 bp, Homo sapiens
taaatattatactagcatataccatctcacttctaggaagtactaggatatcgctcacacctcatatcctaccctactatgccgtagggaggaataatactatcgctgttcattatagcgaactgctcatgaccctcaacacccactccctcttagccaatattagtgcctatgacatactagtcttagccgcctgcgagacgcagcggtgggcctagacccgtactagtctcaatctccaacacgtatggcctagacgtatgtacataaccctaatacctagatccaatgctataaagctaatcgtcccaccagagttatgagttcacataccagctgacagtgactgtccaacaaaagacataatttgagatcaataagccaagccagcgccacaggcataagttattagctatcatcccttcctacatattttgttaaccaaatcaaagaactaaggtctatttatgctgttcgccacaccttttcctccgaccccgctaaataaaaccctcactctcgtaataacctaactagcttgagatcctacaccccgtgcgactaatgcaataggcaaagctcattgcgccaagcttatcacaagtgaaccaagttatcacgaaaaaaatgctagctctctatattaatctcactactaatctccttaaggatcacgatggcacgagcatcatgaccctattcagtgtgcatgatctgctatcggaaacaaccactgtatccccatccttggcgtatcagtcaccccgattgatgcaagccagccagaaggcctgcttggctggggcgatactatcgctaatctaagcctagtgatgctccctttccgtaacgtgggctaatgtgttgcacaaaacctgggttttaacctttaaatcactcctggcagataggaccgggcaaacataatgtgttagcagtaagga

SEQ ID NO: 501127 - DNA, 148 bp, Homo sapiens
tccggttactctagacgactccctgagacgaccgtgttgcatgaaagacgaaccgactttaactttacttttcccctcaaccttgcctgctctctatgccacgcgcgggaatgcctcagcaacagaacaatgtctactggagtcacta

SEQ ID NO: 501128 - DNA, 836 bp, Homo sapiens
ctccacggggtcccgtagccccggcccgcagccggtctcccggcctccgaggctgccggctcctccccctgcgcatcccagtgtcctgactagctggccctgagctctggagcagcccgtgacccacactaagaggctttgaagcccgaataaaaatatagacacaaaacaccagaacaactaacaagtactgatgtacgcagtacccttactctagtccttcgtacctcgcctacgacatacatcgccgcccgcccgccctacagtctttagtgcgtccagccagctggctctcatactcctcatcctcatctcatcacacccactaaacactctctcacctctcgcacacacacagccagacacaaatccaccactacacctatacacacatataatccacgcccgcatcaacactccacactcacgcacacgcatctaaccatcaacacatcacccagcacccaccaacgaccagaaaaaccgaccaacaacacaacacgcgcccagccatccaccccatccgcccaaacgaaagcaacagcgcaggacacaacagcagagatccctaagacgacataatcagcatcatcacacacaaacaacaccacaacaacttgtccctatcaactcgacgcaccactcaccaccaagacaacagccacaagacgaaaccatcaaccgactccagcaaactaccaaccaccgaagaagcagaacagtcacaagcacaacaccgatccactccacaaatactacagtcagtaacagctactcattgctacactcgccaactcgcccaacgcacccaactcacgacacagcaagccagacgg

SEQ ID NO: 501129 - DNA, 584 bp, Homo sapiens
  misc_feature (52)..(52): n is a, c, g, or t
  misc_feature (54)..(54): n is a, c, g, or t
  misc_feature (71)..(71): n is a, c, g, or t
  misc_feature (104)..(104): n is a, c, g, or t
  misc_feature (107)..(107): n is a, c, g, or t
  misc_feature (112)..(112): n is a, c, g, or t
  misc_feature (122)..(122): n is a, c, g, or t
  misc_feature (484)..(484): n is a, c, g, or t
  misc_feature (506)..(506): n is a, c, g, or t
  misc_feature (531)..(531): n is a, c, g, or t
  misc_feature (560)..(560): n is a, c, g, or t
aagatggcggagaacagcggtcggacggcaagagcagcgggacgcagccgcngnagggggcggtgtcccangagcaggtgattgctggcttcaaccgccttcgnaangctcngtgagcgggntgcatccaaagcagctgagttggagatggagttgaatgagcacagcctagtgatcgatacactgaaggaggtagatgaaactcgtaagtgctaccgcatggttggaggagtgctggtggagcgaactgtcaaagaaggtgctgcccgctttggagaacaacaaggaagcaagatacagaagatcattgagacactgacacagcagcttcaggcaaagggaaaagaactaaatgaattcccgggaaaagcacaacattccgtctcatgggaagaagatgagaagccagcagccaaggaaaactcagaaggggctggggctaaggccagctcagctggagttgtttggtctcctagggaccaanggcctttgcattttttttctanccctgacttcccaattctaatttcncctttattgttaattattaattaatttcnccggcaatggtaaaattttttttt

SEQ ID NO: 501130 - DNA, 228 bp, Homo sapiens
  misc_feature (36)..(36): n is a, c, g, or t
  misc_feature (118)..(118): n is a, c, g, or t
gcattatactggcaggacagcctcttctcagcatcnggtctaagctaaagtgcagctcctgagggctccccttcccatcagcccctttccacacccttctctccatttgctccccctntggagacaggatgtcactctgtcactcaggctggagtgcaatggcatgatcatgactcactacagccttgaactcctgggctcaagagacccttctgcctcagcctcctg

SEQ ID NO: 501131 - DNA, 90 bp, Homo sapiens
attcccttaggacttcgtcagaaactccaccctgtgtggaatctccttcctctctctctcttggaggatgcacccgaattcgaattgtga

SEQ ID NO: 501132 - DNA, 203 bp, Homo sapiens
tgtggctatcctgtgctcagcacctggactagtgcatcttgcttgttaaagggaccatatgtgggtggtgcgtagtcttggcaggtgcagtcgccgtactagagtagctcgaggggccagggcccagagcagtggctatggagcttccagcctgagctgggctgtctgccaagtggcagccatgagtcctgcatgggtaccat

SEQ ID NO: 501133 - DNA, 325 bp, Homo sapiens
aaatgttcacaccaacatagctggaggccccaaagactgataaatatgtaatgtataagctcaattacatgatgttgttaacattaacagttccaagattaaattcaacaggtgggactaatccccagcacctgaatttcacaaattacagactgtctgcaagagatcgacttgactaatatggctgcacactgaattaccgttgcaaataaaccactgagcgctgttggacgagatatatgcctggcgcgtcaagtcataagatgatcgagaggtgtggaggatacaagagtcactatgcatgggcacattctctacttgctct

SEQ ID NO: 501134 - DNA, 800 bp, Homo sapiens
gcctgggcgacagagggagactccatctcaaaaaaaaataaaaaaaactccttactgaggtgttggcccagtggcccaatcccaggccctggcccagtcttgagggcaggcagtgttgtcactgctttgctctttgacctgtggttactgcttcccaagggccaggcttgttgcatactcactagctttcacgcagcccacccagcagcagcttactctggccctgcctagaaaggcagaatgcaggaaacctggctttccgggtttttttctttccctttttttttttttttgggtaaaaacggggtttggctgtgttgcccaggcgtggtctcacacttcgttgggcctccagaaattccccccacctcggcctcccaaagtttgggaatttacgggtgtgtggcttagcgcccagcccaggttttccttttcttctccccaccacaaagagccttctccgaacttgtgggcgtttgcctcccattttcctatacccctttcccatccagtggctggtatgtggttaggatctcagaaacaggcagaaaattaatctaccgtgatatacagaaatctcatatagagtggattctcggccgtgtcgtgaatcaaaacacaagccagtgtgcagtgcatgcctggtggtcccagcatactggggaaggtggcttgagaggatcacttgagcccgggagtcccagtccagcctgagcaacacagtgagaccctaatctctaaaaggcgatataaaacaaaaaaaacgccaaaaaaaccaggatgtctcccatttggattca

SEQ ID NO: 501135 - DNA, 357 bp, Homo sapiens
cccctgtgacgacactgactgtcactctgtggctgctccgcgtgtccagtgtctgacgggctgtgccgagccatggaaccatgggaagacctttacttgcagtgctgcctacccctgagtccacgacccctgataaccgccaccctctcaaaatccggaaacacgttccggcccgaggtccacctgctgccgccgccgtcggaggagctggccctgaacgagctggtgacgctgacgtgcctggcacgtggcttcagccccaaggatatgctggtacgctggctgcaggggtcacaggagctgccccgcgagaagtccctgactagggcatcccggatgcaggtgtgggaggtaccg

SEQ ID NO: 501136 - DNA, 138 bp, Homo sapiens
agttattcttatgtcagtttcttaagcagttatctcttaatcgttaaaagaaggctagcagttgtttcacaaaaaggttggtgattcccaccccaagataggtaataacgctaccttcttgtgagtaaccgttttatt

SEQ ID NO: 501137 - DNA, 251 bp, Homo sapiens
gcagacgtgttgcaggccgtaactgtagcgtgcgtcggctgcgacttccgctgcgcgggtctggatcttttcatcctcgagacaggacaagatgcagttcacggcttctatctggggtaaagagcttgaagagcccctcacaggccaagaaaattcagctgacgtttcctccagccttctgtatcctcatccgctcttcatactgagtaggattatgctctttgctgtatacaacggttcatcgggggtac

SEQ ID NO: 501138 - DNA, 272 bp, Homo sapiens
gctcggtaccggttcgcatgttccctggagactcatgtcgttaccactcaactggaagctgagcatggcttattcctctgatggttacccatgccaggcgcacctctccatgtccaatgttctttctttatttgtttgtttgttctgttagtttgtttgtttagagacggagtttggctctgttgcccaggctgtagtgcagtggcacgatctcagctcactacaaactccgcctcctgggtacaagcgattctcctgcctcagtctcctga

SEQ ID NO: 501139 - DNA, 403 bp, Homo sapiens
  misc_feature (66)..(66): n is a, c, g, or t
  misc_feature (161)..(161): n is a, c, g, or t
  misc_feature (212)..(212): n is a, c, g, or t
  misc_feature (276)..(276): n is a, c, g, or t
  misc_feature (288)..(288): n is a, c, g, or t
  misc_feature (331)..(331): n is a, c, g, or t
  misc_feature (336)..(336): n is a, c, g, or t
  misc_feature (343)..(343): n is a, c, g, or t
  misc_feature (345)..(345): n is a, c, g, or t
ccccaaaaacccccccccctttttttttaaggggtgtttgtttttaattctccttcagccctcaangggtttctcatttttgaatcaacatcttttccttctgtccctccctttctccatcttttggtcactaccctccaactctaggaacaggggtgtanaggagaagccctaggcttgagatttcatctgctctccttcctgcatctcanaggagggcaggagaagggggtggtgttttccctccccccgcactgaggaagaatggggctcttntcatcccctttntcccttgcccccaggactgggccacttgtggggcagccagttntagcncagctcncnctgagagtgtaagaactacaaacaaaatttctattaaattaagttttgtgtcttaaaa

SEQ ID NO: 501140 - DNA, 184 bp, Homo sapiens
cgtgcaagactccagaattgtaggcatgatgaagactctgctgctgtttgtggtgctgctgtgacctggagagtggcaggtctgggggaccagacggtctcagacaatgagctccaggaaatgtccaatcagggaagtaagtacgtcaataaggaaattcacaatgctgtcgggctaggcgggg

SEQ ID NO: 501141 - DNA, 178 bp, Homo sapiens
ggtcctacgagtggaactggaacctcggtgtgtcggacttgagcttaagcgaagtgcacgtgctgaggcctgccagaacgcccctgccatgcacaccagtaaaccctgtacctgccacgtgtcctgtgcctccctagtggtgtactcctcttagatgtcagcacctgcacggctatgc

SEQ ID NO: 501142 - DNA, 708 bp, Homo sapiens
taacaatgttactagttataatttattctatgcattttataaaataaataaagctttaaaaaaatgaaggtgtgatgggttacagcacaggagaggtgtcctggctgaggcatgcttttgtggagacccccagtggggagggagggatgggagctgagggccctgccttctcccctgcaggaccaagcatccccagtcttgcacttgtgccagatgaatggaatggggtagaactgggccctgcagctcctagctctgctagatggggcccctaaaacccatagcttggtggccacctggcctggacctaggtgaggggacatgtgccccctggtgctctgggtctcacaatgaggcaggctgtttggcccccacccacaatttttgtcccatcatgggtcctccccacagttggggggggggagggtccttcccgtcaggacaagtcgctggaggcgcaaagccaggatggcagaccagtggtcggaagtgtgggtgcctgcgcttggtgtgcggtgccccccggtgccctatagcccgtgagccatgtgttgtctcatgggcccgcctctgtcacccctccagacctggtggcccacccgatcacgcgctctctgcgtgccagccgcggcgtgggtcccttaggtcctggcccccttgttccgggctgcccccccgtgtccccgaaggatccgccgtgtgctgggc

SEQ ID NO: 501143 - DNA, 684 bp, Homo sapiens
ccctcagaggctgatgggagagaaggtgagaggacaaagcaaagacaaacaggcccccacctgcccaggtggagagggcagagaaggcaaagtgggccaagaactttgccccaccacaatggcatcttttctttttttattatttttttttatttttgaggcagaatctcactctgtcgcccaggctggagtgcagtggtgcagtttcagctcactgcagccttgatctcctgggctcaagcgatcatcccacctcagcttcccgagtacctgggactataggtgcgtaccaccatgcccggctaatttttgtatttttttggagagacagggtctctccatgttgcccaagctggtcttgaactcctgggcccaagctatccgccagcctacacctcccaaagtgctaggattacaggcgtgtgccatcccacccagccaatggtttctttcagaagcaactgaaaagccaggcacagtggctcacccctgtaatcccagcactctgggaggccaagacgggcggatcacttaaggtcaggagttcaagaccagcctaaccaacatggtgaaatcctatctctaccaaaaatacaacaattagccagttatggtggcgcacgcatgtaatcccagccactcgggaggctgaggcaggagaatcgcctgaacctgggaagcaga

SEQ ID NO: 501144 - DNA, 340 bp, Homo sapiens
gcaagcatgtagttattaagtccattacagtgcacattcattgactctgtgtatcttcacagtgtgatcttctccatccactgcaattcttcaagcataattctctgatagccagtgtatgactttggctttgacttgtttatacacagtgggtccagtcatttatttcgggaacttgaccagtctttttccaggtatataaccaaatctttccacactccatatcctactgcatccacgtatctgtttataagggaggggcaccacagtcattatcttagcatgaaattgctatcttcgtcagtgctctaaagtagttcttcacagtgtcccaactgtc

SEQ ID NO: 501145 - DNA, 185 bp, Homo sapiens
ccagcgcttgttggatggagagaagtatatggtaggaaaacctctgacttcatatggagaaggcacatcattgtgctgtgtgcctccatcttgagctatgacgatattatgggtctttgcatgagctactcgccaagatactttactacttgtgagctccagtgttcttacagatgaccacacca

SEQ ID NO: 501146 - DNA, 1854 bp, Homo sapiens
  misc_feature (278)..(278): n is a, c, g, or t
  misc_feature (920)..(920): n is a, c, g, or t
cgagacgcgtgagagtccagagtacactatccagacattgcgtaagcttgagttacgtcaagcaacacgtatggactggagatcgaaccatcataagttatgttagagcatgtccatatccagggtaataacgtagcccttgcattatacgagcagtaagcagatactccacgcggggtccccagaagcgtcggtggagcctgatagtcattcaagtgagtgaccctagacagagagtaagctcgtgtgtctgttgctagagtccttggctctccagngagtgtgcacggtggataacacgtggcaatgctttggcatggatgtgtagatagactttggacagagtggtcgctagaggtggagaggtgggagatgggacattggagagtggacaggtagattgtattaatccatattgtgctccctctttctcatgtgcacgtgaagagctctacttcaggggggaagaagatgcagtgggacacacatgatatcatcgcggagacgcaagggatgctgtgtctccgtagagggcgcgtgcgtagtgtgctctagagcagaagatgctcagtggaatgtggcatacacttctataacgcattataacttcacgaggaagtgtgcgtagaatgacgaatacctagggggtaagacaaaggttgcctggcttgtgggatcagcacctggtgttggaaagttgggacgaccacggggctttttgtggcaccggagcagaggtgtgggggcgcgggaacaaaatgtgggtaagagcacctcggacgatgtgggggaatattattcggctaaacgcggcttggacaggaagttttcaaccaagaagattgtagacagcaggggacagttggtaaatgttctcgatttcctctttatattacaacagtagcaggtggaaaacaatntataacagccacggactatactcaacgtgggcgtgtgccgtggttcgcgcacgataatggtccttattgatgagggcaataccctataagatcaatcaacaatacacgaagaaagatgaaggaagaagatcgtgctgccggaaaaagttgtgccctacacaaggtgggggtgtttatcaaccttgtgggcgttttattatatgtcagatggttgtaaaaacagatgggactgccgaagaggagaacacctcgtgcgataaagtaggcggagtatgaaggtgaactatggcattcatttaatgtatattaaaagcgaggctttttagacgatcgctaaatcgtgaggtagaggcgcggttaggtgtacaaaaatattaataatagagagaagacatatttcgggcccaaacagacatattgggggggggacttaataaaccagcggtgagccaccaaaaaatacaaaagtaggggagcgagacaaccaaattgtgtgccacgaaaacaaagagaagtgggttaccacacgccgtcgttgtgacaacatcaacatggcacaggagaacgctgatgggagtcagcaacacaaaaactacatgagagtgacggcacaagaccaatcaatcacaacatacaatgctacccaccaaacaagactgagtgacagataaaactatgagccaccaacagcatgcagaacaaaacacggtgaatgcgtgaacggaccgcacatataatcaacagcaatggccccagacaggcacgggctgcaaaaaaacagcgcacgagttgatagtagaagcatctccacagcccagcgccaagcaatataaatgatgagtatgccagcaatagtagacgaccaacaccacacagagacacgagcgtccaccaacgcggcaggagtgcagagaccagccaatagatgacccac

SEQ ID NO: 501147 - DNA, 468 bp, Homo sapiens
  misc_feature (26)..(26): n is a, c, g, or t
  misc_feature (234)..(234): n is a, c, g, or t
tgccccctcttttttccccccccagntcctcccctcccctctttctccccaaatcccagaagtagatctaggaatctgaaaaattcccaccttggcctacaaaacagcactgaagtctctttgaaacagccttgtcccataaatccttagattgtttttccatctttgaaaaaagttacttctggccccagcacggtggctcatgcctgtaatccccagcactttgggaggcanaggtgggcggatcacctgaggtcaggagttcgagaccagcttgaccaacatggagaaaccccgtctctactaaaaatacaaaattagccaggcgtggtagtgcatgcctgtaatcccagctactcgggaggctgaggcaggagaatcacttgaacccgagaggcggaggtttcggtgaactgagatggcgccattgccctttagcccgggcaacaagagcaaaaaaccgtctca

SEQ ID NO: 501148 - DNA, 363 bp, Homo sapiens
aagctttctaaaagggacgtcatagttagtaaacacctacatcaaaaaagactacaggaagacctgcttgaggctgttttacaggttaccattttgtttaacaaggagaaggagtacactctaaaaacaatgataaaagtataatatagtagatacataaaccagtaacatagtttttattatcattatcaagtattatttactgaatataattgtatgtgctatacttttatatgactggcaatacattaggttttttataccagcatcaccacaaacaccttagtaatgtattacaatgtctacaacatcattaggctataggaattcttcagctccattataatcttatgggaccactgt

SEQ ID NO: 501149 - DNA, 626 bp, Homo sapiens
gggcctctgctgtgggctggctgggaatcctgcgtgacatctgggtcgggtctagtgctcccgatgtccgctgctcctgggcgggatgcccttgtcttggtgtctcgctggtggtggctgccagattgctgtagtgccacactgactagttccttcttgtctgcttttcccatgcaaattggctggatgactgccgtgtgcatgctgtgtggtgtgtgccctgggggccctggtggccctgggatggggaacctgcggtggcttcctgctggatggtttcggcagttggcatcctggtggcctggtggtcgctggcctgtggactggggcctggggcctgagtgcctgctggagctctgctggagtgcaatggccgatggataacggatgtggatagccctgtcaccaatgttgggcctgcttggtcaaggacattgaagatcaatgtccctgggagggacgaatctacttcttctttcatccccttgccaccaatttaagacggggaacttcatcgaagaagtccatttgggaattttcgccttttcacctttgtgtgggtggccatatcttcttccaatgggattgagggtttttggacacggactttaatagcccaagttgca

SEQ ID NO: 501150 - DNA, 342 bp, Homo sapiens
ctgaggatcaccggcagaacacactcaaggaatactatataggacattcagattcagatttcagatccgaatgctcagctggtaatgggataccgatattaccaaatggcaataaatctgaaatctggaacacttatggtccccagccttttggggaagggatactccacctgtatattatggactccagtctttcatccgatatatgatttggcaatatgttctccccactgggtggtttggtctttttgttttttttaatgggtggtccatatggaagtaccacaagtttacttttaggtaaaggtcccagttccatccattttttctccttttatagga

SEQ ID NO: 501151 - DNA, 671 bp, Homo sapiens
aaaaataccaccgtgttcattatgccattggcccacccgaattggacattagaaacttggccacatattggtttaagcggggaaatccacgagttatctccaatcaggaccatgcctaaaggtcggccagtaaatcgatcataaacttagctatagggacattttgtttacagtccccacctgagcttagtgcacaagttagcatcgatagaaacggttatgagcacatatgtacggacataatgtacctttgttacacggccagatatcaccctctcgggctcaggagctcctgcgacgtcagcctcctggtagtgttaaatggtcagcgggtgtgcaggtgtgcgtggcatgaagatacagtactcatcctacatctgagacatgtgccgtgtagatgcaccatgcctgtcaagcagcttatgcccctgctcaaacggcgtgatcattagatcagatatcagccgttgtcattagaggatcttcccttccagttgtaccattcccatatttagaataagcaccatatgtagtaatgataccaacctagaggtccccaaattgtatgcaccatatgcatgtcaggaactattatccattcatgtgcagggcatcaatttcaagtattccccaatcttctgaagaatacagatagctagagaactcgagat

SEQ ID NO: 501152 - DNA, 762 bp, Homo sapiens
gctgaggtgggcgaatcatgagatcaggagttcgagaccagcctggccagcatggtgaaaccccatctctactaaaaatacaaaaaattagctgggcgtggtgacgggcgcctgtaatcccagatactcaggaggctgaggtaggagaatcacttgaacctgggaggtggaagttgcagtgaaccaagatcacgccactgcactccagcctggccgatggagcgagactccaactcaaaaaaaaaaaaaggaataaagaaagaaaagggcgattgcccagttcaattcacaaattaagaatcatccgggttaaaaaatctactctcacatggtggattcacagttataaattttctagtgtgcgggtgtttgggtccgttggtatttgggtaaagagtggggctctcgttttggtcgcccaggccgggttttggaactccgggctttcaaggcgaatcctccgtgtctcggcctcacaaagtgttgagactacgggctatgagccatggtgcccagcctgtcctaatgttttaaagctacacgaggaatttttttaaataaattctcacggttggctcagtctggtctccatctaaagttgtgtgttcgcagttctaacggttaagcgtgcacttttaagggccactttccacctgagaactagggtaatcatctttacttctggtccctgaaatcattttttcccatgggaacctccctccagtgggctgtggtttgtgagcattgcttccagaaacacta

SEQ ID NO: 501153 - DNA, 1066 bp, Homo sapiens
  misc_feature (56)..(56): n is a, c, g, or t
tcccgagcaaaaatctggttaacagtttaattttttttaatgttaaataccagggngacaggcattgttaaggcatgaaacaacactcagtcaacaacgtgcctcacagagggataagaaaaaattctgccatgaatattagcaagaggtaaaggaggaacaaatttacacttgtaagaaggcaccatttccccaaggaatacctctgggcatattctccgtgaaagtgaagtgtggcgatttcagccaactcttacactataaactctattattctcaaagacaggttcacaccagccacacgagaataacacatatttcacagagcggctatcttatctcacaacacacaaacaaacaacaacacaaacaaaaaaacaaaacaaactaaaaaaaaaaaaaaacaaaaaaaaaaaaaaaaagaaaaaacacaaaaaagaaagaaaaaaaaaaacaacaaaaacaaagaaaaagaaaacaaagaaggacaaagaacaagaaaaaaagaaacaacaaccggagagagagaggagggggcggaggcgcgcgagcacagacgcacacgaacaaccggaggggccggcgcgagaggagacaacgcgacagagaatcgcgcgcgagagcgaaaagacgaaggcgaaggagaagacaagagggcagggcgacggcaggcggaaggcagtcatgggaaggaggaggagacaagaaggcgagcgaggaggaagcaaggaggaagggaaggcagaggaggacgagagtgggaggcgcgaacaggagaagaaggacagagcgacacctaggcggaagggaggggaggtgaggcgcgaacgcgagggggacaccggagcggcagtgggtggcaggggaacaagcgagagagggagacggcacagcgggccgaggaagaagaaggaaaagagggaacgaggaggcagagggagaacaaaaccgaaagagcgagagcggagacgagaaggaaaaaaagaaaaagggggagagcaaggagagagaggagacgagcgagacagggaggaggagacagagaagggagagaaaagggaaggga

SEQ ID NO: 501154 - DNA, 246 bp, Homo sapiens
agaggatccccaggttggctgatagatggagcgacacttacccaagtttgataaagatcatgatgtaatgttatttttgaacgaatgtatgatcccgaaacgcggagcttgaattactgtgccggcatatctacacaccacatatcctgtaaaatacgtgacttgctcccagcttatgtgtgacagacgcaggatttattcaacgatactaggccttactcctctaagagcgaacgttcaacgcga

SEQ ID NO: 501155 - DNA, 450 bp, Homo sapiens
  misc_feature (47)..(47): n is a, c, g, or t
catatgtctctatcagaaaatcagatcaagggaagtagcctggaagncacttcacgtactaaatgaataagaagaacttgccatctaaggaaaggggggatacggaagagtatacaaggtcaggaataaatgagatggtcagtattatgcaataaaaaaaaatccggatgaggggtgcaactaaaacagttggcatgaaggtcctacgggaagtgaaggtgcgggcaggtcttcagcaccccaatatggtgggctatcacacggggtggatagaacagtgtcatgtgattcagccacgagcagacagagctgccatggagtggccatctcgggaagtgctctccgaccaggaagaggacagagagcaggggggtgtaaaaaatgatgaaagtagcagctcatccattatctgggctgagcccacccggtcggggggagcgggaaccggag

SEQ ID NO: 501156 - DNA, 803 bp, Homo sapiens
  misc_feature (5)..(5): n is a, c, g, or t
  misc_feature (147)..(147): n is a, c, g, or t
  misc_feature (151)..(151): n is a, c, g, or t
  misc_feature (248)..(248): n is a, c, g, or t
  misc_feature (261)..(261): n is a, c, g, or t
  misc_feature (263)..(263): n is a, c, g, or t
  misc_feature (272)..(272): n is a, c, g, or t
  misc_feature (288)..(288): n is a, c, g, or t
  misc_feature (298)..(298): n is a, c, g, or t
  misc_feature (333)..(333): n is a, c, g, or t
  misc_feature (367)..(367): n is a, c, g, or t
  misc_feature (377)..(377): n is a, c, g, or t
  misc_feature (381)..(381): n is a, c, g, or t
  misc_feature (394)..(394): n is a, c, g, or t
  misc_feature (489)..(490): n is a, c, g, or t
  misc_feature (508)..(510): n is a, c, g, or t
  misc_feature (600)..(600): n is a, c, g, or t
  misc_feature (783)..(783): n is a, c, g, or t
tacanacataatcaccaggtctgcgctggccgaagacgaagcgtcctccctggaggtgggaacaagtcacctctgaccacacctcctctgacgccatcacctcctcctggccccacccaagggctcgacacaagccccaaggtcggngggngaggggcggggcggaaccgagggcggaggccaaggtgggattccaggaaggccttccgaagatggaggtgggatcctgtccctccaggtagcttgtnggtgatggacagnangacttgctngctcagtgtggagacnaaggacactntgccactggattgaagtgagtggtgagggattggnggtggctccacagaggcatccatctgcatggacntggccctatngatncagcaggctgccntggctgtggagtaagcccacggaaccacatgagcttagtggggccgctctggggcaggggctctaacaggacagcatgaaaactagatccgcctnntgagggacaagccaggtnnngagctgtggtgcaatttgctcctgtccctggaggtctgtgggcggaactgtgggcacaggtggacatggctgtcagacgtggggtcatangctcccactccccagctcctgcctcctcacagacagaagccacggccaaggagaggagagacatggggaaggcagagatgagggaacaggaagggagaaggcaatgaggaaagagaaagggagggtaagatgcggagggcacaggtggatggggacgagggggccaagcatggacagcagggnggggagaaggcggaggggcc

SEQ ID NO: 501157 - DNA, 298 bp, Homo sapiens
tgaaatggagtcttgctctgtcgcccaggctggagtacaatggcgtgatctcagctcactgcaacctccacctccccggttcaagcgattctcctgcctcagcctcctgggtagctgggattacaggcgcgtgccaccacgcccggcatgagtggaattttagtgttaaatctcttcctgggccttttcttcatagtcaggttcctggaaagcaactggcttgtgtgggtgacacagatgatccaaatcccatgcacattgatcatgatcggaacatggactgggtttccacccagct

SEQ ID NO: 501158 - DNA, 340 bp, Homo sapiens
ttttttttttaaccccccggttgcccggggggccccccccccgttttttttccccccttaaaaaacccgggggcggttccccccccgggttttttctttggggggggggggggtttccttttttccccggggaccccttttgccctttgggcctttttgggggcccttttaaaacagttttttccaaaaaaagggggggggccggggcgggttttcccgggttttttttacccccggggggggccccggggggcgcccccggggtcgcccccgggggccctttggggggggggttttttttttttttttaaaaataaagggaaatttttttttgggggga

SEQ ID NO: 501159 - DNA, 181 bp, Homo sapiens
tgattagaggatctacaggagagagaactggattttgggagaggaggttgtggaagcccaatagtttatttcgttttgggagtgtatatttcctcttgctggagtacacaaatagcagggggatgcgatagagggaagggtcatgaccccaaaggctagccaagtcagaaaatgaggggag

SEQ ID NO: 501160 - DNA, 336 bp, Homo sapiens
  misc_feature (288)..(288): n is a, c, g, or t
  misc_feature (333)..(333): n is a, c, g, or t
taaacttgacattgggggtcccccactccaactttgctttttgaaggttttggtgtacattgagccccaaaaggaaaggagagtatttgtgagtgggggcctcccttgcccccagtacgaagtttatgccctgaatccccaaagtagcccttcttggtgcccaactggcctggggacaaacagggtcccctacatttaggactcccggttaagtggacccattttttgccctcctcccaggaattttggtaaaagctagctttggggaaggggttgggtgtaaatatnaaagggtggagggagcccagctggtaccaataaacatgggtagancta

SEQ ID NO: 501161 - DNA, 429 bp, Homo sapiens
  misc_feature (308)..(308): n is a, c, g, or t
tgagacagagttttagtcttgtttcccaggctggagtgcaatggcacaatcttggctcactgcaacctccgcctcctgggttcaggcaattttcctgcctcagcctcccaagtagctgggattacaggcacccaccaccatgcccagctaatttttgtatttttaatagagagctaataattgtatatttaataaagacgggtttcaccatgttggccaggctggtcttgaactcctgacctcaggtgatcctcccgcctcagccttccaaagtgctgggattacaagcatgagccaccgcacccggnctcacagtgacagattctgaggaaacagcatgcaaaacatttggaccattttcttcatctcccattgttggatagagagtgtgcaccgctgctatcttggcagatccacactggtcctccc

SEQ ID NO: 501162 - DNA, 917 bp, Homo sapiens
ggacccaggtcatctgaagcagatgatcctcctcctgacctactgtcaggagagcagtgaagtagcctaatgctatgccaccaggcctgagtcatacacctcacttcatctcatcatgtggacattttagtcatctcgaatcatcacaggaagagactttgtgggccaaggcttagtcatctattggtatggatttgtccaggagctggactgcaatccgggaacaaggggcgtcctgctcgaagcctgtgtccccacgaacattgtcatccttatgccaccagcatagcttgatgcctgaagatcctggtactgagaacgctgggaggaaatagagacccagcattgattaccatcgtggaataatctagcgcaaacctaggaaagctggaagccatcaaaagtaccaaagccagctttgtactcacctgccagagctccatgaagaacttgatggcgagctgctatgctgtgtgtttgctatattcaatctttacggatgcctgacgtctgtgacggtaaggccaagtgcaaaggaatacattgatgagaatttcctctggttaataatgttatttgaacaccacatattttagatttatcttattgaagtattagttccatgtgcctggaaacaaactcctttgatgggggcgagaggggacaacccagattggggagagttcatttttaaaacatgggtagtgtcacgatgtacgtgaacagatttgatgagtcgcagttttaaggccatctgcttatggtgatgggttttaccgggttttagacctcgtagtagtcacaagggtcatgtaaagagggggccaaaacggggctttagacacaggaggtttggccaaaaaactcgcgggtggaaagcaggagaaaaaaaccccgagttagcaaatagcgcgata

SEQ ID NO: 501163 - DNA, 213 bp, Homo sapiens
gctacgtggtggatccgtcaagcagacctacatggaagtctgacacaaactcatacaaccatgatgcagtgatcaagaactacgggctgctctactgcttcttgaaggagatggtccaggtcgagacattcctgcgcattttgcagtgccgctctgtagagggtagctgtgtcttctaggtgccctgctggtggatctggtgagcgatccctc

SEQ ID NO: 501164 - DNA, 507 bp, Homo sapiens
gaatcgagctcggtacctgtcgggacgtgttatcgcatcagaatcttatgagtagcattcaaagagagaatatgcacttgcgcctttcagtcgatatgaaacgtggagagccttatctggggaagaccatggttgaaaatggttcatgtgtgtagtcagaatgcagaagggagtttagttgttagaacaaactgtgacattaaatagcctttttacagaagttcttagctaaagcaaatctcaaaccttgttaaatacaagactggataactataactttagggggactgcagagacgagggctttaatgatatttcagagggcacttgtgaggggagtgtcacattgactcggggtctgggagtggactcagcctggattcagcctaggcatctcttcagcctcagctgtccagccctggtgcctgtctggggatgtgtggcctaggcagagggcagtttaaagcacaaaaccacatggggataacacgttcgcgagggggatccc

SEQ ID NO: 501165 - DNA, 384 bp, Homo sapiens
tttacaatgatacagctatgacaacctgagtagtaggatattacctacgaagcacatctgatgtgaaagtatataatgtcatatgcctgatttcctcaacaccttttgttttgccgtcatgatcttctgtctttatatttttatcacagaaccaatgatctaacagggttctttcgtatgaggattattatgataatgtaacactatgatcattaatgcacgggatcatgccagctcattcatgggttgttctatagttccatggaactctaagtaggccaacgttatacataggcactccaaggggcatgcttcagccagacaagtaaagggctgaaagaagtagaacaatacaaaagccctcgtgtggtgggaactgtggcc

SEQ ID NO: 501166 - DNA, 128 bp, Homo sapiens
tggaagtgggggtgcccttccttcctaaaggccctgggggccaagctgacttggcggggcagacttgacactatgccccactcactcagtatgtcctgccaattccacccacgtggggtcacccctgg

SEQ ID NO: 501167 - DNA, 582 bp, Homo sapiens
ccaaaaaccaccaataggtggtgcccccgaaataaattttttttcccggaccctttttttttggggggggttaaccctttgggcccccttctttggtttttgtacgccccccacaagggggggggcccccggggggtctttttggggggaaaaaaaaaacccccctgaattttccctccccccgggccaaaaaaacccccaaagtttgggtaaaaaaaaagggggcccccccccaggggtgtttttttttccccccttggggggaacactgagggggccccggcccccccccctctcaaggggggtttatttttttgggggggttcccccaccccccccaaaaaaaaaaagcctttttttagtttttttaaaaaaaaccccccggaaaaacccccctcccccaaaaaaattttttaaaaaccttttttttttaaaaaaccccctataaaaagggaattccggggttttctttttttccccttgggaaaacagggggttttcccacaggggttttcccggctcccccccggtttcgggagtgaattttgttttccaaaaaactggcaagtccgcctgtctcag

SEQ ID NO: 501168 - DNA, 272 bp, Homo sapiens
  misc_feature (64)..(65): n is a, c, g, or t
  misc_feature (69)..(69): n is a, c, g, or t
  misc_feature (103)..(103): n is a, c, g, or t
  misc_feature (106)..(106): n is a, c, g, or t
  misc_feature (111)..(111): n is a, c, g, or t
  misc_feature (140)..(140): n is a, c, g, or t
  misc_feature (183)..(183): n is a, c, g, or t
  misc_feature (248)..(248): n is a, c, g, or t
  misc_feature (254)..(254): n is a, c, g, or t
atgtctgcagtctagacctcctgaagaagctacagcgtcaggcacacaccaccacacctggctnntttntctatttttagtagagatggagtttcaccagtgnggncaggnggtctcaaactcctggcctcaggtgattngcccgcctcagcctcccaacatgctgggattactaacatgagncaccacacccggtcttgctcttgatttatttctgatgtttctgtgtcaggctcttctggagctcngacccngagcagcagggaaagaca

SEQ ID NO: 501169 - DNA, 243 bp, Homo sapiens
aggatctctcgactcgacggtttctctgctgctgatgaagacacacctcaggcttgccctgcagcctgctgccccgaatcaggaccaggaccaggcctcacctttgttacgccccacgtctcgttgcaaactcctcagtgtatgcctcatcgttggtgatgaggaagttgtcaacagatggtgccagacttgacctgtaggatgaatgggaaggatggtcagaggtgataccggatagccctt

SEQ ID NO: 501170 - DNA, 153 bp, Homo sapiens
cggatgtctgaggcagcgattgtctgtttattgctgagtaacgtcactgtgtaacattctgggggttttagtcatctcttgttgaagacccttgctgttccatctggaggctcttatgagtaaacctgttacgctggcctacaggacatgccg

SEQ ID NO: 501171 - DNA, 114 bp, Homo sapiens
atatcaatgccaaacagcaatacattgatttataaaaactaaaataaccacatcacagtaagttagtgaaaaacacgatatacattaaggaatttcacttattatgagtcccat

SEQ ID NO: 501172 - DNA, 1158 bp, Homo sapiens
  misc_feature (242)..(242): n is a, c, g, or t
  misc_feature (630)..(630): n is a, c, g, or t
agctatctgtgtttacttttctaaaataatacctgagctggttcaatgatttctctccatcttagctaattctgtttaaaactctgtcagaggcctgcaggcctgtgacgttactactttactacaactatactcttcagacaacttacactctttacacaacgacggccattacgtttccacgacataccttattttaacaacaccgtttacacacttaacactactttatactgcgccantctgtacacggacacactttatcatatctatcctctatacctttgtgcggacacatctggactgggtcttacctttaacctaggttccataatgggggaatctaatacctattctcctcggagtactcccccaaatgggtttctaaccaaactttcccatctttcccaaccattatatctggcactatctaggcacacgcttagcggccgcaaacacacgacggtccccttttggaaccacggccgcatttctcttcaacttccacattaggttcgggctactacggcttatggggtctcggcttagatatggttacaccaattatccatctatcaagatttggaccacccgtttgggtatactccaacgcgtatccctgcgatttancggtgtttacgacccccgtatatttacacttgtgcacacgcgtgcccttcttcacgcggcacgaacttttgtacccaaacaagcgaccaaaccaggcgtctggtaatcccacaggcggagaattccacaaggataaacacacatcgtagcatacacactgtgctgagtttaagaccacgcgccttggggttaacacccatattatattggagcccgttggtcttcctcttgggacacagtggcacaccgtaggaggccacacacccgatacttccagtcagggttgtccgaccacattttcggcaccattgggcgctgctagctcgcaactttgtgccaccctctttggggtcccacccactatatgatcatcaacccccaacagacggcccattaaaagtttgcacttaaccttccactctatcacacacaggcacagtcttatgggcctataacagcgtggtatcacaccaccaaaccaactttttgatcgttacgcacacacgacggtttagtaggtgggttcga

SEQ ID NO: 501173 - DNA, 100 bp, Homo sapiens
ggagtatgagaccagcctgggcaacatagcaaaaccctcatttttacaaaaataaaataaaaattagcagggtatggtgatgtgcacctgtagccccagc

SEQ ID NO: 501174 - DNA, 134 bp, Homo sapiens
cccgtcagtcaatcttatctggtaatgggatcattactgttatccagtgtcaatggtctcagtagtatttccattttttttaatggagtttttagattaaggatttctctttttgttttattaaacattgaaag

SEQ ID NO: 501175 - DNA, 270 bp, Homo sapiens
gcacggtaggccgtgtctcctagctacgcagttccatgctttcctcaccagcctgattgcttgcaaaccacgcagtgtcagacatgtggctcacttacagacgcacagaggagtttgaggatgaccggctcctttgacgagccatgagactcttgcttaggagacacctccagtctccctactcagtgcctgatcaacctggaacacaatgatctggttgcctctggctgaccccagattggggaccactgcttcccacttgctgaagtt

SEQ ID NO: 501176 - DNA, 150 bp, Homo sapiens
  misc_feature (19)..(19): n is a, c, g, or t
aaaattcaacttacctgtngtcttgagtgcctacggaaatcttgctgaagaccacgtatacatgatgtgaacattcatcattatgaggatgaatgtaaaatacttcattttataatgaacaaagagacctgaaattccctggcctgaagc

SEQ ID NO: 501177 - DNA, 390 bp, Homo sapiens
  misc_feature (131)..(131): n is a, c, g, or t
  misc_feature (187)..(187): n is a, c, g, or t
  misc_feature (228)..(228): n is a, c, g, or t
  misc_feature (240)..(240): n is a, c, g, or t
  misc_feature (242)..(242): n is a, c, g, or t
  misc_feature (246)..(246): n is a, c, g, or t
  misc_feature (249)..(249): n is a, c, g, or t
  misc_feature (254)..(255): n is a, c, g, or t
  misc_feature (259)..(259): n is a, c, g, or t
  misc_feature (268)..(268): n is a, c, g, or t
  misc_feature (274)..(274): n is a, c, g, or t
  misc_feature (284)..(284): n is a, c, g, or t
  misc_feature (292)..(292): n is a, c, g, or t
  misc_feature (326)..(326): n is a, c, g, or t
  misc_feature (335)..(335): n is a, c, g, or t
  misc_feature (341)..(341): n is a, c, g, or t
  misc_feature (354)..(354): n is a, c, g, or t
  misc_feature (366)..(366): n is a, c, g, or t
  misc_feature (371)..(371): n is a, c, g, or t
gggtggggacgtgggtgggtcccaggtgtgtgtggggtcggggtgggctctaggagttagcccttatcccccctgaccaggcgggagccgccaggccttcaactgggccagtgcccaggagccatcctggngtggggccaggagcttgtccaaggccacaggcccccagcaccccctgccggcgggntccgtggggccctggagctgatgacgggggagggccgtccncctggccccccnanccgnccnccttnnctgnccccaaaantgtgtntttagacctnctgggggngcttaaaggggtgagttgggtttggatttttagntattttttnttcagntttattagacttnttttttataaanccatnaatcccttttcctccggga

SEQ ID NO: 501178 - DNA, 1302 bp, Homo sapiens
gaatgccccaactaaatactaccgtatggacacaccataattacccccatactccattacactcattccatcatcacccaactaaaaatattaaacacaaactaccagcatacctccctctatcaaagcccaaaaaaaaaaacaaaaaaaaaaaacaaacaccatgaagaacacgcaaagacacaaagaaacacgaaacaaacacacaaaagaaaggcagcaacggggaccagtaggaaacaggacaacagaggacaacgacgaaacacaccagcaaccaccgcggccccaacggcaaacagcggccatggaacaacaaccacacgaacacaacaacacacgcacgcgagaggcaacacacggacacgacaccagcgcacacaagaaccgaaaaaaggcacataaacaggagaagaccaaacaaaagaggaaaaagaccaccacaccgggaggaaacccaaagggagaacgaccacgacaaaaacacaagaaaaacagccccacagcaggggaacaccgaaacaaagcgcaaaaaagagaacaaaacagagaaaacaaaaaaacacagaaacagacaacaaaacaacaaaacagacgacagagcagacgaagacgaacagaaaaaaaaagaagggacaacaaggcagaagcgacaacaacgaaagggacgcagcagacacaagcgcaagaagaaaaagcaagaaaagaagcggagagaacgaacaaacgacccaagagaagagaaaaccggaggacgaaaacacaagaaggcaagacagacacgccggggcgacagcggaaacgaagcagcgggagaaggcgcagggacacggagcggagcagcggaagagggcgacagcacgaggaaagaggaggtacgagggagagaggagaagaagaggcgacggcgcgacaggagagagaagaggagagagggcacaagagaaggagaaaggaggcagcaccagaagggagacggaggagcggcggaggacaacccgagcaagaggagagagaggacaagagacgaaagcgcaaaaaagagaccgaagaccacgcaagcagaacacagacaacgagacgagcagacaagcaaaacaagcaaagagagaagagacggggagacgcgcggagcgagacgcggcagcaggccggcaagagggagaacggcgagagcagacacacgcgagcagcaaagaacgaaaagagagagaagacaggagaaagaaagaaggagcgcagacagagcgacaggcagcgaccgagagacgaagagcaccacgacggcagcagagcgaggaa

SEQ ID NO: 501179 - DNA, 125 bp, Homo sapiens
  misc_feature (22)..(22): n is a, c, g, or t
  misc_feature (121)..(121): n is a, c, g, or t
tgtgtgtgtcccattggactcntgcacctgggggggcaacttatggtcctcatttgttttatttgtaccccctctttcaccctttttattggttcaaggtaaacatattattaataaaaantgcc

SEQ ID NO: 501180 - DNA, 573 bp, Homo sapiens
  misc_feature (318)..(318): n is a, c, g, or t
  misc_feature (326)..(327): n is a, c, g, or t
  misc_feature (385)..(386): n is a, c, g, or t
  misc_feature (564)..(565): n is a, c, g, or t
gctacaccattagtgcggcgcacgtggctgtgcaggtgcttgaagatggtcgtacgtgtgtcctatgtgatcttggtcactgaataccgctagaattgctcagccaattgtaaatgtcccggagtgcagacaacgaaggcgcttctggatacgaatatgcacactatggcgaacgttcactggtgagtgcatacaacgtgcggcattgtcactctatacaagggtaggctctcgaacaaggcgtacgacttcagattatcaatacacttcaacaggctcctctccgcgccatggaagtggccccacacaagaaagttnatgtccgnnacaagccttgcaagaaaggccagcacatttcaatacaaaaatggggcccagccacacnngatgggccaagcaagattgacagccagacgaaaggcaaagccaagcatgacagcattttgcatcgcttttaaacgttatgacaggcaacagaaacatgacggaacagacatacatcaagacatgaagcttacagaagctttcaaacaaggcagctccctcctgaaaggcttctcccannaaaaagca

SEQ ID NO: 501181 - DNA, 797 bp, Homo sapiens
ctctctgtcctacccttttcttcaccacgcagatcttaaggccaaatataaagagcttctgaaacatccctttattttgatttatgaagaacgtaccgttgaggtcgcatgctatgtttgtaaaatcctggaccaaatgccagctactcccagctctcccatgtatgtcgattgatatcgctgctacatcagactctacaaaaaagggctgagaggaagcaagacgtaaagaattttcatcccgtatcacagtgtttttattgttcgcccagacaccatgtgcaataagattggagcccgttcccatcatgtctgcttactcctgtcacctccaacgcgcatctttgcaatacccgaccgatcacaccgtgttcgtgctggacttagagaccttatacctgcactttcacgatgttcatacttctgccatcgttccttccccccccccccccatttacttccgtttctccctatacctcattaatcatcctcactctacctcctaccctcttttttcattctaccgctctcgctttcccgccccatccccacccgccccgtcaccgccaccaatattttacccctcgcccccgctccctcccctttctttttctattttgcttatacctctcttttccccatccccccatccccttctcctccgcccccgcaaaccacgccctcccctatcctcccctttttatctcctccttcttcccttttaccgagactcacaaccttcccattccccaccaccacttgctcacctaccttccccccccatccatccatcccca

SEQ ID NO: 501182 - DNA, 288 bp, Homo sapiens
gctcggtacccctctgatatgggcgatcagtaaccgcaaaagagcccaatgtcatacatggaacacaaatgactgctatagtgtatcatacaacttgtgcatgaagaagagtactcgcctatgaggacgtagtctttccaatttacatcacatatgtttacacctggaggtggctgatatgatgcttcattcaacctgaatggataaccacatgtacctgtaacagttttacttctcacgtaactgcaggatgacaattcacttgaatttctgtttggcccttatcga

SEQ ID NO: 501183 - DNA, 304 bp, Homo sapiens
acggggaacccagaatgggggcttcggacacagccctcctggaggacctgggaacagcagtggccttctcctggagaggatggtggccattccagccaacaacaaaatgcctgatccttccggaaaaactagccccctccttcaccccccgcacacctgcatcccctccggaggcctcctgtgaggcacgaacccctgcctcccctaggccggaccttgtggacgacagccccacccagtctgtgctcctcagccgctgcgcaaggcccagcctgctcagaataaagcatgtcctgttgccgga

SEQ ID NO: 501184 - DNA, 973 bp, Homo sapiens
  misc_feature (950)..(950): n is a, c, g, or t
acaacttaatatgactagcttacacaactagcttataaatgtgaagtataccatcttttacgtgacttcctacttatgactcggcataaagaccatgtcgatagaccctcgcatcgcatgtgagtcaatggagtacttgtctggattactcattataactaggcgtgatatgtgtataattacagcctcatcactcatactctaacacccgtgacagaatacatagcctaccccttccttgtactatccctatgaggcataattataacaagctccatctgcctacgacaaacggaacctaaaatcgctcattgcatactcttcaaatcagccacatagccctcgtagtaacagccattctcatccaagaccccctgaagcttcaccggcgcagtcattctcagtaatcgcccacggacttacatcctcattactattctggctagcaaactcaaactacgaacgcactcacagtcgcatcataatcctctctcaaggacttcaaactctactcccactaatagctttttgataacttctagcaagcctcgtaacctcgcttacccccatattaacctactgggagaactctctgtgctagtaaccacgttctcctgatcaaatattcacttcttcctacttacaggactcaacatactagtcacagccttatttccctctacatattacacaacacatggggtcagtcaccacaattaaacataaaccttattacacgagaaaaacctcatgtataactatccccaatttctctatcttaaccgaatatacgggttctcttaaaaaaaaaaaaaaaaaaaggggggctaaatccccgggcgccgagccccctttgaaggccaggagtaaaagaacgggggaaaggggaaacaaggtgtggcctgtgggtgcgcccacgcgggtaatttgacttgcgagatattacacgnacgtccacagaagggccgcagcc

SEQ ID NO: 501185 - DNA, 110 bp, Homo sapiens
cgtgtagtctctgtagctggggcaccggcatatgttttctgaaagggatgtgacagtggacttgagcatcctggcaggttaggggtagtggagctgcgtctgctgaggag

SEQ ID NO: 501186 - DNA, 103 bp, Homo sapiens
gccgctcaggatgtgccatcttgagtgatgtgttcctctctccccacaccctggttctacagaacttacagattccagtgtaggtcatgctatttccagaaac

SEQ ID NO: 501187 - DNA, 286 bp, Homo sapiens
aactgagaaactgtttcatgctttatgcctacctcttgtagttgttgcagagcaaatataacttgtaataagatagctaggccttgcagagacagacagaaaacttaaaaaaaatgatatagagctggagtctagtatttatatgagtctgtgagagatactgtgtttggtctcactgcaatgaaccaaaagcggctgagtttggttttaattttagccatgtattgagggatcgttttgaccaactcttgttggctctgtcttgaccattgttaatcactgtcct

SEQ ID NO: 501188 - DNA, 695 bp, Homo sapiens
  misc_feature (177)..(177): n is a, c, g, or t
ttccgcggcgcccgggaaatggcatccgggccgccgcgcgccgctgtaaagaaataggaaatgctagtcaagttgtggtgagagggaggatggcgttcgaatgtttataggcgctcctgttctatccgctggccaccccccgaaggaagagggatctactctagaaagtacgtgacnattttctcgttctttatatattgatcggtgtgtctctttcctttattcctcagtccaatgcagtagagtgatacaatggtaataatcatatatacatgagaatattaggaataccaacctcactctcttcactcacaccctcacagcctcccctcctcaccgtccccccccccctcccctccctccactccgcttctctttctctctgtatctatctttttgtggcgtgtgagtattgagtgagtccctaccccccctcacacgattctcatccccacaccctactctaacccaacctcaaccatgcaatagccctcctctccgacgtccttcgtacacctcatattatggtaagtagttactatttccctaaacacacaacgtccaggcagaaagacgatgtaaatagcgaattatagtctgttatcatggtgtgttcgtgaatcgtaacccgtttacaagtcgctcgtccaatgacggataacgttcacagctcgtatcctctcacacttacatct

SEQ ID NO: 501189 - DNA, 517 bp, Homo sapiens
tgagacagagtcttgctctgtcgcccaggctggagtgtaatggtgtgatttcagctcactgcaccctccacctcccaggttcaagtgattctcccgcctcaccctcctgagtagctgggactataggcacccaccatcatgcccggccaatttttgtatttttctacagatggggtttcaccatgttggccaggctggtcttgaactcctgacctcaagtgatccacccgccttggcctcccaaagtgctgggattacaggggtgagccaccacacccagcctacttactctttcttttttacgagacagggtctcattctgtttcccaggctgggagtgcaatggcacaattaatggctcactgctgttcttgagctttctgggctcagtcgattctcctgcctcagcctgctgagtagctgggactacaggtgcgtgccaacatgcctgggtaaattgtttttgtagagatgggaactcaaccatgttgcacaagctgggtcttttttttttttt

SEQ ID NO: 501190 - DNA, 825 bp, Homo sapiens
  misc_feature (22)..(22): n is a, c, g, or t
  misc_feature (169)..(169): n is a, c, g, or t
  misc_feature (176)..(178): n is a, c, g, or t
  misc_feature (180)..(180): n is a, c, g, or t
  misc_feature (187)..(187): n is a, c, g, or t
  misc_feature (502)..(502): n is a, c, g, or t
  misc_feature (511)..(511): n is a, c, g, or t
  misc_feature (515)..(515): n is a, c, g, or t
  misc_feature (518)..(518): n is a, c, g, or t
  misc_feature (545)..(545): n is a, c, g, or t
  misc_feature (553)..(553): n is a, c, g, or t
  misc_feature (657)..(657): n is a, c, g, or t
cccaagagagtttcctaaagcnaggaaaccaagccgggcgcctcttgcaatggagacggtcatttcttcagatagctccccagctgtggaaaatgagcatcctcaagagaccccagaatccaacaatagcgtgtatacttccttcatgaagtctcatcgctgctatganctgattnnnanaagctcnaaattggttgtatttgatacgtccctgcaggtgaagaaagctttttttggcctgtgggtggacctaacgggggttaccgagccggcccctttaattagggattaagtaaggaacgggcaaaaggtttggtggggcacggcctgaccattcacaggatttcctttcaattattccggcaccgctaacttaattaaaatcagcctggcgtccagaatctaataaagactaaaaaaccccaagataaaaacctgtggagaagaaggtggtattctccaggactccctttaaaccgttgggtcttgcattttctcctantgccagctngttngangctgtctcttcattaattcggaacaanatccacangctgccagttattaacccagaatcaggcaatactttgtacatcctcacccacaagcgcattctgaagttcctcaaattgtttatcactgagttccccaagccanagttcatgtccaagtctctggaagagctacagattggcacctatgccaatattgctatggttcgcactaccacccccgtctatgtggctctggggatttttgtacagcatcgagtctcagccctgcagtggtggatgagaagggggcgtgtgggtggacaatctactc

SEQ ID NO: 501191 - DNA, 2317 bp, Homo sapiens
tggcacgaggcacttgagtgtgaaattcagttgctgaaaaacttgctacatgagcgaattgttcagtattatggctgtttgagggatccccaggaaaaaacactttccatatttatggaatatatgccagggggttcaattaaggaccaattaaaagcatatggcgctcttactgagaatgtgactaggaaatacacccgtcagattctggagggtgtccattatttgcacagtaatatgattgtccatagagatatcaaaggcgcaaatatcctgcgagattcaacaggcaacgtcaaactaggagattttggggccagcaaacggcttcagaccatctgtctctcagggacaggaatgaagtctgtcacgggcacaccatactggatgagccctgaagtcatcagtggagaaggctatggaagaaaagcagacatctggagtgttgcatgtactgtggtagaaatgctaactgaaaagccgccttgggctgaatttgaagcaatggctgccatctttaaaatcgccactcagccaacaaacccaaagctgccacctcatgtctcagactatactcgagatttcctcaaacggatttttgtagaggccaaactgagaccttcagctgatgaactcttaaggcacatgtttgtgcattatcactagcagccagtaacctctcctgtgcctctacctagctcccatctattcattcaccttctctctgactgcacttttcttttttataaaaaaagagagatgggggagaaaaaagacaagagggaaagtatttctcttgattcttggttaaatttgtttaataataataatatcctaaattttttatatttaatctttttttcccttacaagaacttgaagtttttttttttaatttttataatgtactgatgtggttcagagagataaagcactttagtacatagtcactctttttagtacaaacaaatcatttggaatacctaaagattgtagagtcattccctctatcactgacacatcagtgacgatgggaagacatggaaaacaaggagaagaaaatgatgtataatttgtagtttttagtgatagtatttaaaatatatcctcatttgtggggttgagccctaaactttagtttagggtaggtactcaacttaaagaatataggtttcttcttatatctgtattctttagatcctaacctctgtctaccaacctttttgctcagtaggagtcttgatagaagatatgaatctctgagaggtatgtttatttgttaatcctaaccagtataataagcaaatacactataatagatccacgttactggaatctgtaaaccttgagggatagctttctgcttaaaaacacacacacacacacacacacacggaaaacctttattttaaagtcaagttgtgagcaaatagaaataaaagacaaaaggacatcactcttatcaaatgtgtgagcagtagaagagaccacatttacagtcaatagaaataatgaaaaaaaattaggtgtttagtgtattttaaacagttttgttttgttttacttgagggggacgtcccaaaattaaaggaatggagaaataatcaaaatcatgtataccatcttctatttccagctcctgattccccataggtaacatcccttaggagcgaagagttcaattagtaatgtttatgtgttatgtcaggagatgaaacccttgttcttaggatcacagaatactaaagcacctcaaaaaaacaggtatcatgtgaaacagtggttgccaaaagtggagcgaggatgatttcactaggcatttggcaattcttagagacatttccggttgtcacaattggagggatactagtagcatgaattgggtagaggccagggatgttgctaaatagattataatacacaaggaaagcagcctcaaagaattacccctcccaaaatgtcagaagtgctgaggctgagaaaccctgatgtaaagatcagtcccagttataaactgaaaacagctatttacaaagcagtaaatgcaagaaagaaaaggaagtcgcaaagagaaagtgatgtaatgcaaattgaggattttacaagatcagatactgctgctttaagtcaagggtgaataatctcaacaaacagcaaatagcaatcactttaccagctgcatattgcacccacataggtaactcttcattttaggaacaaactgaatttgaacactgagccttttgaactcagccatctctatatattctttccttaaaattcatgattttgggcaaaaaaaaaaaaaaagtcgacgc

SEQ ID NO: 501192 - DNA, 776 bp, Homo sapiens
  misc_feature (22)..(22): n is a, c, g, or t
  misc_feature (169)..(169): n is a, c, g, or t
  misc_feature (176)..(178): n is a, c, g, or t
  misc_feature (180)..(180): n is a, c, g, or t
  misc_feature (187)..(187): n is a, c, g, or t
  misc_feature (250)..(250): n is a, c, g, or t
  misc_feature (257)..(257): n is a, c, g, or t
  misc_feature (267)..(267): n is a, c, g, or t
  misc_feature (301)..(301): n is a, c, g, or t
  misc_feature (305)..(305): n is a, c, g, or t
  misc_feature (309)..(310): n is a, c, g, or t
  misc_feature (315)..(315): n is a, c, g, or t
  misc_feature (322)..(322): n is a, c, g, or t
  misc_feature (337)..(338): n is a, c, g, or t
  misc_feature (343)..(343): n is a, c, g, or t
  misc_feature (351)..(351): n is a, c, g, or t
  misc_feature (354)..(354): n is a, c, g, or t
  misc_feature (367)..(367): n is a, c, g, or t
  misc_feature (378)..(378): n is a, c, g, or t
  misc_feature (381)..(381): n is a, c, g, or t
  misc_feature (383)..(383): n is a, c, g, or t
  misc_feature (385)..(385): n is a, c, g, or t
  misc_feature (393)..(393): n is a, c, g, or t
  misc_feature (401)..(401): n is a, c, g, or t
  misc_feature (403)..(403): n is a, c, g, or t
  misc_feature (405)..(405): n is a, c, g, or t
  misc_feature (411)..(411): n is a, c, g, or t
  misc_feature (419)..(419): n is a, c, g, or t
  misc_feature (432)..(432): n is a, c, g, or t
  misc_feature (434)..(434): n is a, c, g, or t
  misc_feature (439)..(439): n is a, c, g, or t
  misc_feature (442)..(442): n is a, c, g, or t
  misc_feature (453)..(453): n is a, c, g, or t
  misc_feature (462)..(462): n is a, c, g, or t
  misc_feature (466)..(466): n is a, c, g, or t
  misc_feature (469)..(469): n is a, c, g, or t
  misc_feature (496)..(496): n is a, c, g, or t
  misc_feature (504)..(504): n is a, c, g, or t
  misc_feature (608)..(608): n is a, c, g, or t
cccaagagagtttcctaaagcnaggaaaccaagccgggcgcctcttgcaatggagacggtcatttcttcagatagctccccagctgtggaaaatgagcatcctcaagagaccccagaatccaacaatagcgtgtatacttccttcatgaagtctcatcgctgctatganctgattnnnanaagctcnaaattggttgtatttgatacgtccctgcaggtgaagaaagctttttttgctttggtgactaanggtgtangagctgcccntttatgggatagtaagaagcaaagttttgtgggnatgntgannatcantgatttnatcaatatcctgcanngctantataaatnagnattggtaaagatntatgggctagnagnananaagatagnaaattggngngnggtgtntataaagncataatttaaaangnttgtntgnatttctcctantgccagctngttngangctgtctcttcattaattcggaacaanatccacangctgccagttattaacccagaatcaggcaatactttgtacatcctcacccacaagcgcattctgaagttcctcaaattgtttatcactgagttccccaagccanagttcatgtccaagtctctggaagagctacagattggcacctatgccaatattgctatggttcgcactaccacccccgtctatgtggctctggggatttttgtacagcatcgagtctcagccctgcagtggtggatgagaagggggcgtgtgggtggacaatctactc

SEQ ID NO: 501193 - DNA, 2263 bp, Homo sapiens
tggcacgaggcacttgagtgtgaaattcagttgctgaaaaacttgctacatgagcgaattgttcagtattatggctgtttgagggatccccaggaaaaaacactttccatatttatggaatatatgccagggggttcaattaaggaccaattaaaagcatatggcgctcttactgagaatgtgactaggaaatacacccgtcagattctggagggtgtccattatttgcacagtaatatgattgtccatagagatatcaaaggcgcaaatatcctgcgagattcaacaggcaacgtcaaactaggagattttggggccagcaaacggcttcagaccatctgtctctcagggacaggaatgaagtctgtcacgggcacaccatactggatgagccctgaagtcatcagtggagaaggctatggaagaaaagcagacatctggagtgttgcatgtactgtggtagaaatgctaactgaaaagccgccttgggctgaatttgaagcaatggctgccatctttaaaatcgccactcagccaacaaacccaaagctgccacctcatgtctcagactatactcgagatttcctcaaacggatttttgtagaggccaaactgagaccttcagctgatgaactcttaaggcacatgtttgtgcattatcactagcagccagtaacctctcctgtgcctctacctagctcccatctattcattcaccttctctctgactgcacttttcttttttataaaaaaagagagatgggggagaaaaaagacaagagggaaagtatttctcttgattcttggttaaatttgtttaataataataatatcctaaattttttatatttaatctttttttcccttacaagaacttgaagtttttttttttaatttttataatgtactgatgtggttcagagagataaagcactttagtacatagtcactctttttagtacaaacaaatcatttggaatacctaaagattgtagagtcattccctctatcactgacacatcagtgacgatgggaagacatggaaaacaaggagaagaaaatgatgtataatttgtagtttttagtgatagtatttctcaacttaaagaatataggtttcttcttatatctgtattctttagatcctaacctctgtctaccaacctttttgctcagtaggagtcttgatagaagatatgaatctctgagaggtatgtttatttgttaatcctaaccagtataataagcaaatacactataatagatccacgttactggaatctgtaaaccttgagggatagctttctgcttaaaaacacacacacacacacacacacacggaaaacctttattttaaagtcaagttgtgagcaaatagaaataaaagacaaaaggacatcactcttatcaaatgtgtgagcagtagaagagaccacatttacagtcaatagaaataatgaaaaaaaattaggtgtttagtgtattttaaacagttttgttttgttttacttgagggggacgtcccaaaattaaaggaatggagaaataatcaaaatcatgtataccatcttctatttccagctcctgattccccataggtaacatcccttaggagcgaagagttcaattagtaatgtttatgtgttatgtcaggagatgaaacccttgttcttaggatcacagaatactaaagcacctcaaaaaaacaggtatcatgtgaaacagtggttgccaaaagtggagcgaggatgatttcactaggcatttggcaattcttagagacatttccggttgtcacaattggagggatactagtagcatgaattgggtagaggccagggatgttgctaaatagattataatacacaaggaaagcagcctcaaagaattacccctcccaaaatgtcagaagtgctgaggctgagaaaccctgatgtaaagatcagtcccagttataaactgaaaacagctatttacaaagcagtaaatgcaagaaagaaaaggaagtcgcaaagagaaagtgatgtaatgcaaattgaggattttacaagatcagatactgctgctttaagtcaagggtgaataatctcaacaaacagcaaatagcaatcactttaccagctgcatattgcacccacataggtaactcttcattttaggaacaaactgaatttgaacactgagccttttgaactcagccatctctatatattctttccttaaaattcatgattttgggcaaaaaaaaaaaaaaagtcgacgc

SEQ ID NO: 501194 - DNA, 647 bp, Homo sapiens
  misc_feature (22)..(22): n is a, c, g, or t
  misc_feature (121)..(121): n is a, c, g, or t
  misc_feature (128)..(128): n is a, c, g, or t
  misc_feature (138)..(138): n is a, c, g, or t
  misc_feature (172)..(172): n is a, c, g, or t
  misc_feature (176)..(176): n is a, c, g, or t
  misc_feature (180)..(181): n is a, c, g, or t
  misc_feature (186)..(186): n is a, c, g, or t
  misc_feature (193)..(193): n is a, c, g, or t
  misc_feature (208)..(209): n is a, c, g, or t
  misc_feature (214)..(214): n is a, c, g, or t
  misc_feature (222)..(222): n is a, c, g, or t
  misc_feature (225)..(225): n is a, c, g, or t
  misc_feature (238)..(238): n is a, c, g, or t
  misc_feature (249)..(249): n is a, c, g, or t
  misc_feature (252)..(252): n is a, c, g, or t
  misc_feature (254)..(254): n is a, c, g, or t
  misc_feature (256)..(256): n is a, c, g, or t
  misc_feature (264)..(264): n is a, c, g, or t
  misc_feature (272)..(272): n is a, c, g, or t
  misc_feature (274)..(274): n is a, c, g, or t
  misc_feature (276)..(276): n is a, c, g, or t
  misc_feature (282)..(282): n is a, c, g, or t
  misc_feature (290)..(290): n is a, c, g, or t
  misc_feature (303)..(303): n is a, c, g, or t
  misc_feature (305)..(305): n is a, c, g, or t
  misc_feature (310)..(310): n is a, c, g, or t
  misc_feature (313)..(313): n is a, c, g, or t
  misc_feature (324)..(324): n is a, c, g, or t
  misc_feature (333)..(333): n is a, c, g, or t
  misc_feature (337)..(337): n is a, c, g, or t
  misc_feature (340)..(340): n is a, c, g, or t
  misc_feature (367)..(367): n is a, c, g, or t
  misc_feature (375)..(375): n is a, c, g, or t
  misc_feature (479)..(479): n is a, c, g, or t
cccaagagagtttcctaaagcnaggaaaccaagccgggcgcctcttgcaatggagacggtcatttcttcagatagctccccagctgtggaaaatgagcatcctcaagctttggtgactaanggtgtangagctgcccntttatgggatagtaagaagcaaagttttgtgggnatgntgannatcantgatttnatcaatatcctgcanngctantataaatnagnattggtaaagatntatgggctagnagnananaagatagnaaattggngngnggtgtntataaagncataatttaaaangnttgtntgnatttctcctantgccagctngttngangctgtctcttcattaattcggaacaanatccacangctgccagttattaacccagaatcaggcaatactttgtacatcctcacccacaagcgcattctgaagttcctcaaattgtttatcactgagttccccaagccanagttcatgtccaagtctctggaagagctacagattggcacctatgccaatattgctatggttcgcactaccacccccgtctatgtggctctggggatttttgtacagcatcgagtctcagccctgcagtggtggatgagaagggggcgtgtgggtggacaatctactc

SEQ ID NO: 501195 - DNA, 917 bp, Homo sapiens
atttactggcatgtttacatttataggaaggaacaatagtttcgtttatttcaacacaactgaatacttataaactgtatgttcctggaagttatttattccatacaccaaattggtcctttggtcatgacatttataattcctaaatgaagaccagaaagtacaaattgctggcgaggaagaataggctttattaatcaactgcatgtacttcgataattctaaatgggaagatggcttaatttttaacactaattatgggagcagattcttagcaaacttctttgggaaaagttaatgttatgatgtgcataaggctgccccatcgtgtatataactgaagcagattcgattcatcgtattcttacgcttctctgcttggtagttcgtggctgtacttaaagaacatacagaatttcatatctccaccaaatgtctaaaatgtgacccacagaacatcgtacacatgcttacacaactaacatgacaatattacaacctaacacgaatcttaacttcaacaaggtgcttcaacttcgaccgccctgtgcccacggacttcacttgccaccaccttcttaccaccgcgatacattcatccgagtcggcacggacctcgacagagctggcactacaacttctgacttaccgttaaacgaacacgacaaccacaacacaaccaacaccccgtctccggcgcgtctgccccaccagaagactccagacccatccccgcaaggaccggcgccacacctagacaaaccgcgcacgcgccacaagcgacacccaaagaaaacacgccgcacgacaaagagaagcgacccaccacacaaaaagccccgcgcaaaccaccgcggttgccaacacgccgtgacgcaccgaggcacagggcatcatacaagtggaacggacaaaga

SEQ ID NO: 501196 - DNA, 162 bp, Homo sapiens
catgtttcaccacgacgtaaatcagttaaatattgggacactaaccatccagtgtcaagaaaagtcacatgccatagccatggtattgcacatcattcatcttgcattcctttgagaatacagaagatcatgtaaatagttacagaatgtgggaatgctttg

SEQ ID NO: 501197 - DNA, 387 bp, Homo sapiens
acagactgtgttgcaatgtgtggcaaaggggggtacatatgcatgggaggcagtgacagtttggtaaagggaagcacaaaagttgaagatgaggcactgcaaggtgaaagctgtgaggcttcaggccaagtaacaggggctaaggaagccacaagggaggacattttctgcagagttgctgaaccagtaacaacctggtcctgacaaagctcttgtggaagaataagagccaagtgggaaagcttttcatcttgcaaagctgggggcagaaggttcttccttgaagtgtggtcatctgcacttcagctcaagagtcctgttggctgaagtccagagtgtcctttctgattcctgaagtagatgaacagccctgtcccaaggaagagc

SEQ ID NO: 501198 - DNA, 140 bp, Homo sapiens
  misc_feature (13)..(13): n is a, c, g, or t
  misc_feature (88)..(88): n is a, c, g, or t
tggcacagcagantgtaccctggcacagcagacgtaccctggcacagcagacgtaccctggcacagcagacgtaccctggcacagcanacgtaccctggcacagcagacgtacccagttatcagatcaaaaccaacccgg

SEQ ID NO: 501199 - DNA, 143 bp, Homo sapiens
atgctcggatggacgctgtggcttgctgctgtgccaaatacgaacacacactggtactggggagagactgtgacttcaacatctgccaagagcctcgtgtatgggatacgtgggggctgtgatggggtgctgctgctcgcatt

SEQ ID NO: 501200 - DNA, 1141 bp, Homo sapiens
  misc_feature (519)..(519): n is a, c, g, or t
gggggtcccacaagggctggggcctgagtcttagtttggggtgctcgtttgccaatgggggatccctccatatgaattgggccgcatattgctagcgccgtgtgggtttatttttatggagtgaggtctccagtgtcctcaagttgtgccacgcgtgactcactggtgggccgcccgctgggggggcttttgttcattggagagctgcattgctatttgcgagttggtggccgagcacgtgctgcccgaacgggcgcgcgatgcatatcacgacaagggtgacttgctttctcgtgctcaactctctggtagtgcgaaaccccgcccatggagcagctaccttagagcttctttggggttgccccaccgccagcgccgactgtttatagttgggtagaagagctcgaactgatctgccgctgcgcgtcattatgcccaccaagggagttataccccctccctcggctctcataccctacatcaatttagtcgtatagttactacgcctctctgtgcgcncaatctgcacctcgtcgctcagaaaagatggcggttaaataatagccgtttgtcgcaagactcataagtgccttggtgtgccacgtctgtgcatctagaacacacgccggtctggttatgtgggcacgcagggttgctatgtgggggcacactggtggacacccaccgggggtgcgtggtgacccacgctggtatctcacgggtcgtgtgttgggcgccatatcggcgtcccatgccgtctgtggtttgtcgctcgccggctccacgtgcttggtctccccgtggggttgagagccacggcgtctcacacgccgtgccccatgcctctcctcgtgtcagaggaaccatgggtacccccgtctcccccatgcctgctaccagagagaccctgtacacctctggccacaaccagggtggcacccaggtcccattttgggccacttaggagccaggttccagtgctccagaacatcgggggcccaacacgagaggccctggtgccaggtgaggggggcgtgtccctagagggggaaaagggcaccccgggcaccccatgtcccaccgtgtgggcccttctgtgtcccttaagtcagttgtaaaattaatacagatttttatatct

SEQ ID NO: 501201 - DNA, 917 bp, Homo sapiens
gggcacattggcggcagggccagtccgccggcggtcgcgcacggtccgggtcccttttgcctgtccagccggcgctgtccctgctccctccctccgtgaggtgtccgggttcccttcgccagctctcccaccctacccgaccccggcgcccgggctcccagagggaactgcacttcggcagagttgaatgaatgaagagagacgcggagaactcctaaggaggagattggacaggctggactcacccatagattttctaaaaaatcttggaaacgtattgtccttcatagaattacgacacatgtccacactttaatttactcgaaaacgcctgtaaatcggctgaagccatgccttgtgttcaggcgcaggtatgggtcctcgaccctcaaggagccagaacccgctttctcagagcatacagatgtaccactcttcgggagaatacagcctccgatttactttaagtaccagagtatgtcaagtgtagcatggacctcaccaagactgaaatcactgcaccacttcctctccccagattaagatacctttatggacaaataaagaacaggctccgaagtcaaaggccaccaagccagtaccaaaagtgcccatggtccggacagcagacctcccataaaggtacgaagacattcagatgcacaacataccagagaaaaagacaccagaccacccaaaactgggagatggtgacgcacccgggacaggaaataacaaggcatcatagaacacgaagaaccaacacccaaggctacaagatgacacagcaacaccagtggaggacacaggaaatccacaaaaccaccacaacaagagcagaagaaataacgcgaagaaacgacacacagacacgaaacgaaagagaccggagccggaagagaccacaaagacacaca

SEQ ID NO: 501202 - DNA, 968 bp, Homo sapiens
ttggaacacttatacctattattcggcgcattgagctggtagtgctatggcacagctctacgcctccttattcgagccagagtctgggccagccaggcaacgcttcgtaggtaacgaccacgatctacaacgttatctgtctgcagcccatgcatttggtaataatcttcttcatagtaatacccatcataactcggaggctttggcaactgacttaggttcccctaattaatcggatgcccccgatatggcggtttccccgacataatgcaatcataaggctgtcgtgactcttacccgccgctctctgcctactcctgcatcgtgatctgcttaatagatggcaggccggtgagcaagtgaaactcaggttgaagcgagctctaccgcttctcctttagtcagggcacacatacgtccactacgccttgtgcagccgtccagatagaccgtgaacctatcattcatcctgtgacagagctaggcgaggtgatcgtcgttcatatgcttaggtgggccgactccaagtatgtcagtctaacaaaacaaattcagtcagagttataaataagcccacctgaacacagtagaacccagatatatcctatatacggccccgcgttcgttgcgatcttggagtcgcgatgcacatacattcgacatgacaggtccttgacttactgcccttattcatcttccccagtcgctagactgcatgggcagtcacttatcacttagtaaacagaaacggagaacctcaaggaacaaacagtttcattccgaaaaccccgtgcgagcaaggggagagaataaacccacagtttcgtaagtacccaaaactagcttaatttcctggagtgttgtccaggtcacaccctgtagggcttatacatatacttactagcgtgcaagagttcggccaataatcggccaatattggtcaccgtataaatccggcaagacagcaa

SEQ ID NO: 501203 - DNA, 862 bp, Homo sapiens
  misc_feature (16)..(16): n is a, c, g, or t
  misc_feature (113)..(113): n is a, c, g, or t
  misc_feature (119)..(119): n is a, c, g, or t
  misc_feature (153)..(153): n is a, c, g, or t
  misc_feature (194)..(194): n is a, c, g, or t
  misc_feature (196)..(196): n is a, c, g, or t
  misc_feature (200)..(200): n is a, c, g, or t
  misc_feature (202)..(202): n is a, c, g, or t
  misc_feature (207)..(207): n is a, c, g, or t
  misc_feature (209)..(210): n is a, c, g, or t
  misc_feature (212)..(212): n is a, c, g, or t
  misc_feature (229)..(229): n is a, c, g, or t
  misc_feature (235)..(235): n is a, c, g, or t
  misc_feature (239)..(239): n is a, c, g, or t
  misc_feature (256)..(257): n is a, c, g, or t
  misc_feature (278)..(279): n is a, c, g, or t
  misc_feature (284)..(284): n is a, c, g, or t
  misc_feature (302)..(302): n is a, c, g, or t
  misc_feature (328)..(328): n is a, c, g, or t
  misc_feature (332)..(332): n is a, c, g, or t
  misc_feature (366)..(366): n is a, c, g, or t
  misc_feature (391)..(391): n is a, c, g, or t
  misc_feature (396)..(396): n is a, c, g, or t
  misc_feature (400)..(400): n is a, c, g, or t
  misc_feature (447)..(447): n is a, c, g, or t
  misc_feature (449)..(449): n is a, c, g, or t
  misc_feature (455)..(455): n is a, c, g, or t
  misc_feature (480)..(480): n is a, c, g, or t
  misc_feature (495)..(495): n is a, c, g, or t
  misc_feature (535)..(535): n is a, c, g, or t
  misc_feature (541)..(541): n is a, c, g, or t
  misc_feature (544)..(544): n is a, c, g, or t
  misc_feature (552)..(552): n is a, c, g, or t
  misc_feature (680)..(680): n is a, c, g, or t
  misc_feature (786)..(786): n is a, c, g, or t
  misc_feature (839)..(839): n is a, c, g, or t
cccagctcccgaccanaacccccttcctcccccggggaaagcaagaaggagcaggtgtggcatctgcagctgggaagagagaggccggggaggtgccgagctcggtgctggtntctttncaaatataaatacgtgtgttagaactggaaaatnctccagcacccaccacccaagcactttccgttttttgccgntntttntngaggngnngngggcaggggcgccaggnaccggntggntgcggtttattgcatcnnctgggtgttcaccccgcgagnnttctnctgctcattgtagaaganatgacacttggggtccccccggatgnttgnggttccttggtttattttcccggtgttggggttnacacaccagcacttcccacgctgcncgttnaganatatcttgcactgtttgatgttgtacaggccatgtttgttacagttngngatgtncagggagtagaggtgctctatatgnccccgctcatttggnaggtgcatggtggagatccgctccaggacctggtccagtncctgtnggnagggagtnctggcagggggtggtcgcagcttcttgggctcctccaggccaaggtgatgcttgccacccttgcccatctgccggtgctgctcagtgaccttctcccggaacacggccagctccttcatacccgactngaggggcttccggccagcactgcctcccccgcccaacatgttcatggtgctgtccacgtggttctccaccaggcctccttctgagtggtcatcgccattgtctgcnacctgctccgggctggcgccatactcggcgtcccggcgcttctcacaagtgcnctcgcccatgaccagcgcctgca

SEQ ID NO: 501204 - DNA, 1415 bp, Homo sapiens
ctatcatagaagagcttatcagcgctttcatgatcacgccctcataatcattatacacattatctgcttcctagtcctgtatgcccattttcctaacacatcacaagcacaaactaactaagtacgtaacatcgtcagacgctcaggacaatagaaaccgctgtgaactatccgtggcccgcacatcatcctagatccgtcagtcggccctcccagtccgctacagcagtccatttacactaagcagcacgagggtcaagcgactaccctccgcttacacatcgaagagtcaacttggacacaccaaactggctagcatgcaaacgcctagcgcagctaccaaccagcaacgaaacgagacgagcacacaaacatacgttcaaaccatacacgtagcagtaccgtaaccacacacgagtaggaatgccccatcagccacaccccaagcggacggaccacatgaccgaacctccacctctcgcacccgctgtcgcacccacacgtcggcacgcgtacagctcacccatacccaccggcagctcccgcacccgcccgcccacccacatagcccgctcactcaccagtcacaccactcacgcacctcacgaacgcagacgaggaagcccggccgtcgctcccgcccccaacccaatacacaaatggaaagacaccaccgcctcccccagccccaagaagcctgcacgcgcggacctactcacagcacacacaacccaacgcacacatgcaaccaacaacgccgccccacgacccggcgacaccccggcctcaacaacacacaccaccccaccaaaacccaccacagccataactgatacccaccccgcagggccgcctccccccaacagccaacacaccgcggacgagcacgcactaccatatcccaccaaacgcgagagccgacgagaaacagtggccacccatggcaacaaacgaccacaacgcaaccgcgcaaagcacgcaaacagacgcccacagcaaagcgacaaagacgccacaacatgaccaccacccaacgacaccggacacacacgcatacacggcgcaagccgaactacgcagaagacgctcacgcgccccgggccatctacaagaccaccgaaataccccctgacacggcgacagaacaaccacacgagcgggcaaccaccgcaacagacttacgacaccccccgccgacgcaacataagagcaagcacacgcggacgccacacatacccgatacagacacacacgcgccactaccgcatcaacaccaagacgacccaccaaggcaccacgcacacggagaccgcaaccaacaccacacaccgcgcggacaacggtcgaccacgcaacaccacaccacacgacacaacagacgccgcacgcagccaccgcatgacccgagacaggga

SEQ ID NO: 501205 - DNA, 441 bp, Homo sapiens
  misc_feature (62)..(62): n is a, c, g, or t
ccgaagttgggaagtgagaaaccatgtttttaacttgtggctgcttttgctgctgctgctcntccgtatctggctgtatgggtggagaacccaccccctgcccaccacaggggtctccttccaggccactcaggacattttagcttctctcctccccatgctcccttttttctctaaagtcccctgacatcagccctccggactcctaagagggactacccatgagagtggggttctgaggcctccctatggggacagttccgctcctgaagtgtcagtgttcggcatctctgtgcctatgagccccatctcaggtttgggaccccccagcccctctgatcagtctcggagtccccccttgggagaccctacttctttcgagccccagcccctcttcttaaccacctccgcatcgctgtctatccctgtatttctcgaaca

SEQ ID NO: 501206 - DNA, 322 bp, Homo sapiens
gactgcatctgaacagatacacaggaaatgtgaccatatagcaactccaccatcccatgtcgacaccaccaccaaatgttacagtgacccacaaagcaaggtgttcacaataattacatggggggaatataataaaccaacaacaataacgaaaaataaaatccactcactctgcagctgtatcaaaattttactgttaagtattagcacgcccttcccccccccaaccctgtaaagtaaggcaactaacacattacatctggtgaaccagcaaagatatcactcaaacacaaaatgcagcaccactatgcaagcagaggaa

SEQ ID NO: 501207 - DNA, 332 bp, Homo sapiens
tcagaaggtgagaagagcaacaatactgctgctacttacacaacactgacgacgagagaacagtagatgaaaggacgcgataggcaacatcatcatcattgtgccgagcaggagagtcatctagcagaaagcaaagaaaagcacttgatggagaaaaaaaataaacaatcagataatagtgaatacagtaaatcagaaaaaggcaaaaataaagaaaaagacagggagctagataaaaaggaaaaatctagagataaagaaagtataaatataactaactccaaacacatacaggaagaaaaataatcaagtatagtaggcggtaaaagctt

SEQ ID NO: 501208 - DNA, 168 bp, Homo sapiens
gatcaatgtaggtgttttaaaatagaatttttaggtgtttttcttgacttcaattagaaaatttgttaagtgtgaacccttttatatctttaggagctgttttgggcccacaaaggatattttcgtgaagctcgtaatgtattttcccaaggagagaagcgacaccag

SEQ ID NO: 501209 - DNA, 870 bp, Homo sapiens
gccgcgcgggacggagcttgtgctgttggtcggtgggttcccgtgcggcggcgtgccaatggaggatggagacacagttgtgatgcatgctcctgtgggctgactggtgtgctgaggcctcagcatgcgctgagcttgagtgctggcctgagcctgctggttgccttcccctgcgtggtggggacgagctgggccccgctggctgtcatctggctggcgatggatgcctgccagaggcctctggcctagcatagtcggacagctgggcgaggtgagcagcccattggcagaacgacgtggctgccacctggagaacggacatgagggcctgttcccccgacatggccgaagtctggccaggcactggagtgcttggcacaggggacggccagcatgtgccgtgggtgcttgggacgtgcgcagacctgctgtgctgccccccggaagcgaggaaattcaggcaccggctgccagaaggggcgtaacccgagtagttccaacacgtccatagaccacgaacaccgtaagcggactcggcaacggcgggcggagacacaccttgcttccggtctgcgctgggcccttgaggccttggggaattactttaggcgcaacactacatgcactttttcaacacgcacctacttcttaccctaacaatttttgggcaagacagcgatccgcttgtgaacccttgttaccacactacaagatattgcgaattcccccacacgcactttgcgaaccgggttcagacgacggaggcatagcgggggcttataagtcccttgttctccaacactgcattgcagcacccaggctgcatggccagaaagtggttccataggacccaagaaaaggcgcagccac

SEQ ID NO: 501210 - DNA, 353 bp, Homo sapiens
tttttggggaaaaaaaaaaaaaagggccccccccgggcggcccccggcaccctttttttccaagggaaaggttggccccaaatttcccggccccccggggggggctttttccccttccccggggggttttccccaaaggggaaattttggggcccccctttattttttaaaaaaggggtccctgggaaaaatgggaaaaaaaaaccgggtaggttccccccgtttccccccgggggggggggttgggttaagccctttttacccggggccccccccctggggtaaaaaggggtttaaaaaaaaggggaaattcccgttaaaaaagttaaaatttttaaagtttttttttttta

SEQ ID NO: 501211 - DNA, 550 bp, Homo sapiens
  misc_feature (534)..(534): n is a, c, g, or t
tcagccggaccctcgcgaacgtgttatccgtgtcagatctgaagatgacaggagcactgaaggaggtgaaataactgattgctgtcctgaagtgatttttgtagaaatctagtctaactgctctagaagggactgtagatcccaaatagagagactattttgtttgcagatttggggagcaccttgctgcactttgtcatacaattgtgggttgtggctggaatcctgagaagaaaggtttttctctcaagtgaagcctggtgggcactttgtatataacgtccagtacttctaaacagtgcatggaaaatatgactaaaagaaaaattttcagccaggcacggtggctcacgcctataatcccagcactttgggaggccaaggccggtggatcatgaggtcagaagatggagaccatcctggccaacatggcgaaaccccgtctctactaaaaatacaaaaaaattagctgagtgtggtggcgcgcctgtaatcccaactactcaggaggctgagcagttgggataacacgtncgcgagggtaccgagc

SEQ ID NO: 501212 - DNA, 547 bp, Homo sapiens
  misc_feature (531)..(531): n is a, c, g, or t
atagatcgagtcggtccctgggaagtgtatcgggtagatgtgaggtgactgtaaagtggaggagggacatagctgatggtgtcgtgcggcgatttacgtagaaatctagtctaactgctctagaagggactgtagatcccaaatagagagactattttgtttgcagatttggggagcaccttgctgcactttgtcatacaattgtgggttgtggctggaatcctgagaagaaaggtttttctctcaagtgaagcctggtgggcactttgtatataacgtccagtacttctaaacagtgcatggaaaatatgactaaaagaaaaattttcagccaggcacggtggctcacgcctataatcccagcactttgggaggccaaggccggtggatcatgaggtcagaagatggagaccatcctggccaacatggcgaaaccccgtctctactaaaaatacaaaaaaattagctgagtgtggtggcgcgcctgtaatcccaactactcaggaggctgagcagttgggataacacgtncgcgagggtaccgagc

SEQ ID NO: 501213 - DNA, 857 bp, Homo sapiens
tgagcggggtggccaggctgctgaggagctggggccggggcgggacgggaggcggtgcgtctgctgagcgcaggccgggtggccgcggagtatcctggagctgcagacagtgctgggcctgcagcaccagtcccgggctgtcctctgccagcgaactcctcctcgagcccttgtggctgcgctgcacgcttggggcccctgcggtgggtttggccgtgcctcagctggatgcctgcctggtcagaacctccagtctaagctgcatgcgacgtggtgcgcatgcacttggacccagggcgacacatcgggaatgtgacgactatcgtcgtgacagtacgcgtttgggaccgtacgagacacgaaagcttccaggtggttgcattctgtgcgagaaccacctggaagcagggtgaattacaattgcagtaggtctaagttgtaggcaaggagtgactggcctaattgcccatggggctttttcttgggtgccttataagactgcactggacggcttcgccaagtgaaaggacctggaggggtagaaaccccatggtgaagtgcaccccgtggcattaccaatgctgtcgtgctgtccacacgatgactatctttgcataatacctggtgccggacccacagggggagaggcccacgcgttcccggcgtcgttgggggccaagcgatgggaacagagggtccacgactaggcacacgcaccgcgaaaccgtagcgtgccgattcaagcggcgccattgacacacagagggcaatttgcccgaggaaattcgtacatacccagtccttttagataccggacgaaccctttcctattgcagcccttggtattaaagacgaca

SEQ ID NO: 501214 - DNA, 221 bp, Homo sapiens
cactcttactctcatgcacaaaataacataagggtcaacggggataagagagcagtatataaaagagaaaacaaccaaatgtaatcctcctgctagcccagcacaatttcctgaacactcacttatatctacagcactataggtcacaaaatagctctcgtgaactttaaaaacagttccttttagtttaagaaaataagattttataaactttttattat

SEQ ID NO: 501215 - DNA, 211 bp, Homo sapiens
tgcctttcctcacgaggagtctctcaaggtgtgctagcagtgggccatgcccaacttcaggcagaacagtggaggccagagattacagatccccatcctgtaaggtggccaggcattctctcccctgcctctctgggacctctggggtcatacatcacttctttctgccatgccccaatccccctccacccctacacctgtcagttcttgc

SEQ ID NO: 501216 - DNA, 856 bp, Homo sapiens
  misc_feature (782)..(782): n is a, c, g, or t
aatcccagcactttgggaggccgaggcgggttgatcatgaggtcaagagatcgagaccatcctggccagcatggtgaaaccccgtctttactaaaaatacaaaaattagctgggagtggtggcgtgcgcctgtagtcccaactacttgggaggctgaggcaggagaatcgcttgaacccaggaggcggaggttgcagtgaggcgagatcacgccactacactccagcctgcgacagagcaagactctctcaaaaaaaaaaaaaaaattttttttttaaaaaggggcggggcttgggggtttgggcactgtagttctcagcaactgtggggaggctaaagtagtaggatcgctgtgaccctgggaggttgaggctgcagtgagcggtgatggtgccacgtgggctcacagtttgagtgacagagtggagacccttctttgattcaaaacaaaaaacttggtttctcctctctctcgtggtttaatctctatccattggatgtagtgattctaaatgcttggggaagttaattcttaaccaaaagagacttgtagtgggcccacccattaagtgaggtgcgcaattaaaacccggggtagtatggggtgcggaacattgggttttcaaaagataattctagattaggaacttcatattaaaaggttttttggggacattacggttaatcaccaggtttaaggaggtcgttgagcctttaggaggagggttggcgactacggggcgcaggggtataatgaagaggtgcggttaaaattgtcaganagagaggcgaaggcgtttgtgttatagcaaggtataaatggaagggggggaaccaaaaacggacaaaaagaggg

SEQ ID NO: 501217 - DNA, 265 bp, Homo sapiens
atactacgcttctgtcctaaactttatacatatttcaatgaaggtacgatatactctctgaacctcaataccttcgatatcatatattacacttgatccatattggtctctttgtttcgggattttcctatttattagctcatgagcggtctcaccttctcactctggctgtgctccttttcccggtctcgcgttgtccttactcctcagcttcctgggtctgtggccttataggcatcaccctggtctgtcgcgtatcctctcc

SEQ ID NO: 501218 - DNA, 640 bp, Homo sapiens
ggagagagagatagagcgagcgagagagagacagagagtgcgcttgcgagagagggtctgagatggagagactagatagcaacggagggacttccaggattagcacacttaggactttacattaggcatggcctggtatcaaaccgcggcataacaataactattggaggctaccatagaactatgaagatcaagtcttctctatactgaaactctagcaagtcagatgccacatttcttattgggaagtcaaacagggaatgtcaaacatatagacgtgaaatgctgaccagaaagacgagacagaattataggtaactcaccagatgctagataaatattttgctgtgtagcgccatatctgtgagaccatagatcagtatgatagtctcggtatcacctgtaagaacatacagaagtattaatcattatacacatcctgtaggttcgcgactgtgtgaaatgcactatgcacagggcagagaagtatgttcagaggttgtgtgagggaaggagcacatgacggggtgaggatctatctgtgcaggacagagatgagcactacggatcagtgtgtgtaatgtgacaaggagttccaagttcggtaccacatgttaccccacctggtatatggcacacc

SEQ ID NO: 501219 - DNA, 122 bp, Homo sapiens
ggtgctactgtcgtagagcttgttcacaggggatctagaactacatcggcacgtctgatcgccgatcacctctgagacccaccttgctcataacaaaatgcccatgttggtcccctgccaca

SEQ ID NO: 501220 - DNA, 411 bp, Homo sapiens
caacctcgcacctgttatgtcgctaaagatactgtcttacctttagtctctgtgccagcatcttgtacatcacttattctcacacaacgaagtgagaacaagcacatcacggggccaggactggaacagaatgaatgacttggtggtcatgggcatctgttcctcacaaccagcctctttctttaaacgccatggatagccatcaacatgcaggctgaccggaaaaagaggcactgtctgtcaccatggagaccaagagcagatagccacgctgctcgtctccaacctcttctcagtggcggtgggaactggatttagaggatggggttacgcaactaacaggataaaccaatgacttccagacgtgctgtcattaggaaacatctcagaatctgtagtgctgcacttcaa

SEQ ID NO: 501221 - DNA, 277 bp, Homo sapiens
  misc_feature (84)..(84): n is a, c, g, or t
  misc_feature (197)..(197): n is a, c, g, or t
  misc_feature (215)..(215): n is a, c, g, or t
  misc_feature (229)..(229): n is a, c, g, or t
  misc_feature (239)..(239): n is a, c, g, or t
gttttatatgctaaaaagtggatacactccagattggatatttctgcctgagaaatgtaatgcggattcagtccagatcagggncagcagttgcccacatgttagttcaaggtggagggcctctgctgacatcacacaggttgtaggtgtctttatgggtacaatctaattcagaggtctccattctgcttgatgcnctgaggataatcgcccanctggaggcctttcnagccggggtnccttggagtgccctatccatcccctcaagttccaggtc

SEQ ID NO: 501222 - DNA, 86 bp, Homo sapiens
ggagagagggatggtttctgaggggttctgaaagtatgattcactgtgcaacatacaggtaggtctcagcataggctgacatatat

SEQ ID NO: 501223 - DNA, 341 bp, Homo sapiens
tatccccatcaaccctaaatctattatgtatgatataaaacttaactcacgaaagatgaggccaggtgcagcggctcatgcctgtaatcctagcacttggggaggtcaaggcgcgtggatcacctgaggtcaggagttcaagaccagcctagccaacatggtgaaaccctgtctctactaaaaatacaaaaattagccaggcatggtggtgcacgtctgtaatcccagctacttgggaagctgagggagaaaaagcacttgaacccaggagatggaggtttcagggagccgagattgtgccactgcactccagcccaggtaacagagcaagactctgtctt

SEQ ID NO: 501224 - DNA, 489 bp, Homo sapiens
tcatagtctggacatgcagtatgcgtagagcttttgtctaggcagataatatactttttccatcttcagtctttagaactagaggattccttgcgctggtttacttcctctaatgaaatttattggctcggctcctgcacggttgtatctgtactttcctgctgattgattttcttcttctcttctttctcaactaattatttcatagggtcttgtatagctgctttaaagtattaaattcatatggttgattacctttgagaactctcatggactggctgccatagtgtgagaagtttactcccaaaaatgaagcagagtggtctggtatgttgctagcatgtgagacaagagattgcatctgctcgctccaagaagatccactttttgacaaacatccatcttcaatttgtcagagttttttttagcaaggggcacttgtgtttgtaccttcctgaacttctccatttgcttgtagaggtctggatc

SEQ ID NO: 501225 - DNA, 181 bp, Homo sapiens
agagatcctgcccaatgtgtatacacagcatgtgcaacactcagaggtccagattcccactatggcacaaaaggattgaagagagtagtgcatgagacacctgctgcgagaagactgttttgctctttttcagttccctggcaataataatggcacttcaatagaagatggacaattccag

SEQ ID NO: 501226 - DNA, 208 bp, Homo sapiens
tttatgtttacgaggaacagcagaagagcactagtggtgaatgaagaataatgttaccgtaggaaaagcagtgtattgaagcatgaagattacagtgactttgatttactttggagagcaaagctatagatggcccacaaaacttcatatttgtggctctgtttgcaatgatcattgtatataaatgaatcgtaagacataaccgcgg

SEQ ID NO: 501227 - DNA, 728 bp, Homo sapiens
  misc_feature (50)..(50): n is a, c, g, or t
  misc_feature (82)..(82): n is a, c, g, or t
  misc_feature (86)..(86): n is a, c, g, or t
  misc_feature (89)..(90): n is a, c, g, or t
  misc_feature (95)..(96): n is a, c, g, or t
  misc_feature (114)..(114): n is a, c, g, or t
  misc_feature (130)..(130): n is a, c, g, or t
  misc_feature (133)..(134): n is a, c, g, or t
  misc_feature (144)..(144): n is a, c, g, or t
  misc_feature (149)..(149): n is a, c, g, or t
  misc_feature (152)..(152): n is a, c, g, or t
  misc_feature (154)..(154): n is a, c, g, or t
  misc_feature (169)..(169): n is a, c, g, or t
  misc_feature (188)..(188): n is a, c, g, or t
  misc_feature (200)..(200): n is a, c, g, or t
  misc_feature (210)..(210): n is a, c, g, or t
  misc_feature (214)..(214): n is a, c, g, or t
  misc_feature (218)..(218): n is a, c, g, or t
  misc_feature (224)..(224): n is a, c, g, or t
  misc_feature (235)..(235): n is a, c, g, or t
  misc_feature (250)..(250): n is a, c, g, or t
  misc_feature (264)..(264): n is a, c, g, or t
  misc_feature (275)..(275): n is a, c, g, or t
  misc_feature (343)..(343): n is a, c, g, or t
  misc_feature (354)..(354): n is a, c, g, or t
  misc_feature (398)..(398): n is a, c, g, or t
  misc_feature (416)..(416): n is a, c, g, or t
  misc_feature (425)..(425): n is a, c, g, or t
  misc_feature (429)..(429): n is a, c, g, or t
  misc_feature (435)..(435): n is a, c, g, or t
  misc_feature (458)..(458): n is a, c, g, or t
  misc_feature (465)..(465): n is a, c, g, or t
  misc_feature (467)..(467): n is a, c, g, or t
  misc_feature (482)..(482): n is a, c, g, or t
  misc_feature (504)..(504): n is a, c, g, or t
  misc_feature (536)..(536): n is a, c, g, or t
  misc_feature (568)..(568): n is a, c, g, or t
  misc_feature (725)..(725): n is a, c, g, or t
acagatgaagcaccgagggttactacgttgtcttccctagatcaattttnttctggatggctcgtgctgagtggtagatgancgantcnntgacnncagccactgttttcatgnccccaatgatggcgcnctnncctgttaggnagttngtnanggacctgttcttctncgtcagcttcaccatcatnttcgagatttcntagaggacgnagantctnggaagntcttggtcgcncaatatcccattggnaaccttctcatgtntggtcacatanaactgatttgttctcagtacctctccgtccaccttcatgtacacagtgggcaccaccttcacaaagtnttggtacattntggaggcttggggcgcagtgacattggtgtggtccagggggttnacaatgcctggataggtnctccccaantganaggtgntggatgtgtgtgggtcatgttgntgttgtnanggccaaagctctgcnagttatggacgtgcacatgggncttctggaagctcttcccaggggcaaagtggnagttttcggccaccttattgtcttttaagagncatacacctggcagccttcattcttctgctcctgcatcttctggctgaagccctctcgccggcactgctcaatagtatctgggttcttgaaggcacagcctctacggcgatatgcctcccgcacatcttcacaggtgtcacagcacttgatatcttntgc

SEQ ID NO: 501228 - DNA, 621 bp, Homo sapiens
  misc_feature (164)..(164): n is a, c, g, or t
  misc_feature (366)..(366): n is a, c, g, or t
  misc_feature (396)..(396): n is a, c, g, or t
gtgtttcgttacttctttgcttatcccgttcagttcacattgtattactgcttgatttctagtttggtttttccaaatgattgctctttttctgtgaattttcaagggttgttatgtggttgtcatttgctaatgtgatgaacaagtaattcaagcaattatcntttaagatagttatatatttggtcagtttttactattttacgtaattatttaaggggtgagtatttttcatatcatttattcctaaatgtcactgatagcatggttattggaaataagcaaaattaatctcattggtacagattttagggcctatatatgttgcttaaattactttagaaatttttttcttgaaacgaaatnctctgtatataggacataaaccatgaattngttaattggtttttaaaaaaattaaatttcacttgacaaaaatggcagtcatggaaaataagtagccagctttataagcttctttgccaaagtgctgggattacaggcgtgagccgccgtgcctggcccatcagccttctgttaatatatgtcggtaacttctctgtctcattcttttcatctctcattcatctccaatttccatctcctcgagatggagtctgg

SEQ ID NO: 501229 - DNA, 1002 bp, Homo sapiens
  misc_feature (441)..(441): n is a, c, g, or t
  misc_feature (450)..(450): n is a, c, g, or t
ccgtcatctactctaccatctttgcaggcacactcatcaggagcgctaaggctcgcgctgattttttacctgagtaggcctagaacataaacatgctaggcttatgattcgcagttctgaaccaataaaagagtaataccgctcgattgccacacgaagactgccagtcaagtattatcctcacagcaatgcaaagcctgcatccgataatccgttctaatagctatcctcttcaagcaatatactctccgggacaatgaaccataaccaatactaccaattcaatactcatcattaataatcataatggctatagcaataataactaggaattagcccccgtttcatcttctgagatcgcatgaggttagcccaatggcagccccgtctgacagtccggcctgcattctgcatcagcatgacaagaatagatagcccccnatcgtcaantcagtatttaccaaaaggtcatcatcacactttactcagaacggtaggagccttgctgccgtcgagctctgctcaactgcgttatccattcgatagacacggcagttgaggatggattagagacgcaataccgcagcatacgcgaaaatcttagacatatctccatgaattacccaacataggtagtgaagtaataagcagttcgtaccgtacaatcctattgataaccattcttaatttaactatttatattatcctaactattaccgcgttcctactactcaagttaaactccaggcaccacgaccctactactatctcgcagcctgaagacaagctaacatgactaacaacctttaattccatgcagcctcctcttcctaggagggctggccccgactaaccggtttttggccaaatggggcattatcgaaagaattcggcaaaaggcaataggctcatcattcccagcatcaataggcagcaataacctcacttaagctctattgtacctaaggctaagtgtatccacttcaattcaaatagtcccac

SEQ ID NO: 501230 - DNA, 139 bp, Homo sapiens
cgttagaccacaccttctgtcatggcactttgtagtcgtttcatcgagtctgaggctgctcccacgggattggttggtagaccatgaagttgattcccgcctctacagcatctctgtgccagcactcgtcctatactct

SEQ ID NO: 501231 - DNA, 161 bp, Homo sapiens
catttcgctgcagcaggttagcggtgagctcggggccgtaggtctccaggttagacgctgaccagcttgtcggtgaggtccaagggcgtcatggacagccggcgcgccccgcgggatgcgcccgtagccctcgcgctgcgtcaccgacagctgcttccgct

SEQ ID NO: 501232 - DNA, 249 bp, Homo sapiens
acagaatgccatcgtgtggaatatcacgcgcattgcatgccttaaggaattcgcagatcatgcgcagagattgagcttctgtctaccaacgacaagaatgaaatgggctcgagccccatttccattaactttgaggtgcctttcggaccctctggtctcaaggtgcgctacttgaaggtgtttgaaccgaagctgcactacagcgaccattatgtcctcaaatgggtgcgctacattggcccttatgag

SEQ ID NO: 501233 - DNA, 470 bp, Homo sapiens
ctaagccaaacaactgataattttcaaaatctattttttctcctgatttaatggtcatacttgaaacacaattatatccaactgatccatgttgtatatgccttattttcaaaagtctcatttaagctcattcatgccctttctcttatgtagtcttcttcgatacgaaaggagcttggaataaatatccattagagcttttaaaaacacaaaacaatgctttaatgtttcttttttcctggactgagtttggctgaccaacaaaatctctcaagccattttgttttgatcctaaaatatcaatggtggctctcgaaatttggtagatctgatatcaagaaagaatttcaaagatttttatatcttttcaaaatgtattttatagttgctttgcatacactaaataactttgtttatgtaaactgtcaatattatcatgtaataaaataaatttatttttaaaacaaaaa

SEQ ID NO: 501234 - DNA, 138 bp, Homo sapiens
cgcctgtacactgggcatgctgttaatcagaggacaggatcctcagtgaaagtgacccattcgggatggcatgtcactccaggaataaacacaacttagtaaacaaactgatttccgtcactgatagctacagtgact

SEQ ID NO: 501235 - DNA, 468 bp, Homo sapiens
ggcccaatggctggtggcttgatgcatgcgtgcttcatagtgctgtgtcctgggagctgcgcatccagtgccgaggagatcgtcttccatgacctcaacctcactggctgcacggcatctcccactgccaccacctgtcgggaccggcccatgccagaatggcggtcagtgccatgactctgagaggcagagctacgatgtgcgatcttgcccagcatggcattcacacagggagccgcatgatgagcactcgcaggcaccatgcgacatgccatacacgaggcctgtgggcaccgaaagccaaccatgtgtgagaacgggactgatagcgaacgaaggctacaaacatgacagcagtgcacgaactatggcgaaggcatcacaagtatgaggcaaagatgaaagaaggggagttgagaaagagaaacaaaacgaaaagaatagaagagataaatgaacaacacaaaa

SEQ ID NO: 501236 - DNA, 218 bp, Homo sapiens
  misc_feature (191)..(191): n is a, c, g, or t
gatcagaggattagatgtatgccaacacttttggggtctgaggcgggcagattgtttgagccaaggagtttcagactagcctgggcaacatggtgagacccagtctctaaagaaaatgcaaaaattagccaggtttggtgtgcacacactccgtgtagtcccatgctacttgggacggctgacggtggganggatcgcgctgagctcgcaggtgaggt

SEQ ID NO: 501237 - DNA, 271 bp, Homo sapiens
gaatgataggacaaatcccaatgatttcgcatccgagaaagttaatgcgaggacatacgagcaccagcggcactcttagggggctagtaagaaaaatccgtaataagcaaatccgtaatcgatcctgaatggggccgggggctttttttgcgattggaacggcgattcaacataatcaccggtatgatgcggacgcttaggagaaatttcttcagtgccaaatatagtttacgaactagggagcttatatacttctagaggacgggcgagc

SEQ ID NO: 501238 - DNA, 1259 bp, Homo sapiens
cattcgtatgtcatggtgaatgccaaatttgaacgaagaatcacaagaacctgttgctgatgaagcaagaggaacgacagtgactgactgactgcttgaagccatattactgacattctacgactctgctgcctacgtgataacatcagccgctcgccgacggcaaactgttcacttgcacactgctgcgcaactgccacggccctatgccattcccagactccttgcagcgcatgcagcgcactctcacgcactgcacctacgcactgcgacgcaacgcaactactgcactgctgcgcacagccacactgcaaccacaggcaccacgggcggaacactccgcctacattttttaccatcgcttactgcaccgcacagcgactttattcccagtgctaagcagccacgaacacggcccacacgtctcaccacctggcaccacgcactctaccacacgcgcacagctgcccttctccgtccaggcgtcgtgctgcacgccatgcctccacgcctactacactacctgcgccctgcgagcgatccacggccaccccgcacacgcactccccacggtacacgaagcacactccactcgcaccgcactgcgcgcacctgagcactgcgctgcgcacttacccccaccaaaccgaaaccataggctccgctcttgctgtctctgccccccgccccgcattgtctccccactgcctccgccctcaccctcgcacccccctgcatcctcccctcgcccccggcccccccccacctcccgtcgccctcccttccccccgcctccccgcccccccgccctccgccctgcccctcctcgtaccaacaccattcacctgcagccacgccttggtaaacgcgtcttttatcaccttggaatctaaaggactccattcataaatcgaccgcctttaattagccctaacaatcacacctctacaacacgctggtgaacacgctaacagatcatcccacaggtcaccccggacacccacccccacggagcccttatagtttgcccgcgaagccactccacaccacactggtcttggtgctcaaccacacccgcctccatcccaagcccagctcaccagccgtacatctacctaggacaccccagtacaacacccacacacgcccctggcaactagcaacgagtctcaccctccgtccacgccaaggacacgggcagcctaacccgccacgacccacacacaaaatacataacaccactcaaacacagacgccgt

SEQ ID NO: 501239 - DNA, 178 bp, Homo sapiens
tatgcttaatcctgggtggtaagagagtcctcctagagatattagctgatgccacatccacgagtgccactactgtcgctcaatgcccacgccctctcacagtgatgatgcagcacccactccccaggccccgcccacgccctctcacctgagaacatgcaccatgctccccacagcg

SEQ ID NO: 501240 - DNA, 1022 bp, Homo sapiens
atgactatactcgtacctgtgatgatagcagactcgagaaacaagcgtcataccactattattcgacgccatgaacctgcgaggtcctaaggagccgttctacatctccattatgcaaatcccgtaggctggcgccagacaagggcgaagcctgtcttgagggttatcctgtaggggcacaatgtagggaagcgctcatcgctaaacagtctggccatgcgaatctagataatcatttctttcattcaatagctcaatcaccgcatctgtaactccgcggagcgcggttcggctcacactcgcagtcatgtgtcccccttaagtgagctcagggttgcctcgccggagtaattggagcggtttgtcccctcgggcaataaaactagacatatggcgttcctgaggtcttacacctgctcatcttcctcgccgtactctcgtggtccgcatcatgcctatgagttgggaggggcccggtacgcctaagagaagcaagtgttggcgagcgaggtcctaatttcccttcactcctttaagcctagggtgactatcttaaacttctccccagcacgcttgggccaccgtcccctactccgttaatggagcccttaaaaacacaattactgtacttctcgtattaactaaccctttgatcccaaggattgtccttgctcggtctaattacctttagggggcggcgcaaattccatatgtttctacatttcaatctaacccaaatttataactttccacatgagctgaacaatgccgtggcgcatgacccgactaacttcgcgaatggtacccccaagattgtctatcccccttctgtgcgaatccttgatgttcccggttcgccttaaacatacaacatgcgtaatgcatacgcataagctgtcattccctatttcattcctgcgcgcagttccgtacgcgcttgtcggagactggttccctttatttaccatatctaaatcagaacctggtaaataacatcaaaccaacccatactttcttggcgg

SEQ ID NO: 501241 - DNA, 115 bp, Homo sapiens
atggagcagacactctcatagaggtcatcccagattacgatgaggacctggtgcaggaagcttcatctgaagatgtcctgggcgttcatatggtggacaaagacacagagagaga

SEQ ID NO: 501242 - DNA, 1243 bp, Homo sapiens
  misc_feature (262)..(262): n is a, c, g, or t
  misc_feature (291)..(291): n is a, c, g, or t
  misc_feature (370)..(370): n is a, c, g, or t
  misc_feature (727)..(727): n is a, c, g, or t
  misc_feature (866)..(866): n is a, c, g, or t
ctctaccgaagatcatgcggagcgcttccgagccatccttgcatcgggctagtccacattagaggatatcaattcgcttgcatcggacgtgagcgcagcgatccgcctgtagtgcgtggctcttgtgcttccttaaggtttgacattatagcgacctgatcttcaaggctgcacagggggaggaggacgtaacgcccacgctatggatcaccacattattcatggctaccccatcttcatcaccagaaggccagtaactacnatagttatactcagaagagacacgctgcnctcgcgtacaggccactcatatcctgagtacatggcttcaactagggggcgctatacacacttatctatagttgtgccntatacatttttgtgcataatcgccctatcggtgagcccatggtgcaagacacgagtataagacccatttcgctacgtagctcggtagtcgttccttgctccacttcctccatcattacctgattgatccataggcccctaggctgctagtctgatagtcgcaagtggtgatggtttgactaggtatgtctcagataaagcctggtgccccaggacccaagactagtattgagactaacatagaagtactttacgacgcgaacgtcaaggtagcaggcaagtccaagcacctgatgtggagacacatgggattttggaaatcagcttctggaggaatgcatgtcacaggcgggacttncttcagagagtggtcagcgccagacatttagcacataaaggaccaaacagcccaggactgcgagactctggacgaccgcaaggagcctgattaggtactatggaacttttcttagggggacacgtcctcctttcacagnttctaaggtgtccagtgccttgggatggtttacaggcaaggcattcgggcaaacggattaagcctcttaggagaagatttccatatggggaaataggctccagagctgcctagtagggggggcggcaagggcactgttttcttcacacaaaaccaaaagggttataatatgatgacactggtgattaacggaggaacgacaacaggggaactaaagaatagggggaagagtaatagagcaagaaaaacgatgtggttgcagaataagttgtaagaacaagtataaaaaaaagaggggtatacgggagagacaaacacgagaagaagaagaaaaataacagaaagaaggagagatagaaaaagcaatgaattaatact

SEQ ID NO: 501243 - DNA, 284 bp, Homo sapiens
ccacacttcatcggagaggagcagactctgtctagaaaaaaaaaaatagaaatagaagagaaacagtggaactgccacagccaccccaaccttcagcagccaccaccctgatcagtcagcagccatcaacatcgagacgagacccttctccggtggcgtggtaccacgccaccggaaaagggtctcggataacgggatggggcctcggagggtccctgtaggggctcgtggggtcccatggatcaacgcacgggcttgacactggaatgacagctggggtaggg

SEQ ID NO: 501244 - DNA, 122 bp, Homo sapiens
cacctccagcggttgctttaaaggggttaatttctgagaaaaatgttaacataaaagttttggccaggcacggtggctcacgcctgtaatcccagcactttgggaggccgaggcaggcggat

SEQ ID NO: 501245 - DNA, 1809 bp, Homo sapiens
  misc_feature (351)..(351): n is a, c, g, or t
  misc_feature (1196)..(1196): n is a, c, g, or t
gatgtgcggcgtgttctgagggtgtgcgagagtcctctgggttggcgcgctaattttccgtcgcacgcgaggggccccacgcggtggttgtctgttgttcgtcctgtgggggtggtcaccagccagcgtgtgttgtttgtgtgaccgcgcgggcgaccatacgatagttccttcagggggggagtcgtcttagtttctggttgttcgtcaggctcgactctctctggtcgtccgtcgctcctcttgtcctcgtgagttgtcgtccggttcgtttgcgcggcgctgtgttgtccaaacgtcgtcttcgtgcctcgggcgtgaccaccatgtcgttgtgttgttggccgcgcngccgacatgtttgttgtccctggtcgctgtatttgccttgggggaggatgcacaccgttgtcccacctgggtcgcccgccctcctgttttgttgtgttggttgggcgttttgatggctcgttacccgccgtgtgctgggttggtgggccccccagagtccccccgagcccccacgtgtggaggggccgttctccccccagcgggattgttgttcgttcctcacggaagattgttatgttgtcccgcccctcgctgcacatcgctgttgggggagagggctccacagtcccccctgttgtctagctagaccacgaaccgccatttgggggaccacaaacaggttggtggtgaagaccccctctgtcgactggggcctctgtgtgctggcgtaagccacaccccgttgtagcaccttcgtcggtgtcttgtcctttggggggccgtgttgtcgtgaaatatttgtccggcggccgccccggccctgcatagggtattaattggtggggcgccttcttcctcttggggagaaaagcggcctcgttgggagcgccgccccctcgtggtgtgttgccgccccgccggcagattcttggtggcgccccccgaagtgggtagagagattgccgccgcgcgcaagggggggctgatcaccgagagcgctgttcttgtctctgcggagaaaggaagaggtcgcgccgacaaaagaccccccagaccgtgtggggcgcgcgtccccccgcccgtctagtcttgttgtggtgtcctcaactgcgggagactacttcttcttcagcaggagtatacgcctccacagctcctgctggagaatagaggtgtggagagtngtggggggtggtgttaaaaacactccccgccaacagaagacgctctcactagtgtgatatagccggtgcccaccactgtggcccccctctgtgagagagatatatatagctgtgatgacaccccagggcgcgccctgtttgtgggagatactcttctacagtgctcccccctgtggggtatcttggcgctccggcacactcgagagactcccacacagtctgtctctcgtgagagactttccctctggagagaactctcacactcttctctcaagataagagagagagaagttgagaagctcttatctcacacgagaagaattggggtggagccaccctctgagccacacacctctccaccacgggctctgggtgggcccgcgagagctgggctgtgggcgagttattcttctttcgcaaagagctcacacttctccacagacaccgccctaagaaaccctctttgagaccccgccgcaactttctgtaagggccccctctgccacaagataatagggctttctgcctaaacctttccctcccagcccataggcagcttttttaactatccttaccacccttggaccccaatggaaattaaactttttgaacc

SEQ ID NO: 501246 - DNA, 656 bp, Homo sapiens
aggtggcagcccgagttgcaaccttgaagatcggcggactgcctagtaggacgggattgctaccgaagcggtacgagttggccccggaaccataggtgcacgtagcagccatataccttattggggggacaattttacttggcccattgtggagcagccccccttacaggggccttagcctcggccacttaggtttggagcatcggcacaccaggaacgcctttggaacacaccatttttacacattaagggccggttcccctaggggataaaccccaaggttccccacactggccacaacacactctaatttcccccatgcacaccgcccaaggggataaatccaccttatcaaattatggccgcccaagatgggaccaaatcaccttggggacgtgttggcttacacaagctcccactaagggcccaatatcgtggcaccaccccctcccagttacagattattagatcgaacaataggaggagagcttcacgaaacgggccccccagggcatcgcgggggtctcccaaaccaaattaggatgacacgtgaacgggcattattccgaacacagccgggacaaccccacgtttaataccgtaccccccaattattgtggcaccttagggacacccacttgcctgaatacacaagg

SEQ ID NO: 501247 - DNA, 351 bp, Homo sapiens
gattatactctgtcttgagctgaagtgcagataacaatgtaaggaaaaatctatcttccccagcttcgctagcgatgaaaagcttacccgcctggactgttattcttccacgagagatgggatttctcaggacctagttgctactggttcagcaactgcagaaaatgtcctcccttgtggcttcctcagttcctgcccttgggctgaagtcccagcattgatggcagcgcctcatcttcaacttttgtgctcccctttgcctaaaccctatggcctcctgtgcatctgtactcaccctgtaccacaaacacattacattattaaatgtttctctaagaacagcgtataatg

SEQ ID NO: 501248 - DNA, 1579 bp, Homo sapiens
  misc_feature (960)..(960): n is a, c, g, or t
  misc_feature (1579)..(1579): n is a, c, g, or t
gccgattagcccacatcaggttgacagaagaggcacagcagatcagacccacgaggctcagcagaaagtagatgcctatcatctgcagctccagaacctgatgtatgcagtgtgcatgccacctacagcaaggagcatcaccaacatgttctgcgcagtttcaagtcccacagccatgcaagcaacattgcatcctggtcgagatttagcaggcagtttatcataaggaatggctcccaccagcatatacagcaaggccgacaagtcacctatgggcagaccctccaccagcacaacaactggcaacggtcatggaacgtggagacgcctggagaagcaagccgggacaacccagggctgggcacgacgcaaaggtacccggaagaaggtagggcgtcaattctaaacccaacggcacgaaaggacattcatctcgcacagggggaccaaatcgcgccacgagacgaacaccacaaagcgaacgatacccatcatgcaagaacagaggacaccaatcaccagagggaagcacaccacagaacgagcatcccacacacacaggcacactccacagttggacagagaggagacaacaccacatgaacacgacagaatgcaacacggcgacagggatcaacaccggtaggcaaaacgcaagttggacaacaacaataacaaggaacgcacaagcgggagctgacgaacaacaacgacaacaggaaaaataggaacagcaacaaagacaccacagaaacaagaccccaagacacagcccgaaacataaccacccagccgataacgcaaagaaggatcaacgccacctgatggagggcgacgacacggaggagccaacgctaggacaggctgaaaatcggcggaagacgcaacgagcgagacccaagggcgcgaccaataacaacgcgaacacggacatacagaacaacgtaggagtacggaggnacaacacaatgacaggacacacgagagcaccacagagaagaacagagagacatctaagacacagagagcacacaacaacgggagcacgccaccggacgagtaccaaacgagaacctcgccccgcacaccacagcagacaaagtatcacccacagccacgcgcaactgccaacacagccacagagcacagattcgcatacactaccaacgagcagctgacacccggagacagagagcaatgaggagaacgacccaacaaaacaacgaacacccgagaaaccagcagagaccacgcggaagaaagtaaaacacaccacaacagaaaacatcagcgaagacgaaggtacgacacacgacacaaagagaacacgacacaaaacaaacaaccggcaaacaaagaggacagagacaccagggcataggacacaacgccaagggcgccaaaccaccacagacgactgcaatacacaagagataacacaaaggagacacagcgagaacgcacgggaacacacgatagcacaaacaagagaaatgcagcaacacagcagcgccgcatgcaccacacacaactagaaccaataatagcacgatacagcaacacacctcacacatcgcan

SEQ ID NO: 501249 - DNA, 192 bp, Homo sapiens
tcattgaccaggttctttccccatagtgtaatggggaacacgaggtgttggttacatgagtaggttctttagtggctacttgtaagatttgggtgcacccatcacccaagcagtatacacggcatcctattggtagtcttttatccctcactccctccccaccatttcttccccggggcgtcagtatagata

SEQ ID NO: 501250 - DNA, 868 bp, Homo sapiens
gcatctcatatctgggcgagatgtggcatgtccatgtgctttaaggcgacggtgggttgctgaaaggacgaacatttgcctcgtggaacgggcatctaaaccacagaatgggttagagaaaccagagggtggagcccacaagaagccagagagactgggccagactcctaagggatctgtgaagcccgaactggggccggtcctctcgcacgtgtgagagcggaagaagagtgtacgttgagagctctggcccaggagccaataacctgcgaggttaatgcgcctaatgtggtctgggtggctctggtcctttcccgggcccttggtcactaattccggcaatcccagttcttcactattcttggccccaagggtttcttcaggtggcctgaaagtggtacactggctcttgtctagtaaggggcggggaaccccaggcaggctgtgccccattattaaacatgatctttaccaagtgttcttgctttgcctgtactgaccttggggcctgggcgagctccatctgggggactcaactcagcccggggcacagagaacagagcaggtaggcataggttggttgaccaaaggaccaccatgacaaagggttgtctaagaaggaccagcttgaagtaacctgtgagtgaggcccgttgggtgcaatggttccacccatttaaagcaggcaaggcacgatatagcaggttacagcagtgattccaaacatgaaactgggggcgcctcgaaacaaggtcgttggaacttggtgaaagggaattacccctctcaagttagagttgccatgaatctagcagcctcaggttacatggtcaactgtgtccagaatgaaggcaccactgggcgagac

SEQ ID NO: 501251 - DNA, 336 bp, Homo sapiens
tttggaaaacttaagtctttccaaggcttgcgctggaacaacacaaacttctcccgtcagaggcaactagtctagcatccaaacatcatgcacaacacctaagtggcagcagcgcactgcgcccactcccaccggggccttgctaatttgtgcatgaaattggaagcatctgggggagtggaaatagtattggaaagaggagggagaaggaaacagcgtgagtgcttagctgagaggaggccagccaaagttgtgcagggcgagcctgaacatgtcattggggcaaacccaagcatcgttgatgttctttaataggaccatctggggggaccccat

SEQ ID NO: 501252 - DNA, 311 bp, Homo sapiens
gggcgtcgtgtaattcggaatgaggcattactgaggtatacagtgcatcagtgccctgaatgacttctaaggtactgcctatcagctccgttatctcacattcacttgcttctcgctctagactccatagctcattcatttcaatacactactagtaacatcccatttctcttgaccactcccatatgcctggaactggatcaattcaaatgtctgctttctccaggcctacaacagactactccattgccaaaggggagtacacacacacacacacacacacacacgcacacacatcattactttgagaa

SEQ ID NO: 501253 - DNA, 152 bp, Homo sapiens
ggcacaggcagaggtgactgtgccgcccgcgggctgtcttccaccggtggcgtactgtgtcattcgtggaaagaactatgatgcctctgagactcgtgagagaccgaagtcactgcagagactaactctataacagttagaaccatactcca

SEQ ID NO: 501254 - DNA, 106 bp, Homo sapiens
gagccccaaagtcccgcctgaagcctgtaaccatgggttgggccctgcaaggcccacactcaccccctgtgggtaatggtcccggtgggtgggtgggggttaaccc

SEQ ID NO: 501255 - DNA, 121 bp, Homo sapiens
tgggttttttttgggggggggggggggccccctttcccgggggggggggggaaaacccaaagcctggggggtttggcccaaaccttccccctggtttttataaaaaaagccgggggcccca

SEQ ID NO: 501256 - DNA, 589 bp, Homo sapiens
  misc_feature (67)..(67): n is a, c, g, or t
  misc_feature (101)..(101): n is a, c, g, or t
  misc_feature (300)..(300): n is a, c, g, or t
gtttggggacatccctttcctgttggacagcaacattgtagattgatatgctgaggtcatttctggntgaaggccttggaaggatggcccccttcccaccncccatgcggcatctgtcttcacttacaccacaatgccaggacagaaagctcacgtggaccaccacagaagttcccacagtgctgctctattttgggccacctggacatcagattgcatctgcaacaccacctgaagcaagagtgggacacaggacacaggtctgcagcacatagcctgtcccacagtccaccctgtagnactccatggcagatgttgctaatctccgttctcagtgatggcacctgagtttttaagtatgtggcatgtggcataagccgggttggcattcctggtctaaggagaccaaatgctagacgtggcccaggcagagtgccagcagacatggtgtagtggtgcagatgctgcagagctgtggcatctgagggactaaggggaccacttgaagagtttctgcacacgctgttgagagatgcagctccttttgccatagatactgaaagaatgacaaatccgtggagctgacatg

SEQ ID NO: 501257 - DNA, 279 bp, Homo sapiens
gaaaatttttttttggaaaatttttccccttttggtaaaattttttccctcccctttattgggttgccccctgaggaacccccccttacccccccttttcccccaggggtttcagaaaatttaatttagggggcccaaaaattgcaaggagggaccccttttgatttggttttttttataattttccccaacccctggggttgtggactgttttactcctgggtttttttaaaaattgggggggttttaataaattttaatttttttttttgcccccca

SEQ ID NO: 501258 - DNA, 1669 bp, Homo sapiens
tggcttcaaaaagctttattcccatttgggcccaaggctgtgtaggatagttaaaaaagctgcctattgggctgtggagggaggaggctttaggcaaaaccccttatttactttgtgcaaggggccctttcagaaagtctcgcgtgggcctcagaaaggcctcttagctcggtgcttgaaagttgagcctttctcgaagaagatacctcgccacagccacagccctcgcgggccacccaagctcgtgtgtggaggttgtggctcagggtggttccacccattcttctctttgaataagcttttacattctccctcattcttagagaaggtgagttcttccaggaaaaggttcaccaagaagatgtgggggtctcccggtgcggggcaagaaccacagggggcatgtgaaagatctccacaaaggtggccgtggttttcaggcttttttctctctcccaggggccccattgtggacgaggcttttctcatgtggccgtctctgtggggggttttataaccccccaaactctcactatcctctcaaaagtgtgaggcttctctgtgtgagagtagctcgctgtgggacacagacagaagcggcgagccccgccccacaaggcgctgtggagatatgtgggcacaactctttctcagcagaggagacacgctgcgctcggattaaagccccctctacggcgcgcgtaatctttcccctcttcggggcccaagatgtctcgcgcgggaggaaaaacaccacgtgttggggggcctaccaccagcgcccttttttccacaagaagaagaggcgcccaatattttcaactatcgaggggggggtccacggaacaatattaaaagataatggcccccaatagaagagagagcaacggtgttacaacgaggtgttgcattaacacgcacgcacggggcccctttcggcacgatggtggttccacccacaacttttttttcggccccccccatggcgtcttgtgttattagacaaccggcggtagtggagccccctcacccccaactgggtcccgcgggggtgagggggagaacataccaaaaatttcttccttggaggaaaggggaaaactcctcgtgggggaggacacggcacccaatggggggatctacggcgcttcggggggacaccacggaagaagggggcgggcgctttcaaacccgcacatcgaaaaaacaccgggggtggtccgctggggaagtagaggggttcccacccagacgaaaagctgccctgggggaagcaaataatggtagcccgcgcaaacaaaaagtatagggggtgtcccccccgcagaagatgactttttgtcccaaaccacccgccgaatgaagagggaaaaacactcacgcggaggagggggcgcgaagctctagcaaggcgagtgtatctgggtgataaaaaaataaagattcccccgcggagagaaacatttgttggtaccttccgctcacaaaaaccaccttggtgttgtaatctcagcaggagagtactgagctaccccccggggaaacccctacgtaagggagcgtgtgctaagtcaccgcgccaaactaaaaccctcggtcggcgatctctgtcttgttactacagacgacgattactcacaccaacgcagcgagcgctacaagagctatg

SEQ ID NO: 501259 - DNA, 234 bp, Homo sapiens
gccctttccgggggggcccccccctgggcccccccccccccccaatttttatttttgttatggtgggggcatcgttgaccctttcaaggggggggggccctgggccccaaattggggcccttccaccacccattaagggcggggggtaggggggggcgggccccccgccccccaaagattgttgcaaaaaaaaagtttggttgggttttgggatttgttgggcccgctttgtta

SEQ ID NO: 501260 - DNA, 136 bp, Homo sapiens
tctagaggatcctgctgctactactactagaggatataggaaacctcatggggggcgctggagcagaagagggtgcaggagggagagagtggggtgaatgtagaagatattggaggcagaaaggtttggagagtgt

SEQ ID NO: 501261 - DNA, 104 bp, Homo sapiens
gcgcgcgctgatcttcaacaggcacaccccacacgtctgccttgtctattttgtcccaccacggcgccttagtcagtttgtggcccacactcttttgtcaaggc

SEQ ID NO: 501262 - DNA, 251 bp, Homo sapiens
ggctcggtacctgttttcatggaacacacctgtctgtccctgagagacagacagcccccgggctgggggaacccacaaacccacacctcctccttaaagcacccagcccaggtcccacactctttctctagaacgggatctcctggtgggtgatgccgtctcccttgtgcccccagctgcctgtggtggattcctcaccaaactcaatggctccatcaccagcccgggctggcccaaggagtacccccagg

SEQ ID NO: 501263 - DNA, 294 bp, Homo sapiens
  misc_feature (138)..(138): n is a, c, g, or t
ctagtttagaagttcaatagcaatccctcttctgggtatatccccaaagggaatgagattatctctgcactcccaagtttattgcagcacaattcacaatagtcaagatacagacacaacctaggtgttcatcaatgnggcaaactggataacagaagctgtagagatagaagagatcaatagactagataattagcaatattatttagcctttaaaaagaaggcagtcctgtcatttgccaaaacatggatagacctagaagacattatgctattgaaacttctaaaactagg

SEQ ID NO: 501264 - DNA, 244 bp, Homo sapiens
ctcggcaccctatcctctttgtgctttatctctggtaatccttataagagcaccatgagttagatactgtgtttatgccctttttatggaaatagaatcttagagtgtacattgaagtagctttcccaggtataaccagctggaaaagtgacagaacctaggtctttcagattccaaagattgcgccacccgaatactatatcacactgcttactggtgggagttcagcaaaaaattccttggt

SEQ ID NO: 501265 - DNA, 322 bp, Homo sapiens
caccactcctatagatcagttattgctgtggtttatgtcaaagagtgtttggcctatgttttcccctaagagttttatagtatctggccttatatctaggtctttaatccattttgagtttatttttgtgtatggtgtcaggaagtgttctaatttcattctttaagatgtggctgtccagttttcccagcaccacttattgaaggggttgtcttttctcctttgtatattcttgcctcctttattatagattagttgactataggtgtgtgggtttaattctgggctttctatcctgttccactgatctataggagtggtg

SEQ ID NO: 501266 - DNA, 322 bp, Homo sapiens
aagagataatggttctcttagatggtatatgaactaaacaaccttagttaattaatccattactaattcatcctgcagattattccattaagtagagagcacagaatacaggtcagcactttttctttgcacacctgcttgaaataaaaagtggttctaataggtttatatctaaacccagcagtatatctccttctcgcggatatatacctaaatcacaccatgatttttaacatctggttttccttttgcctctctcaataattttttgttgtagttcattccatcaaaatgttgagttgaggattgtgggaggcataag

SEQ ID NO: 501267 - DNA, 146 bp, Homo sapiens
agcccggattggaaaggatttgtttacaaacctgtcccctgtcctccaacccaaaacgcctttttttttgttttaaaatccagaaaatttaaaggcatcctaaaatcaatgtgaacctttaacaaaatagttttacttattttcca

SEQ ID NO: 501268 - DNA, 513 bp, Homo sapiens
gatatccatgaagctatggatgtacttctcccgagtagaatcagtataacggcaagtagctattccaaggcagatttaatatttcaaattcacttccttccacataagcagaatgtgacgaggcgaaaatattcacatgctcacagtatagcaggtttgagaaatggttctggggtgattattttaaattattggctatatttgttctgcttaaaatgtttcaatcaaagtgacttgaaaggcagagacaactgcattaagatacaattaaaaacttatttgtgactcagcctatgttaaatactacaacttggaaaataaagcagttttcttacagaaatatcattcttaaactgggattgatagttaactttaacccacgcatttgaagcttatttttttacatactaaagggtatgttgaaaagagccagtaattttaggtaattgatttcttcctaaaatgacgaattagaatatcatctaatttgtacaatctggcctccagaattga

SEQ ID NO: 501269 - DNA, 287 bp, Homo sapiens
caaatagaagataggactatctaagccctaggtttcttttttaatcaagaaataataacaattaaagggcagggggaacactgtatcagcatagcctttctgcctttaagaaacttaagcagccggtcatggtggctcacgcctgtaatcccagcactttgggaggccgaggcggatcataaggtcaggagattaagaccatcctggctaacacggtgaaaccccgtctctactaaatgtacaaaaaattagctgcgtgtggcggtgggcgcctgtagtcccagcta

SEQ ID NO: 501270 - DNA, 719 bp, Homo sapiens
  misc_feature (257)..(257): n is a, c, g, or t
tggaaatggagtcaaagtctcaccctgttgcccaagggggagttgtaggggtttgatctcagctcacgtgcaacctcctcccccctcccaagtttcaagcgattctcgtgcctcagccctcccgaattagcgtgggattatacgggcactccgcgtgctcagtgccgtggctaatttgtggatatttgtaagataaagagcgggggttctcaccatctggtaccaaacgtggctttgtaaacctctttgaccgtcgntgtgatctccagctgtggccttgcgggccttcttcagaagtgtggtgggggatatacgggcgttgagcacaccagtgccgtggccttctggggaaattatttaaataagcataaaacaatttctctattaccacagggttagatttaactaagggatagcacgaggagtgtgggccccctggtgaagcgtttttgttcgtgggcaaaaaaccatagaaacgtgctctcctatagccccattaaggtgggtacctttcgtgccctctcccgtggtggtgtctcctttcgggcccagttcacaagtttacaacggggttttggggtgtgaggaccgtctgggacagaatatccccagggcgtctgggttggtacagtcccccaggccgggccttggctgccgagccttttgggggtccccccggtttggacattgttgtgttttaaccggttggtttttggacc

SEQ ID NO: 501271 - DNA, 370 bp, Homo sapiens
  misc_feature (332)..(332): n is a, c, g, or t
tggctcatacctgtagggtcagcactctgggaggccggggcaggcggatcacctgagggcaggagttcgagaccagcctggccaacatagtgaaaccttgtccctactaaaaatacaaagattagccgggcgtggtggcatgcgcctgtcgtcccacctacttgggaggctgaggcaggacagtcgcctcaacctgggaggcagaggttgcagtgagccaagattgagccactgtactccagcctgggtgacagagcgagactctgtctcatgaaattgtgggatctagagaataaggatttttaaatcttacttttggtctttattagctnttattttgatggaatgcttttctcttacatattttttg

SEQ ID NO: 501272 - DNA, 212 bp, Homo sapiens
gctggtgtcgcatggccgcgcccgccgttgttaccggtattgtagacaagccgtaccaaagtctcgcttctgccgaggtgtccttcatgccaggattcgcatttttgacctggggcggaaaagcaaaagtggatgagttccgctttgtggccacatggtgtcagatgtatatgcgcagctgctctctaagccctggagctcccgatttgtcc

SEQ ID NO: 501273 - DNA, 382 bp, Homo sapiens
attcttgtgtcttagcccaagtagctgggattacaggcgcccgccaccacactcagctaatttttgtatttttagtagagacagggttttgccatgttggccaggctggtttcaaactcctgacctcaagtgatctgcctgtaatcccagcacgttaggaggccagggcaggttgggaagtcaaggcgggaggatcacttgagcccaggatattaaggctacaatgaactataattgtgccactgcactccagcctgggtgacagattgagaccttatctcaaaagaaaaaaaagaagtataccacagttgatttgcccattttttctttcatggcatctggatcatttatacctttatgatagtaacttggccaggggtag

SEQ ID NO: 501274 - DNA, 187 bp, Homo sapiens
ggcgtaacccagtctctacaaaaactttaaaaattagctgggcatgagctactcgggagggcttgaggcaggagaattcctttgaacctggggagggcgggagggatgcagtgaggcccgagatctgtgccactgcactctcagcctggggcgaaagaagcggagactcccatctcaaacaaaccaa

SEQ ID NO: 501275 - DNA, 466 bp, Homo sapiens
catcggcatgtatagcgccagagttcgatctgaacactagcagacgctcagggggcgtatcatgtcgtcagtatagtgtggtctccttgatcagcaccagggggcacacagtttaagtcggaatccgtgtcccgcagctgattgagtttaatattcactgcgaagaggtactcccgaacatcatctatgcccaccttcaggcccttgcacaccacatacctctctgagtgggcaggacggttggtaatcggctcgaagagacacactcgttcaacgcagcagtacagcaggtagaccagccccacactaaagggtgtgcacaggtcacaggttcaacagatgacgtggcctcctgtccggacaatggacagcgccatgaggaactgatctacctcagggcctacccctcaccttacagctcatgcacaatttccacagatagcacagtgtccgggggccagctctg

SEQ ID NO: 501276 - DNA, 407 bp, Homo sapiens
tctagaggatcccttattcgtgtgcactatcaaacacatactcttgttttcacagaatttctccaaaacttgaagttcatcaggtttccactgtcctgcatattcaggtgtcacttttagctgaagcgttggttggtttgggactaagagctactctgcatttcagtgcatcagtcttaaacatgatcactccgggttcattagaatttatcagctgcagctacaaaacaaggacacatcaaattaacatgtaagtcaaagagaaaatgaagatgttactgagaattgttccaaaaggaaaaccactaagttgatacctattccaaaacaaaggcacctacagcattgagcatcagctgctggcaacactgcaaaaagagatgcgatcagacgtgcaacacgaataa

SEQ ID NO: 501277 - DNA, 216 bp, Homo sapiens
cgtagagatcactgttatcccagcccttcaggaggcgaggcaggtggatcacttggaggtcaggagttcgagaccggactggtcaaaatggcgaaaacctgtctctactgaaaagacgaaaaattagccgggcatggtggcggaccagggggcccaatggggccagggagacccgttgagtccatctttgccaggagcaccagcagagccagcatc

SEQ ID NO: 501278 - DNA, 1000 bp, Homo sapiens
  misc_feature (752)..(752): n is a, c, g, or t
  misc_feature (917)..(917): n is a, c, g, or t
gaactcggtggtggccactgcgcagaccaaacttcgctcgtactcgtgcgcctcgctttgctatttcctccgtcagaccatgtcgtgacatatcgccgagtatggctgaggagtcgatgaaagttgctgattgaagtcgatagactgaacgaaggactggatgactgcggagacgaaataatccagctgccttccaatgaaacgattgaacaggagaagcaagcaggcgactcgtactgaggcgtgctgccgccgatatgcactgtatcattcctacaagcattgccttcttattttacttcttttacgctgtttaacctttgtaagatgcaaagaggtcggatcccgtttcattgactgtgctgcccctttcacatcaaagaactactgacaacgagggccgcgcctgcctttcccatcatgtctatcgtatcatggcgtggcagggaatggaaatgaacttgcatgttggtgaaggaagaagtggggtggcagaagtggggtgggacgacagtgaaatctagagtacaacctaagctggtccaggtgtcctgcaggctgtaatgcagtttaatcagagtgccattgttttggtggtccagatgatttgacatctcatgggaatgcgcaattttctcttgaatctgtcgcatattacctacaaacggagaagacgcgcagaaaacacagacgtctcttgagcacgacttattggccccggagaaaaagcttggtccaagccacttggcagnctggacaccgagcgcgccctgatgagagaagcgagcaacacgggggttccaacaagcatattgccaacgaaccaagaaactcgcgcgcacttagaacgaaaggcgctgaggatctcctcacccagatgaaaacacgcccgggggcgacacggatgatttgcaacnctagccccgacagggcgtacgagagaggcatcaggggggtcttcacaacggagaaggccccagggggtcccgctttaaaatag

SEQ ID NO: 501279 - DNA, 461 bp, Homo sapiens
  misc_feature (270)..(271): n is a, c, g, or t
  misc_feature (278)..(278): n is a, c, g, or t
  misc_feature (314)..(314): n is a, c, g, or t
gaccaatgatgagacagtgtttatgaacaaaagatcatgattaatccagttctgcacaaaacactgaggtccattagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaannaaattanaaaaaaaaaaaaataaaaaaaaaaaattatatattnttataaaaaaatatataaaaaatttataaaatttccaaaatggtatatattaaaaaaattaaatgatagaattaaaaaaattattttataaaaaaaaactataaataaaaaaattataaaaatttataaaaataaatattttttaaa

SEQ ID NO: 501280 - DNA, 363 bp, Homo sapiens
tgtacaggtcttatagttttgctgtcctgtggatggcacgggcactcctctgatgtgcgcagaagatccagtcatcagatcctagatcgtgaaggggttggctgtcctctgtgaaccatagcaggctttctttaggcaggtgacaatacacttcagacaataataatctacctgtaatacacatcacccctctggcatggaagagcttttatcacaatcagacaaacatgcactgaaactgcacaattgaatgaaatccctttataaaatgtataacatggcccatcaggtaaccaaatgcacctgaagtttggattgtattcctaggaatatcggttcgacaaaccaaacattgataataaa

SEQ ID NO: 501281 - DNA, 156 bp, Homo sapiens
aattacagatctagaccactgtcgtgaggttcatgctgagggaggacaggatagcctctgtgggaccgttcccatgtaagaaaactggttccaccaggacgccaccagcctcggaagccacggtgggctggatgtctgctgtcctctctgtacgca

SEQ ID NO: 501282 - DNA, 808 bp, Homo sapiens
  misc_feature (639)..(639): n is a, c, g, or t
  misc_feature (646)..(647): n is a, c, g, or t
  misc_feature (653)..(653): n is a, c, g, or t
  misc_feature (664)..(664): n is a, c, g, or t
gcagtagttcacttttcctcttctaattcatttctttttcatcagaaagttctcattttaaataataccagccatgcaccgagcccttgctaactgtcaaatgactactgaagctctgcattatgtcaggttattacagtaagcttttggtttgtgactgccaggccaggagttgaggcttaccctctcttttgttggctacaagcaaagtatgtcaactgcagcctccccatgcctttcctcactagctgcctcagatctgcttccttgttctttgttgtgctgtcttctgatggatgctttggtcgttctgttcatctactgtttgctgaaacccaaagcttttttgtacttctattaacagttaaccagttcaccctaaggagattgtacgcagaccagcctcccacatttgtgttaggggtatgttactactcatatgagatttgaagccttctttttccccaaaaaaatggtcgatctcagatcttaataaggtgccccttttctcaagccccatagaggtaccttttatattcactgtgaaactgtcattcaaatgaatctactcctggtctttaactttttttgcacttctaccccaataagaggctgtcttgcagtggggaggaatgcatnttgtgtnncttgtncttcccatttnatcctcttttgcttattggaatctgactatccatgaataagatggactttgagatctacttgtaagtacacaggctgaagttgaatatctgtatcccagtacttaccaccatgctttgtgcatgttaaggtcactttcgtcaca

SEQ ID NO: 501283 - DNA, 1319 bp, Homo sapiens
  misc_feature (243)..(243): n is a, c, g, or t
cgagggcagagccgggctggcgagcgaggtcgagagagagcgggagatgagcagatgacgagagtgcgagatagatgcgagaggagggtcgtcgcgatgtgagtgagcgcctgagaaggcgtgagcagagagtggaggagggaagtgacgagtacgagagggaggaggagatgtgaggagcggagcggtagtagcagagaggaggagcgagacggtcgtggaggatagtgggatgagagagtngggatgtagggaaggtgaagaagtggtgagacaggattgagcaggggaggagataggcggaggtagtgagtaacgagagagggggagtgtaggagcgattggtgagggcttagttaggcgacgtgagaagagagagtggcggcggagtaatgtggtcgccaaggtgttgacatagagggggtgaagcgccgcagatgagtgtaaggcacgcggttaggggggccgatatgcgaagttgggcgggagagagagtgtgcgggatcaaagagcgtcgggcagaggggaccacaagtagcttagagttgtaaggggtctgtgtcggaaaaaaaggccatggggttatcgaagtgatcgtgagaagcgcacccctcttaagagattcgatgaggggggacctggggtcaaactgaaggattttattccagtcgggctgaataaaggcactttattatgccagaagccatctgaaatttccacctatttagcagaagccccgtgggtgattttgatatgcactaaagtttgaaattaaggatcatggttttaaacaagagtcaggataagattttaagcaaaaaaaggtgtgtgtgtttgaggggggctctgagtaaccaaaataatgtaaaggtagtaaagggtatacggtatatttaactctttatttagaagagccatgatttatgtttatgtcagacatgatcttgattccaagaataagatccagatataatttttagagcactttcacatatagtgtctcactgaggcacagttttcagtagattagaagtgttgggtgatgggctgggcgcagtggctcatgcctgtaatcccagcactttgggaggccgagccaggcagatcacttgaagtcaggcgttcgagaccagcctggccaacatagtgaaaccccgtctctactaaaaactacaaaaattagccaggcttagtggcaggcgcttgtaatccagctgcttgggaggttgaggcaggagaatcgcttgaacccaggaggcagagtttgcagtgagccgagattgcactctcgcctaggcaacagagtgggactacatctt

SEQ ID NO: 501284 - DNA, 107 bp, Homo sapiens
ctagagcatcccatcatcgctgataggcatgctgttaagcaaaaataaaatggattatggaccaaacgataaactgacctataacagagatgcaaagaattttaaag

SEQ ID NO: 501285 - DNA, 558 bp, Homo sapiens
ggaccagctgggtccccagcctcacctgacaaccgggctagaccccctcaccgtgcgcccccctgtgcctgccgtgtgggtgctgctcacgccgggagccccctggagcccccactgagtgtggttaacccaaccccccggagcacccccctggcctgggttccctgccccgctcccgctgtggccctcgttcccgcgagaagggctcgagacaaccccgagtcgtgagagacctcgctgaggcccgcctgttctccgggcctgaatgttctggggtgcttgtgcctcttttctgagaagcggttgtgagctgctccacaactccccctaccaggtttgagtcccccacaagtggagcctccctatcactgcttccccttccctctagcactgtgggaagggactgctgtgaagaatgacccgatgtggggcctctgcccagattttgccttgctaaataagggcttcctctgccttctacctaccgtgcctttgaactgccttttgaaagaggtcccgggagggatttaggaaataaagtttctacctatttgatga

SEQ ID NO: 501286 - DNA, 194 bp, Homo sapiens
cgtcggtagcgttccagctagcaagacaggttatgctatagtacaagccactagcccgctcttagaacctctcatttcctttccatcgtggaaatctatcctcaaggaaataacttctcagtgttccatctgctattctactactcctcagggataattcaggccccctcccttccctacacatcaagctcgag

SEQ ID NO: 501287 - DNA, 199 bp, Homo sapiens
ctaacattgtacacaatgtctccaacttccgtaaggaaatgaacttcagaatactcaagcaagatctgatctcacctctcggggaaagccatgaatcttcgctcccctccccacataacaagagagttttgctggattttacctgggactgcaaattctacctcccagggaaatcctaaacctggcttaggatctggct

SEQ ID NO: 501288 - DNA, 210 bp, Homo sapiens
caaatctactggtatagtcacagtgtagacatttctgcaattctagcaataaataaaaagtctcttctatcttctcttcaaagctatgaattacagaagatggtgtaaaagaagtcatatttttttctattcattcttgtagtattaggagccaagtatttttaccatcacatgtctacaattttcactttatccactttaataagttct

SEQ ID NO: 501289 - DNA, 842 bp, Homo sapiens
gtgctgcacagcagcaaagaacaagcttaaccaggtggtcatgatcgaggacttgagtaagaaaatgagagggcgtggaaaatggaattagattgaggacaacactccgtagccagttgctgaatcttctgagaacagcttgaaggatcccatgccacagataccaagtgcaatagcgcagatggtccatgtgatgacaacaaggacgagtatcaatcccagatgagtctggaatgggctcatatctagcccaaggtccctgttgctatagactatgtagatgacctaaaacagggttccaactgtccagctgtgtgcactcttgttataccaacctttgagagaaatgtttgcagaacgaaatactcgatttgctaggtagacctatccgtcaagtcatccagaacgttgaatagacatttcttgaagtcaattcgggtagaacgagggcaagatagtagaaccggaaacttaataggtgcacgcgccgattacccgtgtgtctactagaaaattaatgggttcatgggttgcaaatggtaaccttctttaatatctaatctggatagtttagaagaatgttatgtgtactctttggtttacagtgggggaaataactaagatgtccggtccagtgtgttaacgtgtcttaggcaccaatggtcacttgctggttgaagtgactgaagaacgcgttgtgaatcacaatggcacagaccgaccgacttggacacgagcgattcctaagtacttagaaacctggcccctggcaaacgtgttcacctttggcaaatgagattctcggccacggttggagtgccttttccttttaaaaaccccgg

SEQ ID NO: 501290 - DNA, 100 bp, Homo sapiens
cgcggtgagcatcgtaaagtcaaaaaatcctacagtaatatcacaaatcagcacacagtactgtatgcatacaattttggggccccacccctcagaagat

SEQ ID NO: 501291 - DNA, 406 bp, Homo sapiens
  misc_feature (103)..(104): n is a, c, g, or t
ccccagcagtggaatagggcctgttgtaccttgcaggtggatcctgattttggacaatgcagcaatttgtaagtgtccccgtcccttattgaaacaaagcaanncccaacgtgagccttgggcaccaaaaagatgcagccgtcaggttctcctttaaactttgtcaacggaaccaaaagtcacgttgggatggcttccagcaattcccctttgggattctccaccaccgtaaggggctgaggtttgtccagacaaattggctatgattgatatgaccaccaccattgaaacttcaggtgcaggctgaagaggctatcggggctgtaacattctcccttggccaacgcctccgggtaacttctcctcggtgacgtccaggttgtccacgtaggccggcgtggtgata

SEQ ID NO: 501292 - DNA, 239 bp, Homo sapiens
atgccgtggaaggctcatatcaggacatgcattgaaaagtgttgcatacctgtgggctgctggcggtgctgcaggcaggacttcctttcctcccttccctggcctttccagacaccacagagagaccaggcagctttctctggcaccagcccaggcctctggcccaactggcctcacctcctacctcctcctggggaatcagggcctcagtggaagataacggggcccgggagaggtct

SEQ ID NO: 501293 - DNA, 448 bp, Homo sapiens
  misc_feature (4)..(4): n is a, c, g, or t
  misc_feature (13)..(13): n is a, c, g, or t
  misc_feature (54)..(54): n is a, c, g, or t
  misc_feature (87)..(87): n is a, c, g, or t
ccangattgtaancccctgactacttccaacccaatttgttctgtccctaaaanggaaatgatgttccaaggaaataagaggagacngaaaagaactgagagagacaggagtgtgttgaaagggcaaatccctaatgagaagtggtataaatgtggatcaggttaggcccaggcgcggtggctcacacctgtaatcccagcactttaggaggctgaggcgggcagatcacttgaggtcaggagttcaagaccagcctggccaacatgatggaacctcatctctactaaaaatacaaaaattagctgggtgtagtggtgcacatctgtaatcccagctacttgggaggctgaggcaggagaatcgtttgaacccaggaggcagaggctgcagtgagccaagatcgtgccactgttactccagcctgggcgacagacgagactccatctc

SEQ ID NO: 501294 - DNA, 250 bp, Homo sapiens
gatctagaggatcccaattctgcagctcatcaaggacagctgtttgcccagtgcacgcagtgggtgccccgaagaactactacgatgcctggtgtcgacagctgcttcatgcggggtcgacgctggagtgcgccagtctgcaggcctacgcaggccctcgtgtgcccagcaagaacatcgtgcctcgaggtgggggaaccacagcgcatggggccctgcttggtggatgtgcccatctcacgagggagta

SEQ ID NO: 501295 - DNA, 105 bp, Homo sapiens
catcatcatcatggatttgctggtgcagtacaactaggcttaatagggacatgggagtctaactgaagtctctccttcctaataaatgttaccactctgaaaaaa

SEQ ID NO: 501296 - DNA, 134 bp, Homo sapiens
acctcgtagatcccacttctgcagaggaggcacaggtttgccttctcgaggcatgtgtaggcgttaggttctgctagcatgatgttcaagctgcagagggaggggctggagaaagacttccttaagcggatcag

SEQ ID NO: 501297 - DNA, 227 bp, Homo sapiens
tccccgggggggtgtccgttttccttttcttgttgcccaccccccggccagtgttatttatgctccctttgggggtgatgggccacgccctccccatgtccttggaaaagggtttccctccgggatcccctgcttggtgcccacattgctttgcaagggtttgcccccctcaggtggttcccctgttgttgacccttgtgttgtcaataaacggtttgaggtttgca

SEQ ID NO: 501298 - DNA, 208 bp, Homo sapiens
catcatcatcatggatttgctggtgcagtacaactaggcttaatagggacatggtcagccacacagtaatagtgggagacttcaacactccaccaacagtatgtgacaaatcatcaaggcagaaaagtaataaagatatttaggacctgaactcaacattggtccaaatggatctgatagacctcatcagaactctccacccaaaaaa

SEQ ID NO: 501299 - DNA, 105 bp, Homo sapiens
  misc_feature (72)..(72): n is a, c, g, or t
  misc_feature (85)..(85): n is a, c, g, or t
catcatcatcatggatttgctggtgcagtacaactaggcttaatagggacatggcaccactgcactccagcntgggtaacagagnaagaccctgtctcaaaaaca

SEQ ID NO: 501300 - DNA, 227 bp, Homo sapiens
gccccgtgctgctgagcgaggcccccctgaatcccaagctctggcagtgttcggtcccgccattccgtcgatcccgttcactccgcactggtcccgtgtcctccgcgacccatggggatcgcgtcgcgagtcgtccatttcgccccgcgacccgtccgcttcagctccgtgacatctcatggtacgaagtatccgtgtggcacgtcagcgctgtgcggactctgtcg

SEQ ID NO: 501301 - DNA, 117 bp, Homo sapiens
  misc_feature (60)..(61): n is a, c, g, or t
catcatcatcatggatttgctggtgcagtacaactaggcttaatagggacatggtggaannggaagcaaacatatcctctttcacaggatgataggaaggagaaatgccaagcaaaa

SEQ ID NO: 501302 - DNA, 1025 bp, Homo sapiens
gggttcctccttttcagcgccctccatgctttcctggagtgaacgtggcttgcacgtctagggtacactgaggcctagtacctccgaccccgtttggtgcaaacactgatttcattttcccccaggcggtgctaggctccttggttgggcactttttgtgtgcctgtccctatactaatgtactctgctttagctccccgttcccttgcgcgcttggtgcaaggacgcgcgggggaagggcatcgctgtcgcacccctcacagttagccctgaggctctccacgggtcccgttcttcccgcgtggcaatgctctcaaatgttgtggaggtttgcttgaggcttccgcaatccttgcactcgtcacccttacttcttgacacatggatgtgaccgatgctctaggatgattgggtttggggccaagaatgggagcatcgacatcttccccagcagccacctccatgctgagatccgctcgaccttgcttgccgaaaccagatccctaactcgatgacctcagcctcgaggatacagtgctctcctcaacgtgactctcctgtgcttctgttttgtccaccctgctggggaggaacaggagaagtggatgtgggtgagagccactggggcctccagagcctggctctgctttgtagcattgtggctttagccggacgagggactgtggccaagggtgaggtggccaaaaccagaaccagcagtctcaatgccttgttccctcctggcccatcaggcccatcattccagggatgtctctcacagctcctgactgatatgtgcctgaagctgacccgaggtcttcctatctggaatgactagagggagccaagaggatggggtgggggccagggccccccagggcctatcgtgtggagagcactggagcaggatcccatcagaaaggtgctgactaaaactggttgcccgacactcaacagcctccacctccctttcataccctcacagctcctggggccttcctttatctggcgggagaaagtattca

SEQ ID NO: 501303 - DNA, 172 bp, Homo sapiens
  misc_feature (139)..(139): n is a, c, g, or t
  misc_feature (152)..(152): n is a, c, g, or t
catcatcatcatggatttgctggtgcagtacaactaggcttaatagggacatggtggtgtgcgcctgaggcaggagaatcgctggaacccgggaggcagaggctgcagtgagctgagatcgcaccactgcactccagcntgggtaacagagnaagaccctgtctcaaaaaca

SEQ ID NO: 501304 - DNA, 142 bp, Homo sapiens
catcatcatcatggatttgctggtgcagtacaactaggcttaatagggacatggatgagctgaatgaatgcactaatttaacatgaagcccagaccagagccttgcacagatcttttgggtgatatgctcaaaaaaaaaaaa

SEQ ID NO: 501305 - DNA, 1306 bp, Homo sapiens
agcgggcagtgtctgccccggaacctggtcggcgcgcggcgcggcgcgcctgggcgctaaaatggctgcggcgttgagttgcatgttgatgtgagagatcccggggcacgccggggtcagctctgggcctccggcatgtgtgcgtcaaccaatctgcagactcgaaaacgctgacgagtctggctacgacctatcgaagaataccgacttatgtggagctcgtgcacagagcacgggtggcagtgtgactagagaggaagaacgactacacaggctcgaagaaagagtgttctgctcggagtgccttccgccgttgtgctggaacacgaaattcgtacagtctagagcgcgggcaagtaatcattgaggcttgatccgaatggtcctcttatcacgtggaactactacggcagatcagatttgaggaaggaatcttatgtggagtccgtccattgggtcgacgcgaagtagcgcgaataggtcgacggactaaggggataacgcgtcaggactaccactcgctcatggagggcactttcacactcgaaaaaggccttggctccctcaagggaaagtcgtctacttaatcaatttcctcttttcgtggaactagttttcactttacaattcggccagttggtaagtcctcaagtggttggaacatggcggttggttcgaacccaggcaaaggaagcgtgtggcgacagcaacgttcccaatcgtagggtatggtgaaaagttgcccttttgggttggttcaaaggcagggggtacacggccgctggggggaactttcgggtcgcttgggacaacttgcttggcttgttccttgcccaatgccaatcggggaagggtccaaggaccgctgtgcgaaccccttgggaaagggaaggttgaaagattccgttggggcccaattaaccccccccaaatttccgaaattggaagaaggggcttcgcgataaaggcggaatgaaaggacaccaaccaggtgtgtggaagcgttggttggttcccacaacatttcccttccatttatgtaagagcctttaagttgacggggagggcacaaccccagtttttggagccccgagttaaagaggaaattctcagaggcacagccccttggggggggaacccttccccaaagcttcccctaaattaataggaggactctctgggtggagaaaaagaactcccaatgagcaggcaagaaaagcagcctggtttggtccaaagaggaagaggcgctctctttgggagaacggttccaacaggaacaccggctggacccgtttgtaaaccg

SEQ ID NO: 501306 - DNA, 138 bp, Homo sapiens
catcatcatcatggatttgctggtgcagtacaactaggcttaatagggacatgggagacaagcagtcagagtttagctttgcgaagagctagtaggatattgaagtacgcactcaggagagtgctaaggcacatagga

SEQ ID NO: 501307 - DNA, 212 bp, Homo sapiens
gactgaatgccgctcttgctagcacagacagattacataactaaaactaacataaaggacagcggcctacttggccagaccgattgaactatgctgctggtgatcatgctactgctgacaccacagctgctcctgctgctgctgcagccccagctaaggttgaagccaaggaagagtcgcagtgactcgcagtccgcgcataccgacgctag

SEQ ID NO: 501308 - DNA, 134 bp, Homo sapiens
catcatcatcatggatttgctggtgcagtacaactaggcttaatagggacatggaaaaatgaggaaggatcacttgagcccaggagtttgagaccagcctggggaacatagcaagacctcatctctacaaaaaa

SEQ ID NO: 501309 - DNA, 204 bp, Homo sapiens
gcgccactcctcaggcattgggagctccaagtgcctattccaccaccagatgccatggagaccctagtttgtgccctaggcctagacattggcctggtggggttcctcgtgggtatcgtcctcatcatcatgggcacatatgtgtccagtgtccctaggtaatgatccttctgagagaaatgacttgtgggagacaccctgcag

SEQ ID NO: 501310 - DNA, 227 bp, Homo sapiens
acccatggatggatggccaggattcccgtggtccctagctagatccccttcctatcaatcacctgatagcaacagggccacttgccaatcccctgctctttactcaatggtccccagggagggagcatgggaaaagggttagctgagggctggaggagggccccaccccctgggtgacctgttcccggttttatactattgtttgtgattaaaagtgcttcccccca

SEQ ID NO: 501311 - DNA, 908 bp, Homo sapiens
  misc_feature (106)..(106): n is a, c, g, or t
  misc_feature (857)..(857): n is a, c, g, or t
  misc_feature (864)..(864): n is a, c, g, or t
gtccttgtatgtatataactaatataccagtcttgttaacctgtggatgaatgcctttttccgaggacaatatcaggataacaagtctttagactccaccattagnacccaaagctaagattctaatttaaactattctctgttctttcatggggaagcagatttgggtaccacccaagtattgactcacccatcaacaaccgctatgtatttcgtacattactgccagccaccatgaatattgtacggtaccataaatacttgaccacctgtagtacataaaaacccaatccacatcaaaacccccctccccatgcttacaaggcaagtacaggcaatcaaccctcaacttatcacacatcaactggcaactccaaaggccacccctcacccactaggataccaacaaacctacccaccctttaacagtacataggtacattaaagccatttaccgtacatagcacattacagtcaaatcccttctcgtccccatggatgacccccctcagaataggggtcccttgaccaccatcctccgtgaaatcaatatcccgcacaagagtgctactctcctcgctccgggcccataacacttgggggtagctaaagtgaactgtatccgacatctggttcctacttcagggccataaagcctaaatagcccacacgttccccttaaataagacatcacgatggatcacaggtctatcaccctattaaccactcacgggagctctccatgcatttggtattttcgtctggggggtatgcacgcgatagcattgcgagacgctggagccggagcaccctatgtcgcagtatctgtcttggattcctgcctcatcctattattnatcgcanctacgttcaatattacaggtgaacctaccctgaaacgtgacttc

SEQ ID NO: 501312 - DNA, 801 bp, Homo sapiens
ccccaatgaggtgtggggccccctcgattgtggggttttaaaaggggcgacccctttaatttacagggaacccccatttagggttcccgccattttttaaacccaggcggttaggcctcccaaaattaaaatttctatttggttttaaaaagaggatttcgtccgcagtgggcccccccctgttgggctttgtttcctaaggctatgggggcaactgcccatcctttagattggaccaacttcaaagttgcccccacggacaattttaatcgatccttcgggctcgtgggtccctgtccatttgaaactcctagaatgggatcctgaatcctgttctccgcgttcctatttgatcctcaccgtctagcctttacaaagaaaccctgtctgatccgtcccatacttttagccctctagatcacggtacgtttttctcgcagttcgtgtagtcgtcaccacggagctctcatactaagtgggtttgaacgtgatgctcagatcccgtccaggggtgtgcaaatccgcacaaatagctggtaggtccaagtcccagggccctagctagggtgtggatctccccctcatccaggaccagactcttccacatgtagaggggcgttcgtatacttagtcctgcataaaggactttgagtggtatgtcaccacgtcagacagcaatctctaacggtatttaaagataggccaggcatggtgtttgtgagtgtcctcgcgtcacttgtgcagcatgcggtcatatgttcacttcagaccttattctttggtccagccaagttaacatct

SEQ ID NO: 501313 - DNA, 412 bp, Homo sapiens
ttttttttgagacggagcttcacacttgttgcccaggctggagtgcagtggtgcgatctcggctcactgcaaactctgcctcctgggttcaagcgattctcccacctcagcctcccaagtggctgggattacaggcgtgcaccaccacgcctggctaattttgtatttttagtagagacaggatttcaccatattggtcaggctggtctcgaactcctgacctcaaatgattcacacaccttggcctcccaaagtgctgggattataggcgtacgaccacacccaggcagcgcacgtttttttctttttttttgacacggagtctccctctgtcacccaggctggagtgcagagcgaggttctgtctctaaaaaataaacatttaaaataaaaaatgagtaaaaataaaaag

SEQ ID NO: 501314 - DNA, 814 bp, Homo sapiens
  misc_feature (763)..(763): n is a, c, g, or t
  misc_feature (770)..(770): n is a, c, g, or t
catcatcatcatggatttgctggtgcagtacaactaggcttaatagggacatggcatggggaagcagatttgggtaccacccaagtattgactcacccatcaacaaccgctatgtatttcgtacattactgccagccaccatgaatattgtacggtaccataaatacttgaccacctgtagtacataaaaacccaatccacatcaaaacccccctccccatgcttacaaggcaagtacaggcaatcaaccctcaacttatcacacatcaactggcaactccaaaggccacccctcacccactaggataccaacaaacctacccaccctttaacagtacataggtacattaaagccatttaccgtacatagcacattacagtcaaatcccttctcgtccccatggatgacccccctcagaataggggtcccttgaccaccatcctccgtgaaatcaatatcccgcacaagagtgctactctcctcgctccgggcccataacacttgggggtagctaaagtgaactgtatccgacatctggttcctacttcagggccataaagcctaaatagcccacacgttccccttaaataagacatcacgatggatcacaggtctatcaccctattaaccactcacgggagctctccatgcatttggtattttcgtctggggggtatgcacgcgatagcattgcgagacgctggagccggagcaccctatgtcgcagtatctgtcttggattcctgcctcatcctattattnatcgcanctacgttcaatattacaggtgaacctaccctgaaacgtgacttc

SEQ ID NO: 501315 - DNA, 810 bp, Homo sapiens
  misc_feature (84)..(84): n is a, c, g, or t
  misc_feature (166)..(166): n is a, c, g, or t
  misc_feature (173)..(173): n is a, c, g, or t
  misc_feature (190)..(190): n is a, c, g, or t
  misc_feature (192)..(192): n is a, c, g, or t
  misc_feature (201)..(201): n is a, c, g, or t
  misc_feature (262)..(262): n is a, c, g, or t
  misc_feature (265)..(265): n is a, c, g, or t
  misc_feature (283)..(283): n is a, c, g, or t
  misc_feature (288)..(288): n is a, c, g, or t
  misc_feature (290)..(290): n is a, c, g, or t
  misc_feature (338)..(338): n is a, c, g, or t
  misc_feature (360)..(360): n is a, c, g, or t
  misc_feature (363)..(363): n is a, c, g, or t
  misc_feature (368)..(368): n is a, c, g, or t
  misc_feature (400)..(400): n is a, c, g, or t
  misc_feature (405)..(405): n is a, c, g, or t
  misc_feature (408)..(408): n is a, c, g, or t
  misc_feature (415)..(415): n is a, c, g, or t
  misc_feature (517)..(517): n is a, c, g, or t
  misc_feature (528)..(528): n is a, c, g, or t
  misc_feature (564)..(564): n is a, c, g, or t
  misc_feature (567)..(567): n is a, c, g, or t
  misc_feature (569)..(570): n is a, c, g, or t
  misc_feature (576)..(576): n is a, c, g, or t
  misc_feature (578)..(578): n is a, c, g, or t
  misc_feature (581)..(581): n is a, c, g, or t
  misc_feature (600)..(600): n is a, c, g, or t
  misc_feature (609)..(609): n is a, c, g, or t
  misc_feature (629)..(630): n is a, c, g, or t
  misc_feature (635)..(635): n is a, c, g, or t
  misc_feature (639)..(640): n is a, c, g, or t
  misc_feature (642)..(645): n is a, c, g, or t
  misc_feature (651)..(652): n is a, c, g, or t
  misc_feature (654)..(654): n is a, c, g, or t
  misc_feature (657)..(657): n is a, c, g, or t
  misc_feature (659)..(659): n is a, c, g, or t
  misc_feature (662)..(664): n is a, c, g, or t
  misc_feature (673)..(673): n is a, c, g, or t
  misc_feature (720)..(720): n is a, c, g, or t
  misc_feature (729)..(729): n is a, c, g, or t
  misc_feature (758)..(758): n is a, c, g, or t
atgattactgtttaaaatttaacaatgtaggtatatccagggtgagctaagcacactttgacagcacactattgaatgttatantttctgtattgaaatatgtaaagacatctgcaaattagtacctagcaatgaagacatacatttataaatatacacattctangtttganaaggtaaatgtaaacanangccatgacnccttttcaaacagaaaacccacaagactaatagagaaccaataggctccctatagtacgantgngcaaaattaaagcatggnaaacngntatttacataaatatcaaaccaacaattagtttatacattgtcaatgnccttctaagatatgtcatgggnggntccangaatatctttcccccaatggggagggtattcnggggntanattccgncactttaaaatggcacacatcataggctttacctgtttgaccactgcctcaaatgtgtgagatgtgattttatgataagcagtctattatttttaaacaagnggttctaaacncatctttagattctaagcagaaagaaattacaagtnctntnngatttncnttnaacaagttacctctatcanatttctcgnttctcttatgctgtagctanntttgntttnncnnnnaaaagnncnaangnccnnnccccccctntgttaattttggtaaactaggcacattttacaaggaaatctgtgtcnaaacagatnacagtgcataaatcaatccaaatttagancctggcaaccagttccccattgctcatctacgggactctgtcaaacggtaaa

SEQ ID NO: 501316 - DNA, 360 bp, Homo sapiens
tggcacgacttctgggactctgcgtgtagtgttggtggtgggtttcatgatagccatcctgttctgtattacctaccttatatcttactgctctatctctattctactgctagctctttttctcagacttcttcatttgcttttcactcttaagtaacttgtctgcgttctcattcttcatcttttaattcttctccttctctggtttctcaagctcttcatgctttttagactccttagctttttttaaggggaacattccccacctgcagctcgtcctccagctgagaggcagtaggccggctgaggtcatacttctcctcatactcattactaagaatttagtcctgggccttcttt

SEQ ID NO: 501317 - DNA, 498 bp, Homo sapiens
actcctataaacagacatagtcaagtcatagaaatcatgtcaagcatgaaatctacagctgtcagagtcagataatcaaagagggagatcttcccacatcaaccaaggttattttgtcagaaccttagaggagttgagacagtttttcatgttgcaagtgattggtttacttatttcagtcaagctggatatggcacaccagactgatttcatttcagtgagctatagtataattgattcttatgtgtgtgctaacccaaagctgttgtcatttgggctaacatacactgacagagacaattccacacgacaaaagtttcccagaaaacttctgtggcattttttctttttggacgtaaatgcccagatctaaaggtatttctacccaacaacgtctgtataagtgtttcatgttatttcctttttggtcctatacagaatgctatgacttctaatataggtctgaatgctgatccacgaatgatcgaggatcctcta

SEQ ID NO: 501318 - DNA, 506 bp, Homo sapiens
aagaatggagtaatagaggcatgcggtggatgcgctgtacagcccgacactcaagggcagcaaaaatcctacctgttgacttactgtcttaaaaaatcccagagaccagcaggcaggtccaaggcttatctacctcctcagggctgtggtattaccactcgaagggctcagagatgggtgccagcaagtcctcgtggcacgagagggcaaagtccaccttcactctggggtaggggctcgccctgctggcctgccaggtttcgagatgaaatctccgacctgtagctccggacgtcctccagatccagcgtggcacgtcagtgaattccacgtcatccagagaaaactgggatccttgcgcaaagacgcttccgttcatggcgatcatggcacagccgtcgtcgtacaggcggtccacgtcgcaaccctactggttggccagcaagtaaatcccaccgttcttgctggtgacatagtcacgagatcaccctggtgtaggatatgag

SEQ ID NO: 501319 - DNA, 1370 bp, Homo sapiens
cttggaggcgcggtgggtgtctgcgggggtctcgcggggcggctgcgtcgggctgcaggagaagatggcggtctccaacacggagctctacaccgcttccctcgctaactcccttccgcctcgctcgcgaacgaaccttgaacgacagcgaccacaaacacggagctagcgcgaaccgagcaccacgcctcacgcctgcgggcccctcgcaaaccactgcactgcacacgcactactgcacaccctctaaccaccaggcttggccccacggccatgcactcaacttgccgcccccacccacaaggccccacaactctactgcacacacacccaggacactcactcactagcccctctgaacacacgccaccggcacacctgcctgcgcaccctcttacacacacttacccccaacgaacacgcccatcccgaatcccggtccacaagcctttaagcaacatctgctgcctcaacctcacacaccacacgttctaaactctacttgaacacgcgtggggcacactttaccaaacgtaaagtttgtgcgccactgtcttgggtgtgcaccttggcgccttggggctagcttggcgtcccggggtacggcgccattttacccccatcgccttggtctttcaacggtcctactcgcacctcgctggcggctcctaaccacgcattttctccctcctttacttacggcgcccacgcttcttcggacccgccgcctcctcggcctggcccctcttcccaccagcgccacgtcccctcacaacgcaacccgccctcctctacacctctgtacactgccttcccccacacctccagcacaccaccaccctaacctcgcactaccgcccactcatccccaacctaaccgcccccaccccccatgacaccgcgccgccccccaactccccaatcttaactcataccccacaacctttacacaccttcactccagacggcctggccgaaccatccttccaacacccaccctctctgccccccatctaaatactcttcccacacctcaacaaccacattttccttaaacccatacaaatcatgactacacaacacctgacacatcacaattaggcacactctcatctaaaccacttaatataccactcaccaccttgtccccaccaccacctcaccacacccccattttcaacaccccctccaccacctcgcacaacactatctccccacgcccatgtgcgcctacatacccccctcttttgaaatcccccatgaggacccaccccacttccacggcctcaacacctcacacctcatcatttcacctctctgccaccccttaccttcacttgagctaacacaccacactccctaacactgtt

SEQ ID NO: 501320 - DNA, 108 bp, Homo sapiens
gaatgcaatggaattgaatcaaccggagtacaatggaatggaatggaatggaatggaatggaatggaatggaatcgaatggaatggaatggaatgatacggaatagaa

SEQ ID NO: 501321 - DNA, 165 bp, Homo sapiens
gcatggcttatgcttgacaaaccagtaacaactctggcatggcgatcgtgggatgtgtcgcaagcaatccactagacaatcttcccacgaatgtccgtagccagcgcctctcccgagcgatggctttagtccgactgaatctccaccatgtcggaatcgttacgg

SEQ ID NO: 501322 - DNA, 161 bp, Homo sapiens
tgaaaagaagcgaggggaacagaggggaagagaaagagacacactaaagtgctgcctcctgacagaattctacttcctccaagattattattttttaaagaaataaccatccatatacaatttcattcaaaattagaaccacaaaaattggggcacctggg

SEQ ID NO: 501323 - DNA, 182 bp, Homo sapiens
ccaccacccgattcgtgaccaagaaggctctgtgcattcgggttttccaggagactcaaaagccgaagaagcgaagaagagccttaaaggctgcagcagccagaaaaacaagcaaaggaggaacccagacagccctgcaaagcatacaagacactcaagacagcaattaatctgtcatcatt

SEQ ID NO: 501324 - DNA, 205 bp, Homo sapiens
ccaggccatatactagtggcaacacacaatataaaactaaaatgccattggctcctttacattggttaaaagcaaaaatgtaacaggcagaaagtctgtttcacacacaacttacaaagctatgtgttcagatcacactccttcccaaatcagataatatacacacccacaaaaatagtgtgtgcagccaagctgtcatacacca

SEQ ID NO: 501325 - DNA, 712 bp, Homo sapiens
  misc_feature (21)..(21): n is a, c, g, or t
  misc_feature (83)..(83): n is a, c, g, or t
  misc_feature (140)..(140): n is a, c, g, or t
  misc_feature (142)..(142): n is a, c, g, or t
  misc_feature (159)..(159): n is a, c, g, or t
  misc_feature (172)..(172): n is a, c, g, or t
  misc_feature (240)..(241): n is a, c, g, or t
  misc_feature (335)..(335): n is a, c, g, or t
  misc_feature (665)..(665): n is a, c, g, or t
ccctcaggtcgtatcattatncacaaacccactttaaggttgttttgtatgtgctgttgtccctatgttgttgtatcttgttnttagtatgatctgaggcagaaccatctgattccatatcgggtcacagggatataatntntctgtagatcacactcnttatcactgcagnaagtgactcttgacatttagaataagaaagtgaggggacttaccaaatctatccattgctattgacannaacagttgaatcagcatgttctgctttcaccaggaaagtggtttataactactccaagtgactgttttagtcaattcagactgcttcaacaganaaccacagactagatggctaaccaacaaacatgtatttctcacaatcctggaggctggaaagttcaagatcatggtgtaagtagattcagttctgttgagggcttgcttcttggtctgcagatggccatcttcccattgtatcatccagtggtagtgagcagagattggagaacaagctctcttgtctctctgttaaaggcactaattacatccaaggagctccaccctcatgacctatcatctcctaataccatcacattgagggttagaatttcaatataaaaattttggaggggagggcacaaacatccagtccacagcagtgagtntcttgtaatctcagaagtcttcttacataactaaattgttgctcgtg

SEQ ID NO: 501326 - DNA, 250 bp, Homo sapiens
aactaaccacccccgcagcaataccgtagcgccagtgataccggcaactgggttaacgccgatggtgcgattttctacccctatattggtcgcctgaaagtggccgggaaaacacttacccaggtacgcaacgagattacagcgcgtctcgattcagtcattgaaagcccgcaagtcgatgtcagcgtcgcggcgttccggctcgcaaaaagcgtacgtcaaccgccgaagtcagcaaatccggtcagcc

SEQ ID NO: 501327 - DNA, 995 bp, Homo sapiens
gatcgcatagccagcgtcggagggacacgcacgctgctgactggtacttctcggtgcgactgttaaaggagtctccagagttttctctctgcctgtgcaaatatgtacaccctcttgtaggagaaagatagtcatggcaaccagggtagtgcgaaatacacaagagatgtagtttccaatgtaagattagcggattgagggtgcaccgtgagtgtcggaccacgagttggttatgtgcgttgttgtctatatagccatttcgttgcgagaagacgccttgggtagcactgagccattcgtctcattagtggcactgtttggacataattagtacttgcgccgatgatatgattgaaatcgaagaggcattggctggccgcaatgaacgtttcagtatcaccctagaacaatctgatgtgtggaaattgcacgaatgattgctaggtgaacagctggcacatagctagagtatgtggaggggataatatggcatgcgcagcccgttgctacacagacatggggtacaatcggaattctaggtgcatggatgccagagtaaaatggttaaaggtccttcaaatgccgttatatggctcagtgtgggtcgaaggttacagtgctggtttgcatcgttacttggttggtttggcagtccatgtcgggaccatgtctttgcgttctgcgtacctggcaagcgtaacgtgggatatgcgcaactaccgcgtggagttgcacgcttgattgtaacctggggttgctgtgagactctggctgaacctcatgggttgtcacaaactgtggcattcatcacaacgagtttgcatggtgggcttgtggcggcgacaatgggacacccccagtgtggggggtgtgcatcgttgtacttggggagtgttttctcccggattggtctccaaaattggccgacactctggccaatgagggacccataataggaggcgaagcaagtggaaacagaaacagggtgcgaaggg

SEQ ID NO: 501328 - DNA, 436 bp, Homo sapiens
aaaatatatccacagcatctagaacatgggccagcatgtgatatgggctgtataaacatgtgctgtctttgaggaaggagaggtgtctctgcagccagtgatcttactatcgcacgtgttgcctattgggcccagggtcccattaccaccgtgggagggcacaagatgctggtctatagtacagagcagtggttctcaaacttcagtgcagagtgggaggaccccacctctggagattcaggttcagtaggtccaagatggggcctgaggctgtccatttctaccaagctcccaggcgatgctgatgctgctggttcagggactactctgtgagtagtactgctgcagtaactaactccatccttgcccccagtgcacaactctggtttctctgggaatcccaatcattagtgaaacagaaaaactctcctctcaa

SEQ ID NO: 501329 - DNA, 213 bp, Homo sapiens
caaaaaaaaaaaaaaaaataataaaaaccactttttgaatgtggcccgccccctaaattaggaaaaaaaaaggccttttttgcatttttgcccagttttccttaaaaacccccctaaattaaaaactctgtttttttggggtttgcccaaagaaaagcttttaaaactttttaaatgggcttttttaaggaataaaagtttttccttttgcca

SEQ ID NO: 501330 - DNA, 261 bp, Homo sapiens
cgtgaggtgattagaggatcctctacctggggtgctgccaagagacgcaagacgatgcaggttgagggcccccagctgcttctctcagaggctgtgagccggggcagctaaggcagccggagctcggcccctgacgagccccgatgagcctgagcgcgggaccgtggaggcaccagaaggttcagagagagctacatggcacccggcgagggtagagtggtaccggagcgtcggaattcggtaatcgatggtcgatagcgt

SEQ ID NO: 501331 - DNA, 223 bp, Homo sapiens
gtgacgagagagtgaatagcccaagagatgcagtgtggactgcagacgtgatagtgtgagataagagtataaacagcagaatggcatgctgatctccgaacaaatgtgaaattaggtcgaacgtgaaggggacctggtgacaaataatcacagttcacaaagagaaaagagaggtaggcagagaaaggagaggtagacagaatattttcttcttatttgatct

SEQ ID NO: 501332 - DNA, 230 bp, Homo sapiens
acaccaattttggctaggaaagcacctccagtcaccatacacagtttaccagtgtcgtacttgatgaaaacagcaatcttgccagtctctaaatcaatctgaatgggatcattcaccttgatgaggggatcggggtagcggatgttgcgggcatcatgagtcaccagatgaggtatttcttttgggcccacaaagatctttctcactttgcacaacttgtacttggcctc

SEQ ID NO: 501333 - DNA, 369 bp, Homo sapiens
catatgtgtgggagttgccatacttgtgggtatgctcaatggcttcctgaacgtggtccactacttcaatgcataactcgaggtccccatactcagggcggaatgacttcacctccggaggggctgaaggctcagactacgaggcaaatatgagggcctgcatgacctctcacctgatccactctcagcatactcactgatctggtcaacatatggtgtcctgagcacgatcccggtggacccaccaagtctccaaagcatcacaggcagctgcatactcacattcagagcctctgactagcctggctgaccttatcacccctggcctcataccccccatacatgtcccccacccctccgctgcgccca

SEQ ID NO: 501334 - DNA, 114 bp, Homo sapiens
  misc_feature (67)..(67): n is a, c, g, or t
  misc_feature (71)..(71): n is a, c, g, or t
  misc_feature (96)..(96): n is a, c, g, or t
agaaggtcttgacgttcagagtaattcacgatttgatgttgtaaacagtgaaaaggggaactctcangtanggtgtattttgacgaggtaatgttntagcagtagctctgtgta

SEQ ID NO: 501335 - DNA, 128 bp, Homo sapiens
ttagtctctgcaaagaacatcagcctgttacgtgcccagcgcgactataagaccggatggcagacgcgacggaaaccaccttgctggataatcctgagcttcaggtcgatgccgtgcgcagcaaggat

SEQ ID NO: 501336 - DNA, 414 bp, Homo sapiens
accctgctcaataaagtggacatgctatctatacgtggcgagattgtcgggtttactttgctctttatacgttatgtatgttctgcacattctgtattgaatgggtccttttttcagatgagtattcatagaaattaatcaattctccgtaaaaccgacatctaacatatgctaagaaaacttgaatatcttgtttaatatatcaccaggcattatgctgacctcatagagtgttgtaactaaattcaaaatccaagtaaccctaaagtgaagatgtaataacaaaaaggcagattgatttacgtcagaaggctattatatctgacatgatgttaaatcatgaattctgctataaattcttacatgaggatatttaaatgttatgttcactataacagacgtgaaacacgtttg

SEQ ID NO: 501337 - DNA, 460 bp, Homo sapiens
acagaaaatcgtgcaggcaaaatagatttccccagacatttggatttccatgtaaaagacctcattaagaaactgctcgtggttgacagaacaaggcgattaggaaacatgaagaacggggcgaatgatgtgacagcatcatcggtggttccgctccgtggactgggaagctgttccgcagagaaaactgaagcctcccatcgtgcccaagatagctggtgacggcgacacttccaacttcgaaacttaccctgagaatgactgggacacagccgcgcccgtgccgcagaaggactttacaaatcttcaagaatttctgaggacaggagctcacatctggaaggagagaagagttaaggaagaactgtaggttatcttcaaataagaccagggtcttgctctgtcacccaggctggagtgcagaggctcgatctcagctcactgcaccctctgtcttccg

SEQ ID NO: 501338 - DNA, 329 bp, Homo sapiens
tagaggatccctcgctattagacatcattctagaaaaggtaactaatctatggtgacagaaagtagatcactggtttaaaaaaaaaaaaaaaaagcagatcatgggttctctaggaccgagggatcagaggtccgacggtgcggattcacaaaagagccggaccaaacttccagagatgatgacttggtccacaatcttatttataactaccaaaactagggggtgacagttggacagttatacacatatgtcaaaatgggccataattatatccttcaaatgtgtgcaggttaatgggtatggtaaatactcccaacgttatatcaca

SEQ ID NO: 501339 - DNA, 197 bp, Homo sapiens
aagcttagtaggcagaataagcaaggaagtgggcagagccaagcacgagctagcgagatcctattggcacgttgtaacatttatttgcatatttccgttagggaacgcctcctctgtgaagtgcgcgtgtgcagaatctcatttagaccttgtacttcttctgaacagcgcccttttttaataaaaaaaaaaagctt

SEQ ID NO: 501340 - DNA, 229 bp, Homo sapiens
ctgtttttttttgccgatggtactcacagtggtactgggtcggccagaggggcgggcagtcaggtttagacgtcagcctccttgcttgtgccttgctccctgcctgctaccagcttggtgacaccagaggtttcctccctccctccctctcttctccctctccctcctccctctccctctctctcacacacacacacacacacacatacaaaccccgtcggataatttt

SEQ ID NO: 501341 - DNA, 891 bp, Homo sapiens
tatacgtgcgcatcaattatcacgacagctgatcgaactaggaattgttatatagagcccccttcagctgtgctttacttgaattcaacggcattggattgttcaaatgctgtatctatgttggaaggaatgataatccacgatccgttgtgcatgatacatccccgggtgttggcagctccctggagtctggtggtcacgactgcacgaataggacctgtatactgacttaccatagtagagttcctctgtacccacattaattgaattagcatctagaatgatatagtacaaacgcacaatcgttacgcgcttctttgtaaaaagatgacttactggctacaactgttcagcctggtccttgtaaacttatactttgataccatgaccacgctgagcgtaaatagtgagcaagtttccatcgacagaggacgtctttgattggtaagaagagtgaccatctttccatacgggctctctagtatagtggattttccccctttggggacacgcaatgtgtgagagcaactcactatccgagtgtccttcaaataagtctgttcgacccggcaggggctcttttcaaccatagggggggtttatggccattgaataagatcttccttgatcacttgcttcaaaatgcacccctggatggaacaggtgttggacgttacactacttacgaagatattcctcttactattgctggcatccgggcaggctgtatggatgaattatagctagaaagaacctagatttttcaatcgaacttcgtatatatctaccgggcagactaaaattgcctatgttacttgggggttgtggcttattcatcccttcagtaagctttccggtgcattggtgggaaatgggccaggacttatttgc

SEQ ID NO: 501342 - DNA, 595 bp, Homo sapiens
tcctataaccctttatttttaacgtttctttcacacaaaaaactctttgggggggaaaaaaaaaaaaaaaaaaaaaaaaaaaaaaagaaaaaaaaaaaatataatacaaacaaaataagagggggggggcgcgcacggaaagcctgccgcaccgcgcggcggccacgaggaccaccgtcgaccgaatactctagtagcgagcacgccgcctccacaaaagaggggccgataataaaaaagccaagaaggcgggccgggcgcggtaaacaacaaccgacggggggcggagaaaaacactctgcgagcagccatatgagaggagaaaaacacacaccccatggggtggggcggcacaaaaaaacttagaggaggagaccaaacacgacgcacccggcgagtgaagaagccagcgccgcagcgagagcaaaaacacaaacaacccgcggggagcacgacgctgcgtggcagggacaaaaacaccagagcacgaccgaacctgctgccggccgagagatgaaaactagtagccccgcacaagaacatggaaccacacaaaacatatccccaaacagcagaggagagaacactaacaatc

SEQ ID NO: 501343 - DNA, 134 bp, Homo sapiens
tacctggggcctgtggcttggtcgtgccgcacaggcttcctgaggcaaagcggcattggtttggattcccgcggctccatgcctgtcatgcacatgtatgcacgtacctgtggtcgtatgcgtgtcggccgttc

SEQ ID NO: 501344 - DNA, 417 bp, Homo sapiens
  misc_feature (32)..(32): n is a, c, g, or t
tccatgcaccggggggggagttccaaagccgntgtcctttggttttggtttagccacaaaagggtcaatggttgccttgcaggtgcccccagggaggacccccagtttcccaaggggcagtggccaccccgtgaaatttgttttgcctgccacaatgaacggctggatgggcccgtgtgggaggtggaagccaccctcaatttcctcaagggccatttttccccaaggaaaattattttggatttccctgcaggtgggtcagctgcccggagggatgtgcagaatgtggcagccgccccaaaggtggggatgggagccctggaggtggaaagccggaatttaattttggaccctgggaagcctgagatgatgaagtcccccccaaacaccaaccccatggcctccatgattttttta

SEQ ID NO: 501345 - DNA, 370 bp, Homo sapiens
aaggctctgaaaggggtcctactgggtcaatagacaccaagtccgaaggtaagatgcgctgcctactctgccaaagagagagggcacgatctgtagaacgggcctcaactccatatggcatagattcagattctttgggaatggagtgtattatttcgtgcaaagtgcctctccgatctctggcaatcaacactgtgtactatcgacagtaatcattgtataacactgatcagcgaattggctagtgattgtcccacgcagtagcctttacaacagtctctcagaccagagtttggcatctgttaatttgaacagtgtgggaagtgtgcatggttctactccggtgacaagccatccagaatcagtctct

SEQ ID NO: 501346 - DNA, 445 bp, Homo sapiens
  misc_feature (19)..(19): n is a, c, g, or t
  misc_feature (79)..(79): n is a, c, g, or t
  misc_feature (81)..(81): n is a, c, g, or t
  misc_feature (83)..(84): n is a, c, g, or t
  misc_feature (96)..(96): n is a, c, g, or t
  misc_feature (114)..(114): n is a, c, g, or t
  misc_feature (125)..(126): n is a, c, g, or t
  misc_feature (128)..(128): n is a, c, g, or t
  misc_feature (162)..(162): n is a, c, g, or t
  misc_feature (167)..(167): n is a, c, g, or t
  misc_feature (239)..(239): n is a, c, g, or t
  misc_feature (274)..(274): n is a, c, g, or t
  misc_feature (401)..(401): n is a, c, g, or t
  misc_feature (411)..(411): n is a, c, g, or t
  misc_feature (423)..(423): n is a, c, g, or t
aaattcaggtctgaatttntttaagtaggagtcagtctgttgaaaatccttaacatgtcaattgtcctttatgcttttnangnncagctgcaattnactcctttatggtctgtngtggacatttnncnccatctttgccaagtacatacctttgagaacatngcctncaaagatggggttctggcagccatgtctgctttacaaaacaaaaaggcctgactacataactgccctgtctngtcaaaggtgattgtgccaagagtacacaagcggncataattcgaaccaatcagtttctttctcctggggtttgggattcatagatactaattagtctctgtttgttcttgaagtgaggctgggtaaacctggattacgttcccaaaaaagcagtgaaaacngctctgccgngattataaagcngctttgtggagagaagcagaga

SEQ ID NO: 501347 - DNA, 131 bp, Homo sapiens
ctggaacgtctgaggttatcaataagctcctcctccacgtcagctcccagtcatggtcacacagcggcagtgataaagagcacagggatgtggagagatctcaagaacaagaatctgaagcacaaagatac

SEQ ID NO: 501348 - DNA, 164 bp, Homo sapiens
  misc_feature (1)..(1): n is a, c, g, or t
nctctctctctcgtctctctctgaagtctttgactttgaatgtatctgggacgccatacacagttaccttgtattgcagattaggaaaaggggtaagaaatggatgagtggccaggcacggaggctcatgcctgtaatcttggcactttgggaagctgaggaag

SEQ ID NO: 501349 - DNA, 343 bp, Homo sapiens
  misc_feature (275)..(275): n is a, c, g, or t
ggcccaggctcactagaaggccttctctgaggagcctacctacggagctgagatcaagccgagcagccgagcagggcgcatcagcctgaccttttcatcagatcccggctccagcccctcggagacggtaacatcaggccacagagccattgaaggatgagttgaacttgttgcaagtgcagtccacagagtgcggggagatggctttctgtataatggattcgaagccatttcatagcgggccctggatcgctcgctctgaaacttttgcactncctccggtcgtggatggtgacaagcagcttccagatagccaggagtgcaagcccaacaaggaggatgc

SEQ ID NO: 501350 - DNA, 186 bp, Homo sapiens
ctcatggtcccacacctcgcataaaagttaattccagtattaaatgtaaaaaaagagagcagcagcagcagcaacaaaacattcagcatgtcatgtgtgttttcacgtcctagcagcatgcaagtcttctcaaaatcttcaatttcaacaccagcaaaccttcatacaaaaggcaataaacctcaa

SEQ ID NO: 501351 - DNA, 163 bp, Homo sapiens
atgtgggcatcactgtggcactgctgatggtggccggcctgacaacacagggcgtggatatgtgtggagacggattctccgccgagctgtcggatacgcccatgaaaagctcaatgccagcaggggcttcttggctacgttagtggatgttgtcgtccagtcc

SEQ ID NO: 501352 - DNA, 103 bp, Homo sapiens
tatacaatcgagctcgtaccaggtcttttcccctcaaagttagccagtctttatagtttttcaaggtttcttcctgattggttcagctgcgtttcacttccga

SEQ ID NO: 501353 - DNA, 1306 bp, Homo sapiens
  misc_feature (38)..(38): n is a, c, g, or t
  misc_feature (143)..(143): n is a, c, g, or t
  misc_feature (234)..(234): n is a, c, g, or t
  misc_feature (385)..(385): n is a, c, g, or t
  misc_feature (402)..(402): n is a, c, g, or t
  misc_feature (408)..(408): n is a, c, g, or t
  misc_feature (411)..(412): n is a, c, g, or t
  misc_feature (418)..(418): n is a, c, g, or t
  misc_feature (430)..(430): n is a, c, g, or t
  misc_feature (442)..(442): n is a, c, g, or t
  misc_feature (454)..(454): n is a, c, g, or t
  misc_feature (456)..(456): n is a, c, g, or t
  misc_feature (483)..(484): n is a, c, g, or t
  misc_feature (495)..(495): n is a, c, g, or t
  misc_feature (502)..(502): n is a, c, g, or t
ctttatttttattttttggacaatctacaaacactttnattagcaaaaggagtaagtgcagcatgggagaaagaggggctccttcctttccccttcaaaggcattcactgtgcccctttcccaaggggcaggccagcagggancaagaggaccccagggtttgcaagcaggcgtggaactcagacaaaaggtgactccgtgtccgggaagcattgtgaccgtgccagaacattntgagctcctcattatttcactccagaagccgccgtggaacgtgggcgggttgttgaagccacgagaattacacagcgcgtgcttcgtgcctcagagaaccggacactttcggccccccgtggagaaccagttgtcagcggacgggggcaanattattcacattcgtgngtggtnctnntgaagntccatagcgtgntcgtgccccttngttctccataananaaagagttcctttgtgacattcttccnntatagccttgnagtggcntttcattctcacattcttctctttgtctcacaccaagattcttaccatttctcagaagcgttgccagaagcaggtgggaaagggcgccaggatatagcccagcgagggtctccgggcagaaagttatcaggtgggctatccttactagcccaagcctctcgcctcattctccacgttatgctgctgtgatgtagtcagccagagactctggccaccatggggctgctttctcgccggccaattggctatgtaaccggcctcatgaagctttcaatgccccagaagggcttcacaacgtggggaagggggagctgacacgcagtgtgcctggggccccattagagcaacagtgccgggaccaaccccggaagagtcaatgggatccgaggcccggtccataaaattacccaaaagagggcgacacacgggagacaacctgccaagagcacgataattaacggccccagcgagtgcgcaaaaaggttttaccgccccatactagccgcgatgtagggcacaccagtgatatcaacgcacgcggactacgtaggtggtcgtgaaaatacactggcggtaacaagaatacagatgatgtgtacctaaccaccagtagtaatgtttgtgcgatcacaacgaccgtgtgaactgaaaatcggacaacacaaggcagctagcgtgccacctcgtatggaattacccgcaatacagacgagagacaacaccagtcgttgggaggagtccgatggcgctagtacaccatctgtgacgctcctacggtctcccttttcctactagtgcagtaga

SEQ ID NO: 501354 - DNA, 403 bp, Homo sapiens
ttcagagccctgttacaaactgcgcagaccacccatagccctactgctgacacctgccctgctgccaggctttaatcttcccagagaactatgctgccacttcatatccactcaccacatcccacctacagactaacaactttcgagatcaggaccaacctggacactgccagagttggctctgcctaaacagacattgatgcggacagctcaccaacccctgaaggggccgaccagcctggttagtatgctacctactccgagtgtcctcccctgccccagcagattgctgcaaggacagcggcgtgcctgggaggcaaattgtggacccttctttatgcctatgcaactggttcttacacagctgtcatagagctttcaaaattgcagcagtcccacagat

SEQ ID NO: 501355 - DNA, 202 bp, Homo sapiens
  misc_feature (3)..(3): n is a, c, g, or t
acnacggctggctaattttgtatttttagtagagacggggttttctctatgttggtcaggctggtttcaaactcgcgacctcaggtgatccagctgcctcggcctcccaaagtgctgggattacaggcgtaagccactgcatccggccctaaagtatgtttcaatccctctatctccactgccaccaccccatttcatgtca

SEQ ID NO: 501356 - DNA, 183 bp, Homo sapiens
  misc_feature (50)..(50): n is a, c, g, or t
gacagactgagtgtggcctcagctcccccaagcctctgcccaggcactgntaggctctgtttggaaaatggggaccaacagcccccccccagggccagcctttaaaacagactacaactggggtgcagggatgtgggttccccaaacggaagggtaaacaatatagtctttttcagttcctga

SEQ ID NO: 501357 - DNA, 242 bp, Homo sapiens
tcatcggcccttgcgcggcgagacaaagtcttcgtccagttcgatgttgtcgaacagcaccgtgccgctgaccgaattctgctggccgaaggcatgccagtcgtccaccagggtcaggcccggggcgttgcggttgagcagcaccccggcgccgcttattcgctggcggcggtcagggaaatccattcggccaggtaggaaccggtggagtagaacttgctgccgttaaggatcagcttgcc

SEQ ID NO: 501358 - DNA, 623 bp, Homo sapiens
gcttattttaaaaaaacaaaaatttttcacatttttctttcttacttttttactatttataatcattatacatcttaccttaattaaccattactttaaataaaaccaaaaattgtcctcaataaactatcacatactttccactcctcaaaacataaactacctctctaacacctatattccacaccgttcactctcttattccacacttacctcttctctaccccaaccaacaactttcactcctccccctattccctcccttccacaccacctctccctataactacaacctccatactaaacctcacacccaacctcaccacaacattacctatatcttcccttcaattccctcctcttcacctaacacctatacccaccccatactcttctctccccacccttacaaccttacctaacccatcaacaacctaatctcctatccccctcctactcttccttctcttccccactcacccttaatcccatattcactacttacccctcatccccttaaccttaccacaattaactcatactcattctcactcctctacctcccctactcactcaaccatattccctctcttacacattcacacctctctacacaatatccg

SEQ ID NO: 501359 - DNA, 439 bp, Homo sapiens
  misc_feature (27)..(27): n is a, c, g, or t
  misc_feature (105)..(105): n is a, c, g, or t
cttactgcctgggccagatgcaggatncccgcgccatccccatgctggtggacgtgctgcaagacacccgtcaggagcccatggtgcgccatgaggcaggggaancctgggggccatcggggacccggaagttctggagatcctgaagcagtattcctcggaccccgtcatcgaggtggccgagacctccagctggccgtgcgcaggctggagtggctgcagcagcacggcggggaccggcggcgggaccctacctctccgtggaccctgccccgccggctgaggagcgtgacgtgtgggcctgcgggaggcgctgcgggacccattgacagcacgatggtggtccctgagtgggtcaggtagggcacaggggccagggagggacaagcagacctcagacgctgcccagatggaatattaaattatttttgccaaaaaa

SEQ ID NO: 501360 - DNA, 322 bp, Homo sapiens
gggtcatctagaggatcccagcagctgtcgtgaatggtcatgcgggttaacaaaacggcacatggtggcaaaagggtcatgaggggaaggggtgtctgttaaaaatgcagttctcagacccccatgctcagtaatgtaactcaggaattggagtggggcctggaaatctgcatctttacactggatgcatagaacccctgtcttagcctgttctttgctgctacaatagaatacctgagactgagtaatttgtaaagaacagaaatttattttcacagttctagaggctgggaagtccaaaatcaagatgctgacccttggt

SEQ ID NO: 501361 - DNA, 647 bp, Homo sapiens
  misc_feature (38)..(38): n is a, c, g, or t
  misc_feature (106)..(106): n is a, c, g, or t
  misc_feature (137)..(138): n is a, c, g, or t
  misc_feature (205)..(205): n is a, c, g, or t
  misc_feature (211)..(211): n is a, c, g, or t
  misc_feature (267)..(267): n is a, c, g, or t
  misc_feature (280)..(280): n is a, c, g, or t
  misc_feature (282)..(282): n is a, c, g, or t
  misc_feature (314)..(314): n is a, c, g, or t
  misc_feature (318)..(318): n is a, c, g, or t
  misc_feature (323)..(323): n is a, c, g, or t
  misc_feature (329)..(329): n is a, c, g, or t
  misc_feature (383)..(383): n is a, c, g, or t
  misc_feature (392)..(392): n is a, c, g, or t
  misc_feature (399)..(399): n is a, c, g, or t
  misc_feature (430)..(430): n is a, c, g, or t
  misc_feature (457)..(457): n is a, c, g, or t
  misc_feature (510)..(510): n is a, c, g, or t
  misc_feature (631)..(631): n is a, c, g, or t
caactgcgggggcaggcagagagacagcaaaagcaaanagggcaagggggggggacaaaaggagacgggaccaagggcggaagaaaaaaagggcagaaagcggganaagaaaacaggcaaagaagcagcacaggggnnaagaaaaaaggaggaaaacaggagccgggggaggagggaggccaagaacagggaggggggggcggcnggggcnggaagggcaggaagggagcagccggggcgggggcgcaggggcgcagggggggcagncaggacggagacncngggagggcgccagggcagggaccagagacggngacnggganggaggnggagagggccgggccaggggcggagggaggaacagagcaagcagagagcccgcnaggagggcnaggaagnggggggagaaagagcggggggccggagggcngaaacggcccaggaaggggccaaaaanacgcggccggggggggagaggccgggaagcaggacaaggcgaggggggcgccngaacgggaagaggggaaggaaggggaaaggcgggggagggcgggaccagagaggacagggaggaggacggggggacggcggaggccaccagagcgggcccgcgagggcacagggagagggncctgggtcagggcgcg

SEQ ID NO: 501362 - DNA, 768 bp, Homo sapiens
acgaggacctcttctcacaagtacgtgcctcgagccattctggtggacctggaacccggaaccatggacagtgtccgactcaggggccttgtggacatctcttcaggcctgacaatttcatctatgggtccacgagttggggccggctaacgaactggtgaccaaagggtcactacatcggagggggcggagtctggtggcattctggttccatggatgtggtgcggaaggagtgtgaaaacgtgcgattgcctgcagtgtgttccagctgacccactcgctgggggggcggcacggggctccggcatgggcacgttgctcatcagcaaggtgcgtgaggagtatcccgaccgcatcatgaacaccttcaggcgtcgtgccctcacccaaggttgtcagacacggttggtggagccctaaaactccaggctgtccatccaccagctggtggagaacacggatgagagctacgtgcatcgacaacgaggcgctctacgaatctgcttccgcacctcaagcgtggcacgcgcactacggggacctcgaaccacctggtatctgggcaccatgagcggaggtcaccactccttgcggcttcgcgggccagctcaaggctgacctgcgcaagcttgggcggtcaacattggtgcccttcccgcgcttgatttctttcatggccgggtttcgcccccctacaaggccgggaaggcctggagtaccgggccttggcgtgccggagtcacccagagattttcggtgccagaactg

SEQ ID NO: 501363 - DNA, 1693 bp, Homo sapiens
  misc_feature (118)..(118): n is a, c, g, or t
  misc_feature (140)..(140): n is a, c, g, or t
  misc_feature (160)..(160): n is a, c, g, or t
  misc_feature (199)..(199): n is a, c, g, or t
  misc_feature (233)..(233): n is a, c, g, or t
  misc_feature (336)..(336): n is a, c, g, or t
  misc_feature (970)..(970): n is a, c, g, or t
atgaatgatgactatgagtacttgagatctacaacatcgggtacctgcggcatacacttaaaacccagcctagaaacgaataggactctacttctcttcgggactctattctcagttntctcttctgcgagagaacgctncaaagcgcctatcctcgcanagaatcgatctatgagatcgcactctcgacgccttattngcgctgcgagcacatgctagcctctattctacanaagacgggtggtactccactcgtgtgatcatatgtatacaccatgtgttatgtggtgcggcatgaacaacaccagggaaagcaacacgtatctgtgacgagantgatatctctatgtctcctctgtctttagcgtataaaaatatagtatattgcatcagacagccaagggggctcatttacccgactaagtgtctcgagagagacgaacagcacggcagccaatagcgacggatatctctatatatgcgatgtaggggcacaagacaggtgtgtcccgtgagttaaactttccctcacacgcactgtgagagagctctctgtgggactctatcttctaaccaatgacatatacaagacggtgtgccacgaggtgtccaccccaaagatgttcgcacacaccaaagataagaaatctgctcccagtgtgtacacacggcctatgcgttggggcataaccttttgagagactgatgtagagcgggagacgtaggactgggcgtttatgggcccttgatccatatattagcacgggaggagaaataatatcagatttggctacccgcggggagcaaattataatgagtagatacggccctaggggttgcggaatatactaatggacgcgcccctaaggtgagaagaccacggcaggataaaggcggtttggggcgataagatggggggagcgcggagttgagaacacttggacaggagaagacaggcccgaacacaagngggcggtttgcccaaccacagacaaaatgacatgacataactagtaaaggcgccattttctcccggtaattgacaataggcaaattgaccgcaaaatatcggcacaagaacgggagagcgagagtaaccaatttggcggccttccgcgaaagagctttttggtagtacaatcaaaaaaaaagcccctatgggccgccaattggataacgcaaaaaaatccttccccgagaaaacgtttgttgtgctggaacggaaacaccccctaggacaaacattcttaaggcgaccgggggggggcaccaccgctggggcaaccaaaaggaccgagtatccccgtggggagggcaggagcaataggggagcgggcaagagatacacccaccaaaacgctaactgggtctgcgcacaccttgttatgtgaaaccgccagagagcaatgaagacgttgtggcgccctatattgtaagagacacgggagtaatgctattccacaacatattagcccggacaaattaggagtttcctaagaaatatctggcgaaaagacgaggcggaccgctccaccctaaggaagaggaatatatccacccttagcagaggagggggcccccacaagagcgtattacaggggcggttaatcccgccggaagattctcgtacttgggtacaacgaacagggtggtccccccataattatgaaggacagcgcgcagcatacaataa

SEQ ID NO: 501364 - DNA, 664 bp, Homo sapiens
tttttttctccccccccccccccgggggggggggggagaacataatctccccccccccttgggggcccacaaaaaatatattttttcccccgggggggggggggggggccctcccccacacacaaaaaggggtgttttttaaaaaaacaaccccattttttttttttccgccccaccggaggggttttttttttgggggccccccccaataagaaaaaagccccccccccccaaaaaaattttttttttttttttgaaaaaaaaaattttttttctcccccccccattttgtgggggggggaaaaaaaaaacccccccccctttgttggggggcccccctctccccaaaaaaaaaaaccccgcccgccttttttttaaaaaaaaaattctcccaaaaaatcccccccccaaaaaaagcccccccccccaccccatattgggtgggggaaaccccccccccccacaaaaaacccccgagaaaattttttggaaaagggggcgcccctaaaaaaaaaaccttttttccccaggggccaaggggccaaaaatttttccgtgttttgggccctttgttccaacaacccaaaagaaacccggcccaaaggctttccgttacggccatttcaaaaacccgggtgggttgacatggctatagcaccaggtt

SEQ ID NO: 501365 - DNA, 536 bp, Homo sapiens
  misc_feature (9)..(9): n is a, c, g, or t
  misc_feature (121)..(121): n is a, c, g, or t
  misc_feature (243)..(243): n is a, c, g, or t
  misc_feature (326)..(326): n is a, c, g, or t
  misc_feature (329)..(329): n is a, c, g, or t
  misc_feature (346)..(346): n is a, c, g, or t
  misc_feature (369)..(369): n is a, c, g, or t
  misc_feature (531)..(531): n is a, c, g, or t
tcggtgccnctcgccccgtttgtacaacccagccggctggtccggtccggaattccgggatgccgaggtttccccaacctgacgactgtcatccaggcgacatatgggacagatgccaccnatgtgggggctgacggcgggtttgctcccaacatcctggagaataaagaaggcctggcgctgctgacgactgctattgggaaagctggctacactgataaggtggtcatcggcatggacgtngcggcctccgagttcttcaggtctgggaagtatgacctggccttcaagtctcccgatgacccccgccggtccctctcgcctgnccngctggctgacctgtccnagtccttcatcaaggactacccngtggtgtctctcgacgctccctttgaccaggatgcctggggagcttggccgccgttcaccgccagtgccggcctcccggtcgtgggggctgctctcacagtgcccccccccaagcggatcgcccaggccgtgcacgcgaagtcctgccactgcctcctgctnaaagt

SEQ ID NO: 501366 - DNA, 648 bp, Homo sapiens
ggcgagctcatgagcatctcagtgcatgctcaacagctcaaggtgagccagtcactatttggctctccaacagtccagaaatgacagattgtgactcgggatatattacaggctgctcaggactattgaagtacgtcctacagatagcagcaagctggatcaggtccaggcaaaacgtccagagtgctacaaggaggttgcgtgcatcaggtccagaaagacctggtcaagaaatctgacagatcatgctgtggccccactgtgacgtgttcgtgtccggtagacagtgcagaaccactattgaaaacagcgttgatggacccggagttcagagagacgacatcattcaacttggggaaagacattgtaacctatattgtgccattggaatggtattctcatagaagaaacttgtacgacgagcaaagtgtggccacgaatgtggttactataacggagattgcatatattgtgggggagtttcatagtgaattaacaaaggagaattgcctaagtgcaaagcggggggtgggaaatgcctttgtatagaagttggaccttgaatctggttgatggactttttagaggtgaggtaacgattgggaaatgcgatttcagaagcactactgttacgcagaaggaggtcat

SEQ ID NO: 501367 - DNA, 161 bp, Homo sapiens
taggtccttcccttgatttctgaatttaattataatacgtttcatttcaacaaatgtttaaaattattctaacagtgtgggaaacgtattctttactctcatacaaggaaaatgatttactaggatctttactgggtacaaatgctaatagcatggtagta

SEQ ID NO: 501368 - DNA, 220 bp, Homo sapiens
  misc_feature (66)..(66): n is a, c, g, or t
tctgtaaagccccggcttcagtcctctacagggaagggttgggggaaaagctaaaatgtcttaagntaagtgtccaaggattgtcccgtcacctcctgggactgggattgcccgacaacactgtgatgtatttctcaatgaggtgcctttcataactgaccaaatgctgccatgtttggcccctgagtcaataaaatatgttgaaaatttgtaaaaaaaa

SEQ ID NO: 501369 - DNA, 271 bp, Homo sapiens
atctaacttgataaaagacagcaatccaaaggttccaaaatttttcatacattccaagccgaatcaatgtcacgaactcatgcagacatatcaaaatgaaactactgaaaatccaaggtataaagcagatctttcaaagtgcagcctgatgggcacagtggtatcaaacctgtaatcccagcacttatgggaggctgaggcaggcagatcacctgaggtcaggagttcgagaccagcctggccaacatggtgaaaacccacttctactaaa

SEQ ID NO: 501370 - DNA, 1530 bp, Homo sapiens
tttcagtggggtaaaaccatttttattaactgaccaaagcacattcattttgtgtttcctgatttgtgaggataaaactcattaaaacacagttctcacaagaaaaaatcacaagtgacatattttaaccacaattatacaagtttgtgaaactcctccactagggtgttctcattatatatcttaattatcaccaaattctcatatcagccaactgtgtgtattatgtctctatatcttatagacgcttatagtgtgttatacaccaagaagagagagcccaatatatctctacaagacactctatatgacacacacttgtacactatcactatcacttttgtgtgcccgaggtgcgagtatatgtatgtgtctctctatctacacacacacacgagaacatatacactgtgtgtacaccccttcttatgtgcacattatatactcttatcacctttatatacacacacgcccactgtgtgcactctgacgcccgaactgtgtgtcacagtgtgttccctctctggtggactctcaacggggggtgtgtgtgcaatgtgaaaaaggtctctcatatagagaacgaagtccaaacaccacctgtgtgtctccctatatatctcgtgtgtatgtgtgtcacccactctcctctctaaattctccacacatgtgtacagaacgtatcacgccacaatgttgtgcgagttagtaaaacagataataaaaccccgaaaaattattaaaacccgccatgttgtggcctcccctccaaccccactgtgggaccaccattgttggcgggcgcctgttgttgggggaaaacagacaacagacgctcctctgataaaccacactatccctctacaagctccaacatatatttttctatagagcggcagtcatttttacatagaggcgaccgcaaagaccacgaagacacaatctgttattgttatgatctcctccccctaaagagtgaaacattcatccacatctcttttgcggacaccatgttgtctatcctcacaaaacaatatccccgttataggtatatttaacaaggagtgcccctcatacacacgcctctatatatgtttaggagacccctttcaaccaggtggtgtacatgtatttactgacgctgccgaacacgagggcgagacatggacgatccaacagcgagaccgacgtgacacccactaacagctggcgcaagaagaaagcagcggcgccacaaaaggggaacaacaaacacaactagcggagtgggcgaacgggtaccgaccgacagacaaaaaaacgaaccacacgaagaagacagacaaacgatcgtgtgacccagtatcaatcatgccaggacacacacgcgtcagtaagaagcacccctcctcgcggagtatgttcttaggccgcacgaacacgaacgtacccgacgaaccggcagtcagaggcgacgcacacaccgcgtcgtggcgaacatacaacgggcgaccggtataacgcaagacagccgccacagtcgcaccccca

SEQ ID NO: 501371 - DNA, 134 bp, Homo sapiens
taccctgataagggccaacctgacagtaatggacagagtgcaaagagatgcttcttggtgatggatgcatatgaagaagtgcccaggctcaagctggatgaccacagtgctgtgtgaattgccgcctagtgtat

SEQ ID NO: 501372 - DNA, 215 bp, Homo sapiens
atagccgacggatatcacagtggtatgtcggtccagaggggcgggcagtcaggtttagacgtcagcctccttgctgtgcctgctccctgacgctaccagcttgggacaccagaggtttcctccctccctccctctcttctccctctccctcctccctctccctctctctcacacacacacacacacacacatacaaaccccgtcggtctaatttt

SEQ ID NO: 501373 - DNA, 256 bp, Homo sapiens
tcgaggatccgagcactgaaacgtaagacagactgcaagaccaacgctgtctctacctccgcatctatctccgtcctctgcctactcgactgtgaagacaatgagaaagaagacgtggatgttgacccaggttccatttaatgaatagtaaatatattttctctttcttatgattagctaaataacattttctctagcttactttattgtaggactatagtgtataatacatataacatgcaaaatatgtgttaat

SEQ ID NO: 501374 - DNA, 234 bp, Homo sapiens
gctcgcgcgagagaatgcagttgtcttgacttcaggtctgtctgttctgttggcaagtaaatccggtcctgttctgttcccgctgcttttggattgctttgtggacgactggggtttgttttaagttgtgttcccccctgattggggtggtgttttttttgggggaaaatccgctgggtgtttggggttggtttttggggtttttttcggttttggggcgtgttttttgtttag

SEQ ID NO: 501375 - DNA, 178 bp, Homo sapiens
tgtgtatacctctcgaataccagaaatggtgagctcgaacgagggtaaggttcctgtatgtcactcctcaccagaaaaagccactaaagcagttacagaaatgaagcggtagaatatgtggccacaaatgccattgtaatgtggctttagcctcagcgcaagagaagagcgccaggat

SEQ ID NO: 501376 - DNA, 458 bp, Homo sapiens
  misc_feature (396)..(396): n is a, c, g, or t
  misc_feature (449)..(449): n is a, c, g, or t
tggcaggctctctacctatgccacatcccttcactggggcctaacttagtggaatcaaattaagtatatttccctccaagtggccccaggattctggggctccttggcacactacaggttttctccaaaggcccggggtttatctatccttgggtgaattttcaactcttctaatcacagttctcccggccggccaagcgcatccgggactccgggtctccgttggcctggtggagtccacagggatggccttcctggctctcggtttcagccagtcctatctttcctcaaggccacggctagtttcatctcggcgaggccttctcagctcccacccggtctcaggccctcagggcccgtggggatgggcagcaccttcagcgtaaagcagacggntcggagtggctggaccggctttaagtcggcctccgtcatcagaagaggatatnccgggctaa

SEQ ID NO: 501377 - DNA, 303 bp, Homo sapiens
tggcccgtgtgcctcggtgtgtctctgttcctctccaggaggcaccaccacagtgccccacttctggaaggttccatccgctgcgggcctgcactacacaggctccatactgtgtcactggtcttacccatcccgccagcatcccagccatatcaatgcagaggcgcagcacacggcccagcacctcagggtggcctcatggtcagagatggggtggtgggcaacgtgtgcctttggaggatctgcgcgcctgctacgtctccttcccattctccaagtatctgcggagcaactccagacaca

SEQ ID NO: 501378 - DNA, 823 bp, Homo sapiens
ggcgtccagctgctccggaccgaggctcggggtgtatggggccgtaggaaccggctccgtgggccccgactaacgggcctgccccacagcagcctcgggctggcgtgagggtctcccttgtatctgagaatggctacctctcgatatgagccagtggctgaacattgtgtagtcggtagcctatgggacagtgtacaaggcccgtgatccccacagtaggccacatttgtggccctcaagagtgtgagagtccccgactggaggaggaggtggaggaggccttcccatcagcacagattcgtgatggtgggcgtttactgcaggccgactgggaaggcggtattagacgcagtcccagagtgttgtctcggcttgatggacgtctgtgtgctagaagtacccgatacatgacctgggagaatgcaagggataaccgccatggtgtcgagagcagtgtagaccaaggacctgaaggacagtagtctgggacagagggcactcgcccacgcaggcttgccagcacgagaccgatccaaggatctgatgcgccaagtttcttaaagaggcctaggatatgcttcagtgcccaaatgaattcggttcaccggagagtctgatagcccaggaagacaacatttgctcggttgcacccagtgggtggcgaaaccaagtccaacgcgcttgggcttgaactttttggagcctggccccatgacatccttacatggttacgcagaatgggtcactttaccgagcccggtggttgtggagcactctgggtacccggagatcccggagagtcttgctgcagtgcgacgtatgc

SEQ ID NO: 501379 - DNA, 1017 bp, Homo sapiens
  misc_feature (18)..(18): n is a, c, g, or t
  misc_feature (32)..(32): n is a, c, g, or t
  misc_feature (630)..(630): n is a, c, g, or t
  misc_feature (637)..(637): n is a, c, g, or t
ttatcccattatttcttnaccaggcggctgtntaagatcaattttcacccagatcttctcccctagtatcttcagcacatgctcactgttctccccatccttgtctttcccatgttcattaattcatattgccccgcgcctagtcccattttcacttcctttgacgctcctagtagttttgttaagtcttaccctgtaatttttgcttttaattttgatacctctttatgacttaacaataaaaaggatgtatggtttttatcaactgtctccaaaataatctcttgttaagcacggagagcagttcttttccattacacataaagtcaggaggtggttccccaaccgcaaaggccatctcaattaggtgagtagcctttaaaacacacctttaagtaaaaagtatgtgtgttacccccctcacattagtgtgctgtgtggggcagttcaacacaaatgtaacaatgtatttttgtgaatgagagttggcatgtcaaatgcatcctctagaaaaataattagtgttatagtcttaagatttgttttctaaagttgacactgtgggttatttttgtgaacagcctgatgtttgggaccttttttcctcaaaataaacaagtccttattaanccaggantttggagaaaaaaaaaaccctggttttttatttttgcattttattattggttacttcaaactttgttttacagcgtcctccacaaaacctctagaatgcactagatatatttttcttggagtcataatcatgatgcataccaacacaacactactcaaattatatttcattgagatgcatgttgcattgaggagtcaacttgacatagagtggagactttttcaaaaggctttttacatccttatgaaagttggggaggaattatccttttgccttttcataagggctttggggccaactgggccccctttcttgaggttggggttgggcctaaaaggttggcccttaaaaggggaggggttaaaaactttaaatttttt

SEQ ID NO: 501380 - DNA, 157 bp, Homo sapiens
gcttagttagatatctaatatctctgtcatcttgatgtgccatcaattaaggtctcttctcatgaagcggaggttttctgggcctagttttagaagtttcaatcctagttttagaagtttcaatagcatagtactctatttcagacaaggcaaagcg

SEQ ID NO: 501381 - DNA, 192 bp, Homo sapiens
  misc_feature (22)..(23): n is a, c, g, or t
atcagagagagttttcctggannaaggtatttgagctgagatctaaaaccttgctactcaaggccgggcacagtggctcatgcctgtaatcccagcactttgcgaggctgaggcaggtgaatcacctgaggtcaggagttcaagaccagcctggccaaatggcaaaaccccatcttggtcaggctgaaaatt

SEQ ID NO: 501382 - DNA, 393 bp, Homo sapiens
  misc_feature (205)..(205): n is a, c, g, or t
  misc_feature (231)..(231): n is a, c, g, or t
  misc_feature (238)..(238): n is a, c, g, or t
  misc_feature (288)..(288): n is a, c, g, or t
  misc_feature (293)..(293): n is a, c, g, or t
  misc_feature (318)..(318): n is a, c, g, or t
  misc_feature (338)..(338): n is a, c, g, or t
  misc_feature (342)..(342): n is a, c, g, or t
  misc_feature (347)..(348): n is a, c, g, or t
  misc_feature (387)..(387): n is a, c, g, or t
cgttatgggctgatgaagaggccttcttaatgttccagaggtgctataatctagatgtaatgtggtcactaattaattgccattactcccagttgagttacccattgtcagtttgggcatttatattgcaggacacgcagagtttgttaaagcccttgtggggctaaagtccaggagtgttccagagcttgatggcctgtcccancaagagagaaacgacgttactggccntagaggncaccaaagtccctggtgggattacactgaaacgaagtggcgtgggtgtcncttcntactgtctctgggacttacactttntctgcgttggagttgtcccntagnacagnnacgaacccgtcatagctgtatttggtaaaggcagcttanctgtgt

SEQ ID NO: 501383 - DNA, 344 bp, Homo sapiens
atagacagtgtacatgcatgcatattgtatgcgcttaaatgtatgcaggctgtgccacacagtcacagagtccaccttcctaacacaggcccttcggctatttagagagagtggacagttgtgcctgtgacttatgtgtagacagacctgcagcctcagaaaacaatgtcctcagagaggcaattcattttgcaacagtcataaaacataacacatataaatgaaaaataaatagcaatggatatttacaagcaaataggcagggcaagtataggcagggcaagtataggcagggcaagtatgtcgacgcggccgcgaatttagtagtagtagtaggcggccgc

SEQ ID NO: 501384 - DNA, 401 bp, Homo sapiens
  misc_feature (37)..(37): n is a, c, g, or t
aaaaaaaaattttttaagatcccagctctttgggggncggcaaaagcagtggggacccagcccagtttccatcaatttcatcaaaaaacttgaggttgttgggcccagtatttcaaatgcccaaagttaaaaagctgggtatacccaattaccaaccaaagtgatatgcatttaaccctttccctttatggccaatttttttataaaaaggggtcatttgctcataactgttagacccccccaaatgtttttagtaacctgagggtttatgcttgcaaaaatgtatgttattattgtttgttttattaaattaaggggggtataaagtattttgttgggtttttatgtttttcaaataagttcccctttaaaaaataaaaatttttaagttttttaaacta

SEQ ID NO: 501385 - DNA, 726 bp, Homo sapiens
gcggcgggagcttgagtgctgtgggcctgagctgtcatgaactcgtgtctgtccggcgccctgcatcccgggcccgggcggcccgctggaggtcggcgatgagcacagggctgactggtcggctgcccgggccatgagtgcctggtgtagcagtcgctggagccagtccctggcagtcatgctgtccatgagctgactctcccctcagaggagactcttcctcagcggatggctgcagagacagatgatgcgggtggctcctggccgcgtgggacccgtgagacgggttcgtgggcggccattaagggggacgctgtgaacacgcgggctgcgcaccctccggactggttccattgggccccgggacgctcgacggcgggccctgcgagtaggcggcatgctcccgcggaggctgctgggcgcctggttggcggggacgcggggcggggtgcctgctggtgcttctggacgatccgtgcgcttcgttcatgggcctgcgcgtgtggcgcggcgccagcaccatcgcagcacgctctacggccggcctctactccgagagctccacagccgcgtactccctcgagccggctctggcagcccggtttgcacaggccgtcctgtgcagtgccatctggcttgatcggcgggcgttaggcccggggtcttccgctatgggacgcaggacgaggactcccaggaacaggcaggagtttggggagaaaaaga

SEQ ID NO: 501386 - DNA, 180 bp, Homo sapiens
tgcacgccaaccttggcaataaaagcgaaattctgtctaaaaaaaaaaaaaaaattcttgattaggctgagcgctgtcgcaaatgcccttggggaggctgaggtgggcaaatcgtttaaagccaggattttgagaccaacctgggcaaagcgaaacgtctctagggtaaagggcccccgg

SEQ ID NO: 501387 - DNA, 306 bp, Homo sapiens
  misc_feature (277)..(277): n is a, c, g, or t
gttgtgctgtggcatctggtgaaaccctaccccacctgaaggcaatgtttttaaatctgtaaaataagctgtataggattacaaaggaaacattatatttatagacagttatcaaaatatttcttttttatttttgagatggagttttgctcttgtcatccaggctggagtgcaatggcgcgatctcggctcactgcaacctccgcttcccaagttcaagcaattctcctgcctcagcctcccgagtaactgggattacgggcacgtgccaccacanccagcttaattttttgtatttttaagtag

SEQ ID NO: 501388 - DNA, 657 bp, Homo sapiens
attcggccattatggccggggaacttgctgattctgtagtaaaacctgggtggaggttggggtggggggtaagctcatattatataaggtgccgcaccccccaacaaactttttattattcaactacattgtctctcatacccatcatccacaaacctaaaactgacaaacactaccaagctacaaattaatttaccccttaaacaccccaaataaatacacatacttaacataatattataatacacaacacaccacaaccacaacccaaccatcaacataaacaatactactcaacacccacaaaacaacaaaataaacttaaaaacacctttccccattaaacacttacttctacatataaaaaatcactcacacattatctaaacaacacaaacaacataaaaaaaaccaattctacaaactaaataaactctaaaaatatcgtacaacacatatactacactaaaaaaaaaataaaacatcccccctatacacacacaaaatcaaaatacatatattcaaaattcgacctcacaaaatccaaaacccccacaaaacccacacaaattaactgaaacatccttcaaactactaaacacaatcctaaactactcctacacactatcacattgctcaacaaacaacaaaccttct

SEQ ID NO: 501389 - DNA, 510 bp, Homo sapiens
ccccgtccctctgccccccggcgcggcccgacagctcccagccccatcctggcaggtggcttgggtggcggtagatgccgggcgggaggaagatgtggggctgctctggcaggttgggggtgcgaggaggaaaaaaaaacagagaaagacacacacagagagacagggagagagcgcgcgcgagagagctcttgtctatagatttatccacataatatatatttatgtagctttttttctctcgacactgatgaatgcgcgctcggatccccgggcggactccctccaagccggctcgcttttctagtctaaataaataaataaagccagatggaagaaaaaagcgcccattccacctccgccgccgccccgcccgccatccctgcctttgcttcgcccgcctggcgccctaatagagcatagcttggtggataaagcccccctacatacccacacgaaaataaaaatcactatcattaaaatacaaaaagttgcacctgctgctattac

SEQ ID NO: 501390 - DNA, 213 bp, Homo sapiens
gacatgcgagacgtggaggaccaggcctccaccctgtctggcctgcgtcccttcatcgcccttaagcactaagccctagcctcccctgctctccttcccacgcatttgagcccttggttgcctgggcccaaggctgagcgggttttcagtatttgtaagcatttcagcagaacaataaagaccgtttggcactacggaaaaaaagaaaaaaaa

SEQ ID NO: 501391 - DNA, 728 bp, Homo sapiens
tctggatgtcttgctctgtcgccaggtctgtagtgcagtggccactctcagctcactgcaacctccgcctcccgggttcctgcccttctcctgcctcaccctcccgagctcgctgggactacaggtgcccaccagccacgcctggctaatttttctgtgttttcagtagagatggggtttctccgtggtctcgatctcctgacctcgtgatctgcccgaccttggctctcccaagagtgctgggactacaggtgtgcacgccatctgcgcccgtgcccatcactggaatctttccaaaatgcagccgcttcagcaatagatgatgtcaaagagaccgatcacattctgacactttagtctcacaactcttctcgcgtcagccgcaaactttccacgagtggtcgcatgtggctcctgctcatgtttgtgacgcagaccttctgatgcagtgctgtgtagagctgggctggtggtaaggactaagagaaagggcttcttaggtgctaccgccgtggctttcctgagttcctccttctcttgaatgatcaaagctgacattctctccttcttagatgctgtcatggctagtcagctctttaacatttctcattagccatttccccttcttaagtccacctttttctgctccttgttgctaccagttctgggttaataaagtgggaagctcatacacctgctaatcttacattaatttgttcctaacaggg

SEQ ID NO: 501392 - DNA, 134 bp, Homo sapiens
caccgaggcccacttggacgtcggggtccatgtgttcgccgtctggactcagctgcgctgctttgatgaacagatcagtcaccttgtcgtgcagaagctgccggtctgtgaagcccaagtcggaggcgggtgag

SEQ ID NO: 501393 - DNA, 380 bp, Homo sapiens
caaggtggaagcaaccacatattcaacaaatgaatgtgtgaacaaaatgtggtatatacatacaatagaatattattcagtcttaaaaaggaaggaccaggcactgtggctcacacctataatccctttgagagaccgaggtgggcagatcacgaggttaggagattgagaccatcctggctaacacggtgaaaccccgtctctactaaaaatacaaaaaaattaaccgggtgttgcatcgggtgcctgtagtcccagttatttgggaggctgaggccggagaatcgcttgaacccgggaggcagagattgcagtgagccgagatcgagccactgcactccagcctggtgacagagtgagactgcatctaaaaaagttta

SEQ ID NO: 501394 - DNA, 114 bp, Homo sapiens
tctgcggttgttgcagaactgatacttatttcagagggctagatctctgaaaatacttcgtgggaatcactgtatataaaagtacaaggtgtataagctacatcattaatgagc

SEQ ID NO: 501395 - DNA, 100 bp, Homo sapiens
  misc_feature (1)..(1): n is a, c, g, or t
  misc_feature (7)..(7): n is a, c, g, or t
  misc_feature (9)..(9): n is a, c, g, or t
  misc_feature (11)..(11): n is a, c, g, or t
  misc_feature (15)..(15): n is a, c, g, or t
  misc_feature (32)..(32): n is a, c, g, or t
  misc_feature (55)..(55): n is a, c, g, or t
  misc_feature (61)..(61): n is a, c, g, or t
ntctttngncnttgnatggaatgactttttgntgtgatggttttgaatgttgggnttctgntgtctgcttagtacccatgcctgattttttgagattgta

SEQ ID NO: 501396 - DNA, 269 bp, Homo sapiens
ctcgtcgctctagaggatccttgtctgcttaggactacctggctgtttgcttatctggtcctggttctgcctgacctggcttgtcttggatcctctctggttctgctttctccctggcctgccttgctctggcctgtcctggccagccttgaccctgaccctgtgcctgacaatccccaggtctgacactggccatgcttggccctggcccttccttttggccctgcccctggccctgccttagccctgtgctaatcttagtccaaagg

SEQ ID NO: 501397 - DNA, 247 bp, Homo sapiens
gggggaaattttaaaactcagactccttgccttaagcagtcctcccacctcagcctactaaagtgctgggattacaagcgtgatgcattacatccaagagaaatttcttgagacggctacatgatgcctaaatctgctggtgacgaagttaataaagtgtagaactgaataaatattaaatattagatcaagtttctcatgtttatcttaacgtataacgatttatgtgaaagcactgattttcact

SEQ ID NO: 501398 - DNA, 391 bp, Homo sapiens
tggcagaaaaccttgagggttgtcagtaccagttcacataggctttccttacgttacaacgaggactttctatctcactacagacatcccttccccttcctctccacttttcttctacgtgcccaccctatctaaaaaaaatcaggtgtttcaccaaccgggattagtttacaatgtacgacctgaccccggccaatagggaaagggtacaggggcaggacttgcatcaggcagtaaaggctctcatgcccctttgttcaggtatgctctcatggcaactggtcaaggaggcacccctctgcacagaagtaaaattgctttgctaagaatcctttgttcgagtgttcaatttccttaggattttgagcgttattcctaacactcattctct

SEQ ID NO: 501399 - DNA, 702 bp, Homo sapiens
aaggctcgtagcctaaaacaaatgtcaggcattggtcgcatagaaactgtcgacctagtgggcagctgcctgttgtaatcaacttgatacggaaatgcatgctcttctacgggtgcctagcgcacctgtggcatagttacggatcctctgtagccctcgtggtggctagtgagtcacattttctacaagtacagcgtaggttcagagctgaacagccatggatgagcagcagtgtggcctgcctatcagccgctggctccccctccagcataagcctagtcatgtccagatcagcgctgtcatatcaagtccagctccatgtgacaggggctccattccccccctgtcctgcagggaggggtgccatgagtcgtgctgtcggctcatacagcacagaggaaaggctggcaggctctgccagcatccgtactgataagaggagggagtcactccaggaataacccctaaggagaggaggggtccatcacctgtggcgtctaccatcgtgccttgcgtgtctctggtttacatcatgatgcatggagcgccaacagccatcataggtccagaaggtgcacagcatcacgtaaatcatctatatgttaagaaggacggtgagagcccaatctctggtgttaatgagatcatgcatgaactccggacgcgcctgcctcagagtgctgcgaaagatataaaaattct

SEQ ID NO: 501400 - DNA, 297 bp, Homo sapiens
ggcacgaggggcctcggtgattttggagaaaaaagaaatgcaaagccagcaattgtttgttaaagaaggattagaaatggctaggagagagtgagtgcgattgatagtgtgatagagatagctggggagaggtagtgggtggcataagaacgggaacaagaataagaatgagtataaaagtaaagaataagacttcatcagggtgaaagtattggagtgtgttctgtcagcaaagatcatctatccactccaagagggaggcaagagtggtggattggggatagattttcacgatgg

SEQ ID NO: 501401 - DNA, 147 bp, Homo sapiens
tttttttttttatttaaaaaaaagggcccccaaaaaagccccttttttttggggttccaatggggggccctttaagtaaaacgccatttttttttttgggtgaaaatttaaaagggccggccccaaaaaaaaccggtatttttttga

SEQ ID NO: 501402 - DNA, 116 bp, Homo sapiens
  misc_feature (30)..(30): n is a, c, g, or t
gtatcttctttttttattccagaataactnacttcactcacaagtgagatgaatggtctttttacagaatttagggattccaagtggcctggttttaatataatacatattcacaa

SEQ ID NO: 501403 - DNA, 176 bp, Homo sapiens
acttggtgagttacgacggggggcgcacatttggcagccctcatgagtgcaggcccgccacttgtccagagggccacgttggggatgtcttgaccccacagccatctgggcaagtggcgggccctgcattcttgggttccggggttcgattcggtattcttgtccttagttgttcc

SEQ ID NO: 501404 - DNA, 602 bp, Homo sapiens
  misc_feature (419)..(419): n is a, c, g, or t
gtagcgctcccactaccaaaagctcccgtatccttgaacaattcctaataccattagaggaatgaaagtacataacaatgtgatgaatcaccttttacttcctagactagcaacgaatgaaagctaagtgtaacaagggtgtagggatacaggcacatgtgtgaactaggtgtgagtgtaagctgagttcaatggtcttttggaagaaaattcgtaaacatctaaagaaacttctgaaatgatttatcccacggaagtagaagtaaaattctacttctaaggagttgcccaataagctggtgcgcatggacatgtggacacacgatacatacaagggtatttagtacaatgctgttggaattagcaaaggcaaatttgctttgggttatatcccatcgggatgggatataaccagctgnctctagatggcaacagtgaattaacctgtggcttacccatgtagtagaatacaatacccttgtttaaaagaaaatcaatctgaatgtactggcataaaacatctaatgtgatttgtgctagctcccaaaattttaaaaagcactggtgcattgaatgctttaataaggcagatgatgggggat

SEQ ID NO: 501405 - DNA, 894 bp, Homo sapiens
tagaagcaggatgccacagtgtggaggctgccctaaagacctttacgatcactgtgcaaagcggggaagcagtgtgaactctttatgcaatcccagactgtcctgtggtcagtcgcactgtgtgcacgtgctgtgtcccctgttccacttccatgctgtaccgacagcagcatgaaagcatttgcatagtgatacctcatcactagacatcgtactaaaacagaaacgttctacgttgtagctcacttccaatatgtcctatcaataggagcgtgtgactggggcactcataggaggcttcatcaggtgattcccctatctcaggctacagcctagaccaaacgctagggcaatactccatttcacatatcatctggatcggcgtaaagtctatcttaacattaccacaagggtgttctcggggcgtatccggaggtgccccgacgtgagggcggactagcccgatgcatacaccaaatgaccggttcccgggagtatctgtaggctcattcatttctctaacagcagtaatattactaattttcatgatttgagaagcttcgttcgaagcgaaaagtcctaatagtaaagaaccttcataaacctggaggtgactatatggatggcccccaacctagcaacattcgaaggaaccggtatctttaaatctagacacaagggaggaatcgaacccccaaaggggttaagccacccatggctccaggctttccaacacaacaacaaaaaacatgtggggggggccgagacttacacagttgggcggcgcggaagaggcacagccagaacgggagggggtaaaaagcggggcgtcgacacagtggtggagagggcaaccgcggaaagaacgcgcgggaggggcatacggacagaagg

SEQ ID NO: 501406 - DNA, 444 bp, Homo sapiens
tctctaacggatccccgagaatggctgatagttagtgagttagaattaaagtgcagaaattatttaacatttatttgatgcctttacaaaatatagacagactacaagaaacagtaaacaagaataatttctgcacatagcagtatttccctgcaatataataatcctccctcagtacatttcctaattctcgagatgtcctatgttactggcgcggtacggcatgaagcaggataggtttaaacagggttacaccctttttttgtcccattgtctaggatttttgttgacggtcgtgaagttgtaacatagtattgaaacttatccataaatctagtggatgttgcaaaaaaaggacaagaagtttgtgtaataatagaacctatcccttgtgagtcacccttagtgtttggaagacattttgaagctccggatattcttgtt

SEQ ID NO: 501407 - DNA, 673 bp, Homo sapiens
attgtaatttccaatgttgggggagggacctagtgggaggtgattggattgtgggggtggaatttcccatgctgttctcgtgatagtgagtgagttctcacaagatctgatggtttgaaagtgtatgacacttcctccctcacactttctctcctgccaccacatgaagaaggtgcttgtttccccttcaccttccgccatgactgtaagtttcctgaggcctctcagccatgcttcatgttaagcccgtggaactgtgagtcaattaaacctcttatctttataaattacccagtctcaggtcgtactttacagcagtgtgagaacagattaatacaggttcatttctacggctcatggcagctctcatggctctactttgttcttactgcatgttccttagttcacctgtgcatccatcatccatcagccatctaccttatgtttgcctactgtgttcttaatattcttatgcttcgtgtttcctctgaatcatcatggagtccagaatagaatccagtgttgcgtgatgtcctttataggctacactatatgaggacactgggatcccttactgagatttcatctctattttaacacagtgttttcaactttgatttcgaatcaatgggtcatgtccaggtttggtacctgcgtttttggatgtgctggt

SEQ ID NO: 501408 - DNA, 486 bp, Homo sapiens
tggaaacagtctttgctgttttgcccaggctggattgtggtggcccaatcacggctcatggcttcctcaaatcacccgggcctaagcaattcctcccaccgtgtaggctgggacttacagcttcacagcacaccggtggcctaaatttttttttggtggagagggattctctatgtggcccaggcgggctcatcaggctccggggctcagagtggctcctccgtgcctcagtttccaaaggcacaggccatgttgtagctttgtccctggccattcattgcccaacaagaggttctatacctttataactgattgcgaacttatcataaatgggttatgtgggggggcaagttcttaaagcgggaaatggtaaatttcctcctgaaaggtttttccatgcagttaccatgaactaattactacaataaagggagggtctggggtgtcaaaaaaacaacaaaacacacaatacaaaacacaaggagg

SEQ ID NO: 501409 - DNA, 97 bp, Homo sapiens
aagtgatatttataaagttattgggtatggtgtcaagtttggtttggcctcatagtatgtcagcaaaaaattaaataccagtcctcctatttaacct

SEQ ID NO: 501410 - DNA, 786 bp, Homo sapiens
gcttgacttgacttgtatttgctgggcaacttacttggggactttcataggacaacagaaggtctgacacaggaacttgagaagacgtgacagcaatcccttcacctttgaatgtcatggagcctatcaaaagacaagaaaagtccattcgttctctcaaatgacagttacctgtaaaactagctcatgtgatgagaccacagtatcattgcaatgatagctgtatctgtcttttttttttttttttttttggaaactgactttactttacttcactttaagtaagtcttggcctcttgtccgcccagggttggattgcaagggtgtaactcccggctcaatgaaccctccgtttcccggggttcaaacaattctccggcgctcagcctccggagtacgctgggtggcccataaccaacacccagttaacttgggtatttaaggtaagaagacgggggtttcaccattgtgggccaggctgggtctgagaactccgagacctcgtagatccggccgcttgggccccgcaaagggcggggattacaagcttgagcccagcgccgggatggtatcttcaccatttaacccaagtcattttacccaagtaagtaatcgggggaaagccgtgagtctggtaccaccgggtcattgggggaccgggtgggaaacgggagccaagggacctaagtgcccttggcacgagcgagttccaataccatttcacgaagggtaatacctttctaaatctgaagtaaccaagagtgataatctcagggacagaagata

SEQ ID NO: 501411 - DNA, 123 bp, Homo sapiens
tacatttcaaccttgggatttttcccaattacttaaaatgtttaatgtcagttaaagatttttttaccctctttttgggaacatcaattttggactgttatgcagtaacccttttttataata

SEQ ID NO: 501412 - DNA, 157 bp, Homo sapiens
tgggggggggcccccccccccttaaagggtccctttccccgtcctgccaaaaaaccccggggggggggagggggcagcatgcaggggcccccctccccctttgggggggatgaaaaggggaaggggcccaatgaaaaaaaactgccttttccgtgga

SEQ ID NO: 501413 - DNA, 146 bp, Homo sapiens
cccccccccccccccaaaaaggggttttttttttttcccctttgggccccccggggcccccccccatcttttgggggccccccccccggaaaggccggggggggttggggggggccaaaaccccccccggggccccggggttggga

SEQ ID NO: 501414 - DNA, 199 bp, Homo sapiens
gccttcacctctggcccagggtatggcagaggtctcccaggtaggggtgtggctctctgggcaccgtctatattgctgtgtacgcagcggcaggttctttggcaggatggggcacagggtccggcacccattacaggtggggaaacaatgtcatcactctggtgccaacctagggattagaatcaaggtctccctggga

SEQ ID NO: 501415 - DNA, 863 bp, Homo sapiens
gaagcggccgtggggtggagttaacagcggtggtcccaagattggtgcgcggcgtttggaggacgtcgggccgcgcagaacatggtggaagtgggaccgccgagaacaaggagctgcggggacacaggagccataagtgggcccggcgtgacaaagggggcatcttggcgaccgaattggggagccgcgtcgccccggcagggaatatcgggatgaatggccccacaaagggccggttcccgctctctatgacccctcaggggcacttgttgcggaagaccatgccagaggttgtccaaagacccggcgtcaaagccgagtccaagggccccggcgctttgtgaaaatcacaagccttgggaggttcccagtctcccagcccgcctgttagcattgtcatcggcccacccgttgtcagggttatgtagggttgagcccctctgtgtcgctaaagtgagagtgtttcttcgtagggggagtgatctaattccgcaggaggagaggctagtacgtgcgggagagttgtaccaccacaggctcgggcgccattgggcatcatagccgcgtaagtctcccgcgaatatttggggggacgtatgccggcggatcaccttgaggtcaccagtggtccagacccgcctggcccaactctgttcgcaccccctttgtcttctttttgaagtagaatgtgaccaccgccatgtgtggtgtggcgcccgttttgccccccttttcatgggcgggtcgatggcccggagacgtcctgttgatacccccgtactgccgactgtctcctctgtagccccctgtcactcctacgtcactgcccccctgggtgaaaaaagaaacttttattcaccaca

SEQ ID NO: 501416 - DNA, 407 bp, Homo sapiens
  misc_feature (75)..(75): n is a, c, g, or t
  misc_feature (346)..(347): n is a, c, g, or t
  misc_feature (370)..(370): n is a, c, g, or t
gctcggtacccccagtagtttgtgatgggtgcatatgtgtctgtgtgtctgtgcacatgtgtggtgtgtacctgngtgtgctcgtgcatgtgtatcaggtgcgggtggtgtgtttgtgcttgggggtatgtactgagcgtgagtctgtatgcacgtgtgcctctgcacccacctgtgtctgtgtgttgagccctatcatgggctgtgcagctggcagtgagatgtaagtctggagcctgggggtgctgggctaacatcagccaggagggtgtcactggtgagggatgcgttgacagccaggggtccccatgagcccctggagcaggcccctcccagcctgggcctnncagagggcagctgcataccagangttgggaggcagccggtggtggggcaggaggagctgg

SEQ ID NO: 501417 - DNA, 361 bp, Homo sapiens
ggtagacatatacatttgtaaaaatctatcttaacttttaatcttttaaattacttttttttttttgatggagtcttgctctgtcgcaaggcgggagagcagtggcacgatctcggcttactgcaacttctgcctcctgggttcaagcgattctcctgcctcagcctcccgagtagctgggactacaggtgcccaccactgcgcccggctaatttttctatttttagtagagactgggttcaccatcttggtcaggctggtctcgaactcctgacattgtgatccacctgccttggcctcccaaagtgctgggattataggcgtcagacaccgcacctggccgtttttgttttaagaactg

SEQ ID NO: 501418 - DNA, 377 bp, Homo sapiens
ctctaaaggattcccttaggcatatcaagtgaaaaatctgtgtagaaaaaaatttcgtaagttatagggccaggtaattgtgagatattaaaacactcagattcatgtaaaattctgagatgcagccttgcatttcctcctccttggcgcgtcatgataaagcttaacatattaaaggctcattctcagagtccacagagaacgagcagaaaatgagcttgaatggattgggtagcaaaactataaaatttttgattctcagtgtagacaaaaacaactcttttatatctttcaaaacccattttatttcttctagtataaaacgtttttaattgagaaagaaattaggtttgtctccacccacctctaccatctgg

SEQ ID NO: 501419 - DNA, 456 bp, Homo sapiens
  misc_feature (49)..(49): n is a, c, g, or t
  misc_feature (74)..(74): n is a, c, g, or t
  misc_feature (76)..(77): n is a, c, g, or t
  misc_feature (80)..(80): n is a, c, g, or t
  misc_feature (82)..(82): n is a, c, g, or t
  misc_feature (86)..(86): n is a, c, g, or t
  misc_feature (98)..(98): n is a, c, g, or t
  misc_feature (108)..(108): n is a, c, g, or t
  misc_feature (128)..(128): n is a, c, g, or t
  misc_feature (134)..(134): n is a, c, g, or t
  misc_feature (142)..(142): n is a, c, g, or t
  misc_feature (194)..(194): n is a, c, g, or t
  misc_feature (227)..(228): n is a, c, g, or t
  misc_feature (249)..(249): n is a, c, g, or t
  misc_feature (266)..(268): n is a, c, g, or t
  misc_feature (279)..(279): n is a, c, g, or t
  misc_feature (287)..(287): n is a, c, g, or t
  misc_feature (383)..(385): n is a, c, g, or t
  misc_feature (437)..(437): n is a, c, g, or t
aaaacacctattttgattgatcagttcttttgtatgaatatccacctcntttaaatactctatttttatatatntnnggntntgangataaacatgantttatatttnactgtcttaaattatatttncataantgcaaatntcacttgatataaacaatacaaatctgcatcttacagatgataatttttttngaagaatgatacagaattaactttaaaaataanncttttctaatatacacttaantgcaaacatcatttttnnnttttcagtgantttttttntgacataaaacgttaccaatgtgtgcagcctctccatcatgttttaacatactgtatactctatagcagtattacagtcagtatttcatataattnnntttgacctaactgttaccatctgactgaggttactctggtatttatctcttngctgctgaaataataatag

SEQ ID NO: 501420 - DNA, 287 bp, Homo sapiens
gggtagaggatcgtctgagcccacgagtttgaggctgcagtgagccaagatcatgccactgtactccagcctgggcaacagagtgagaccccatctcaaataaataaatacataaatacataaataaaataacaacaacaaaaagtccataagccccacacccttctcccaggaatgagagaggactccttatagatacaatctcgggcatcgctaagccatgtgtcactgaaacccagaaggaacaaggggctcttgtgcaggcagcaaaaccctcagcaggctgc

SEQ ID NO: 501421 - DNA, 500 bp, Homo sapiens
gagatactcctgaaagttgtgtatgacagaatttagtgtgagggaggctactggactcctgacaaggaaaatacaaaatgagtactgtaactctcttaacacattcattggtgagtgctggcattacgatggggtcccatggaaaaggagagggtctgaggttattttgagaattaaaaagctgaaggggatataggagtccatcttctgtctcttgggttgagtggccgacctcatggtctgccccctggaaatggcctgggatttctgccttttatgggatgtaggagtccaggaaaaggtccaagttgactggacagttgggtgaaggtttccttaggaaagtggcattcgatgggacactagatgagatggtgccgtccccatctctccttcagtagcttccaaactagccttcttgacttcagtctctccccgtcttcacccacctccaaagggatccttttcacacttattttgtctttttttttcttcctttt

SEQ ID NO: 501422 - DNA, 238 bp, Homo sapiens
ccacatcggaaagatatctccttcatatgattcatcttcatctgcatggtatctttctgcactaactgtggacgctttctgaatctataactcgtggcactagaaatggccagatcccgtgctgattgctatcaccatagcaagtcttacacacttattgataccactactgtggctgacgttaactcgactcctgtagaaggaacagtagacttgttccagcaaactcagcctggtc

SEQ ID NO: 501423 - DNA, 684 bp, Homo sapiens
  misc_feature (59)..(59): n is a, c, g, or t
  misc_feature (207)..(207): n is a, c, g, or t
tctagcatgtgcccagctgacgcacatggctctgatagcgagacaggtccgccgtcccntgcggtccggcgcgggtgcctcgtgcatctccacactaacgaggatgcacgtgatatcgtcgagcaccgtccctgaggcgccggtcagtcataataggcggccatgcgtgggctattctcctcgtacacagagtgttacgctggagcnccaggccgggagcacagcaatgagactgcgcgaagtcagagttcctagggctcccaaagcgatagcgggaacctggctgtagagagaggtgtcgtcactcgctggaccatcaaccaaggtcgtttgaagattgatagctaggggagttaatccgagttcaaacgaatcccagttcttccagagacatagggggaagggagaagaagcattcgcagtgtatgggatcgcggctcacacaaggttaaccaccattcgatgtgcgattggccgttgtgccgactgtgcgcactggagcgtcacaacggacgaggttggctaggttaagccccccgacaggggcgaggatccataactttggcaccatttttccgtgtcttacgttgggacaattgaacccccttatttggagaccaagtctctttaatccaagttggaaatgacaaacctacggaaagatcaatttcctggccattactg

SEQ ID NO: 501424 - DNA, 1263 bp, Homo sapiens
  misc_feature (514)..(514): n is a, c, g, or t
  misc_feature (527)..(527): n is a, c, g, or t
cacggtggctcacacctgtaatcccagcactttgggaggccaaggcgggtggatcacctgaggttaggagctcaagaccatcctggccaacatggggaaatcccaactctactaaaaatacaaaaactagctgggcatggtggtgtgtgcctgtaatcccagctactcgcggggctgaggcaggagaatcgcttgaacccgggaggtggaggttgcagtgagtcgagatcaccactgacagttgcagaacattcaggatgttgccagtttgggcccaccaataaagttgctacaaacattcatgtacaggtttttgttggaacataagttttcatcactctcagataaatacacaagagtgcaattgctgggtcgtatggtaattgcatgtttaggttcataggaaactgccacactgttttttttccagagtggctgtacaattttgtgtatcctatcagcaatattatgagtgatccagtttcctcacatcctcaccagcacttgatgttgntactttcttattntagtcattctgataggtgtgagtaataaactaatgggattttaattacatctctctaatgctaatgatgttgacgtctttcatggacttattgccatccgatatctctttggtaaaggttcttctggctttggcattccctaatgaatgttaattttgcaggagggtttaaagtaattataattctgacacggggggtttggtggttggtctttggccggggaattgttgggaaatttttctcaggcggaagttggcttccatcctttttaaagacttttcccgttcaaatgggccaatttacaatttcttttaggcaaacctttccgccacgcttaaacccgatgttatcccggaccatacatcatcccttctttttctgacatctcctcaaggtgtataaatcctcacccctttagatacactctcgcaccgcgattactacgtctacttctccatgtatatctaatcccccgtcctcgtgcaactccctactctcttactctcgctcctctcgaccatacgctcctaatcatgttctcatgtatcacctacgtcgcctgtcgcaacgttcactcacttagagctcatatctccttacgtatcttacgtcaatactcacacccccactatgtcctggtacactagaatctattctatcttctcgcgccacccattcatctacccaatctgacgctccaccactcgtagctccagcactttatccctcccccgcc

SEQ ID NO: 501425 - DNA, 638 bp, Homo sapiens
  misc_feature (9)..(9): n is a, c, g, or t
  misc_feature (44)..(44): n is a, c, g, or t
  misc_feature (49)..(49): n is a, c, g, or t
  misc_feature (59)..(60): n is a, c, g, or t
  misc_feature (64)..(64): n is a, c, g, or t
  misc_feature (94)..(94): n is a, c, g, or t
  misc_feature (111)..(111): n is a, c, g, or t
  misc_feature (123)..(123): n is a, c, g, or t
  misc_feature (137)..(137): n is a, c, g, or t
  misc_feature (143)..(143): n is a, c, g, or t
  misc_feature (246)..(246): n is a, c, g, or t
  misc_feature (375)..(375): n is a, c, g, or t
  misc_feature (409)..(409): n is a, c, g, or t
  misc_feature (446)..(446): n is a, c, g, or t
  misc_feature (451)..(452): n is a, c, g, or t
  misc_feature (456)..(456): n is a, c, g, or t
  misc_feature (459)..(459): n is a, c, g, or t
  misc_feature (465)..(465): n is a, c, g, or t
  misc_feature (513)..(513): n is a, c, g, or t
  misc_feature (558)..(558): n is a, c, g, or t
  misc_feature (568)..(568): n is a, c, g, or t
  misc_feature (621)..(621): n is a, c, g, or t
cctcacccncttaagatggggagcatcttccaatcaccgtcccnatcgngggcattgtnntggnctggctgtctagcagttgtggtcatcgganctgtggtcgctgctgtnatgtgtagaagnaagagctcaggtgnaaaagnagggagctactctcaggctgcgtgcagcgacagtgcccagggctttgatgtgtctctcacagcttgaaaagcctgagacagctgtcttgtgagggactgagangcaggattttttcacgcctcccctttgtgacttcaagagcctttggcatttctttttgcaaaggcacctgaatgtgtttgggtccctgttagcctaatgtgaggaggtggagagacagcccaaccttgngtccactgtgacccctgttcccatggtgacctgngtttcctccccagtcattttttttgttccaaaaaggnggggnnggangtntccatntctgtttcaactttatgggcactgagcggcaactttttacttccctgntgaaaataagaatttgaaaatcaatttgttttttcaaatatttgntatgagaggntgatggattaattaaataagtcaattcctggaatttgagagagcaaataaagncctgagacccttccaga

SEQ ID NO: 501426 - DNA, 354 bp, Homo sapiens
  misc_feature (43)..(43): n is a, c, g, or t
  misc_feature (167)..(167): n is a, c, g, or t
  misc_feature (345)..(345): n is a, c, g, or t
tcaaggtactcatacctctccatggaactatataatatcacgngcatgtgctatatacaataatcacttacgagcatagaggtactagctgaatcaccaaagtatacatattacaaccacaggaagtttaaaaaagtataaacagccaagagatttatgctgctatncttcagacatatttcaaccatgaggagacaggcagaatatcaaatacactaacagccatcactggactttaagtgctcaagataatcattgcaatggtatgggtctcaccagggcaaactcattcccatttctctttaaaattgtgacagagtaaaactagaccagatgcgacttggntgatcacca

SEQ ID NO: 501427 - DNA, 813 bp, Homo sapiens
cagggcaggtgcctcagccacctgggaaagaacgccaagcagaggtccccacagccaccctgcagctcggctgcacccaatggagttcagtgcccctggtgccaggtgtgatgatgctgtgtgtagagactgcagtgaagagggaggctgctcctggccctcagtgctggtgtgtgaatgtggtgctctgtggtgtgaatggtggtgtagagtgcaccctcatgggctgggtgtgtgctgtgggcctgttgtgacccagtggtcctgaagtggagtgggtttcgtgtcatgggacaccatgcttggtgcaaaatgttgtggagatgattcattggtgtgtccagtgtggtgttgtcctgccgcctgcatggggtgctagaatgtggctgggcaaaggccaactgtatacctgtggggccttgagggagggggaaccctggctgggggccccacctccgccctcatttcatggccccctcctggcttcccagatggtggccgataagcggagctgcttaggatccgatggaaggggccagtgcatgaaccctgggggaatgagcccagggtgcctcaactgcatgggcccgttctgtcctagtggggtggggcccctgcattccaacgtggggagcctcttcttgtcctgtggggttggtggccctgcttaccaaacggagtggctcttctggtctaggggtgaccggcgtacgtggtatgtcgtgtggcccttcccgggatcggctctggcttcacgctctgcctcctattctacgcggaccctcgcccgggtatgtcagatctatcttgtaa

SEQ ID NO: 501428 - DNA, 1409 bp, Homo sapiens
  misc_feature (315)..(315): n is a, c, g, or t
ctgctgtttgttcctgctctcgttatgttatactcggcgagtgatgtggtctcctagtgctgtcgctggtaggtgttggttctcccacgaaacaccacgtggtgttgtttctctgctcactcccttctgtgtctctctagagtcctggacgcagttactctcttctttctgcggaagtgtttcaatttcttcgatgggcctgcatggtattgtttctcccccctctccaggatgaacttctccggagtaacccccgtgtggggctgtgcgctgaatgaatagttttagtccttccttgcctcttgtgaccccccncattaggtggtctgtccctaacactgttgataaggatgccccgccaaaggttccctttctcggtctgggtggtcacttggttctttttcacaagagggtgttggctctcacagggactcctgtgtcgtagtgccgcgattgtgcgccgcgaaaattatatgtgccccccgggttggcctttatacacggcctcccctaagccttggcttccacctttaaggagcccccccccccattttttaagttgaaccttttaatgtgaggtactctcagctttgccgtttccaaacaaggggtgttcccacacagcaagttcacataggtgccaaaacaaccacagccggttttgttttgtctgtaacacacgatgtcttagacacaccgcaggacacaatggggggtccgccaacagttctccttgccagagacattgctaagacccgtcttggcgcagtgtttacgttctcctgtcttggtctcggcacacccgtgttctcccaccccagttataagaattattgcttgccagggagttctcgccaaatcctttcttagcgaacaaattgtgtaatagccacacagcgccaccaagttgaccaatagccaacacagcgctgcctgtttcaatgggaccaagagtccagagaacacctttgactgcgttcccaatgttttggcaatcttgcccccctctcaaagaggccaaagcacaaatgtttgggtgaacggctggtttctcctctttaattcaaagccacatgcacccataacttcttgctggtaaaatcacctggcaatgtttgttggagacttgataaattcacgaaactttttcaaaatgctcgagtctccacgagtcacactccgtttctaaaggttgagatgaaagctgtagctgtactacaagcccacccaaggctaaagagggctgcccacgagaagcaggtaacacgtgccacccggggttccacacctgatttaaaattgaatacgggacccatgaaaagaaaacttgggcttcaccgaagaaaaatattttaacatcgataaacttaaatattatggaaaaaaaacattgccaaaatataaaatta

SEQ ID NO: 501429 - DNA, 304 bp, Homo sapiens
tctgcgagattttattggcccatgacatccagtgacagtgtgggagcaggctactctccagtgacatgtttttggaggcatatggagaagggggcccaggcgaggtggctcacacctgtaatcccagcactttgggaacctgaggcgggtggatcatgaggtcaggagatagagaccatcctggctaacatggtgaaaccccgtctctactaaaaatacaaaaaattagctgggcgtggtggaaggtgcctgtattcccagctactcgggaggctgaggcaggagaatcgcttgaacccgggag

SEQ ID NO: 501430 - DNA, 382 bp, Homo sapiens
gcacggttctgtcgttggggtgacgagggtactccagcgaactgtgtcaagatgtgcgtcactaagtggacatatgtgggtggaagcagaggtccctgtgaggcagagaccttggcagaggtacggctgcagggagaagcacagagggcttaactgccaatccccccaactgcagttcaatgtgtcatagctgttgcttatctcagagaaaggagcagggaagacaggagttggggtcccagggctgtggagctggagcagccaactctccctttgtaaacacacaccaggcacactcagacacagagatgcccctagagctccagtcacacagatttgcacacacacccagccagggtcagagacacacagaggcacaccc

SEQ ID NO: 501431 - DNA, 113 bp, Homo sapiens
  misc_feature (7)..(7): n is a, c, g, or t
  misc_feature (47)..(47): n is a, c, g, or t
atcgtgncatctccctgctgattttagctactaaggcataggcaagntacttaacctctggctaccctgagctaaaactaaacccttagaagagctggctgcactctagctta

SEQ ID NO: 501432 - DNA, 194 bp, Homo sapiens
attacatgaaaaggttctaaaatgatatatttagatgcaataattaaccatatgctagaatgcccacctctaagccaattgggattctagagctgctctctttctctcctacatctaccatcttctcttttgcgctctgtcttcacctagagaactgcatgtctgagggccaagattccacaagaaacacatct

SEQ ID NO: 501433 - DNA, 341 bp, Homo sapiens
tcgtcagctcggcccgaattcctaattacgtgtaattccatctacaagatgacactcttagggagtgaacaaagaaagcaattgatgctttattcttattcttgcagtgaattttgcttattaccttcttcaaagtacaattgagtgaatagtgattattctcacataggcataaatgcatacatgtggaagaagctaaaaatgaatggcatgaaaatagctttcgacttccaaaatcattttctcaatctgctaaatgaggccagatttgtgcagtgtatgtcaggcataaaacagaatagactcttccagctttgttactaactctggatccagtaatg

SEQ ID NO: 501434 - DNA, 177 bp, Homo sapiens
gcctaagtgggctaggttcttgctctctgactgcgtgctgctagagaatcgagctcctgagctgctccaatgaacctgggctctgtcactggagcctccagaattgcctgtgagcagagcagaaggcaccaccagaccatcaacaatgctccccaatgtttcccccgtaactgcctg

SEQ ID NO: 501435 - DNA, 261 bp, Homo sapiens
gaggtgatctagaggatcccaggtggaaagcgagtcaggcttagcggctttatagctaagggcagtcctgctgatacacccgggcagcgtgtgcacaaacagcagagtcagcctctcccgacgggtgctcgctcctcttccttcctaattcatgtccttggtggcattttttccctaatagggcacttgcgcctgcataaaaataccggttcaggcagatgtcctttctcctccatgattttcttttttttgtcttttttc

SEQ ID NO: 501436 - DNA, 817 bp, Homo sapiens
  misc_feature (1)..(4): n is a, c, g, or t
  misc_feature (20)..(20): n is a, c, g, or t
  misc_feature (22)..(22): n is a, c, g, or t
  misc_feature (51)..(53): n is a, c, g, or t
nnnnaaggggaaaaaaaagngngaaagaaaagaaaggaaagaaaaaaaaannntttagcgcaacatggagccctgtactatcaaaaacggctttaggccgttgatctgctcaaacaactatatgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatgtaccctttggatttcaaacagtttcattggatgtaaacaaacttagttccttttactcactgaaactaatctagcggctctacgtagacaaatctctgaatctctctacagagttcatcacctctaccaagagaccgtatgcaaaggaattggaaactgtttgactccaaacataaatcgcaacaaacgaatggacagatcaacaactcaattaaggatctcaccaatggccactttgacaacattttacctgacatctctgtgaaccaccagaccaaaatccttgtggataatgctgcctactttgttagcaaccgcacgaccatattttctgaatcaaaaaaaagaaccgatctcatctcccctaacgggtggagccctgtcgacgctttccatttaaagaaggttaattcatgatcctttatcaatgacttcctgaactctgtattttagctgcttcaaattgtttagttttactccaaagtcgttataccaggttccacatagtgaagggatccgaatgtaaaaacatttcaatagttgcctacatccctcccc

SEQ ID NO: 501437 - DNA, 403 bp, Homo sapiens
aaaaaagtaaaagggcatgttaatctacagtgaagagagaatggggctgcctaggtgccctttaatcatttacaacattttataaaactatgtgggtaagagagaaggcaaatctaatcagagaaacagtggttacagttccctgttacgtgactgaggtcctataatcacattcctttaaggctcaaaatgttttgaagttccaacagcttagattttgaattacttattttcacacaatcagttctccagcagacagtagctgagtatcctctaattcagttcaattctgacactgcctggagacagtgtgagatctcacaggttgagggatcccacttctgatgccatttgcaaaccccaggttagtttgcctgtgcttctgactgacccggctataaac

SEQ ID NO: 501438 - DNA, 171 bp, Homo sapiens
tctataggattccctcagctcatttagggcatgcagtagctgccgcagaataacgccaaactcccgcggcttataggaaagatgtccattctcccccgaaagctggttgattttgcgatccatctggctcttctctgtcttcagttcctgacactgcttcagcctttcatg

SEQ ID NO: 501439 - DNA, 343 bp, Homo sapiens
tcttcaaggtatgagggtttcccactacaccagatacataggcagcagctgggtgtcctcaattcaattctgtcactgatcttcctggatatagggtcagatcctataggttgggtgctcagttcccaagaccgccaccctccctttagaccagtcacaactctggctctctagaacttctgaccaaccagcttcaagttggggtttccacaatcccccctttgggtttgatcaatttgctagaatggctcacaaaactcaaggaaacatgtacttccatttactggtttgttataaaggatattacagacgctatagatgaagacatatactggggaaggag

SEQ ID NO: 501440 - DNA, 556 bp, Homo sapiens
tagatttagtggcaaagactatatgcatcagagggtaggaactaaatatagactacaattcaagggccttctacctctagtgcaattggtagggacccagtgacatggggcatgtcaggatatatcttctacggtgaaggatacgtcacttgcatctatgctgctcttaaataccaagaaagaggcacaatacttagtgggcctctttgggtattggaggcaacattttccaatttcattatgttacaccatgcctgtttaccaattgactcaaaaagctgctagttttgagtagggcccagaacaagaaaagagtctgcaacaggtcccaggctgcttgtgcaagctgctctgccacttgggtcatatgatccagtggtgtttcagtggcagtggcagatagggatgctgtttgaagcttctggcaggtcccctataggtgaatcttggtttaggattatagaggcaagccgtgccattaccaacaaataactagtctctttattgagaaccagctcttgggctgctactgggccttagtagagactgatcttaa

SEQ ID NO: 501441 - DNA, 153 bp, Homo sapiens
gtgaagtctagagtaagaacagactgggccaaggtatcctgagaggatgtgaatgcagtttaatcatagtgccatttggtttttggtccaaaatatttgagttgttggaatgaacaatttttttaatttgaaaataaaaagtttaaaacctta

SEQ ID NO: 501442 - DNA, 447 bp, Homo sapiens
tgtcaccagggctgaaggtgcagtggacgatcttgtgctcactggaacttccgcctcccaggttcagtgattctcctgtcacagcctccagagtagctgggactacaggtgcaccaccaccacatcctgctaattattgtatttttagtagagatggggttcaccatgttggccaggatggtctcgaactcccgacctcgtgatcctcccacctcggcctcccaaagttctgggattacaggcatgagccactgcatgtggcctagcatatctttagtttgcaattctctggctaccagtaaatttgaatgatttgctcttctatttatgttcttcgtacatttatctatgaagtcttttaaagataacagtttctaaacactctccatatattatgtttactgatccttttcatatgcattataaatatattttttaatgatttta

SEQ ID NO: 501443 - DNA, 624 bp, Homo sapiens
gtcactctttctaatgcattcaatcaaatgagtgtataggtccatggggagactgaaggagtgatacagaaaatgagagaaagagagtaaaaaatgacagcaatgtaacacttgatgaatgtaggcaagaagatttgttgcattattcttttaatatttctatatattagagaatccacagaatgaaaatgagaagttatcaaaaactattaaaattatcagtaattgccgggcacggtggctcacgcctataatcctagcactttgggaggccagcgcaggaggattgcctgatttcaggagttagagaacagcctgggcaacacagtgaaacccgtctctactaaaatacaaaaaattagctgggcatggcagcatgcgccagcagtcccagctactctggaggctgaggcaggagaactgcttgaacccgggaggtggaggttgcagtgagccgagttcgtgccactgcactccaccctgggtgacagaacgagactctgtctcaaaaaaaaaatgatcagtaatggagaaatttatgcaattaatgatatatttattaagagatgatttattaataagtagtgggatattcatattatgatcatggacctggaaatctca

SEQ ID NO: 501444 - DNA, 108 bp, Homo sapiens
acacactcatgcagacccttcatcacctgctggtcatcaaaccctctccagttaaagcccattaatcatgacaggatcctcatctgcttcacaatagggtttcgactg

SEQ ID NO: 501445 - DNA, 940 bp, Homo sapiens
  misc_feature (918)..(918): n is a, c, g, or t
tgcgtcttgtgcttgcctggtgtcggtggttagttactgcgacttgtgtagggactgctgcataggaatgatgctcgtatcacggaagagtgtctactatactctgggcaccctgtcccccatagcttcatgacgccacaggctgttatgccagatgggtccagttctagagatatcagacctgtctgactacataggaacatatgtagtgtgctttctttttacccttcttgacttcactctttgtgtgccccacggggactcattgctttcagtgactagggcagaaagacatttaggaatacatcaacatgccaagtgatgggctgcttcgtgtggacttcgtcacattctgtcatctagtcatggcgtcaattacacctgaagaaacaaggaggactgcggacccagtgaacattccttcggtatcagagccctgaagcgcacctattgctcagtgattcatggggtcttaaaggctgatgaaggcatctcgtacaggggccttttaatcattgatagataagggtattctatcgagagatcactgttagaatgaccatccactgttggccggttctgtggatgagacttttgagactagatacaggccttccagttcactgacagaacatggggacgtgtagacccagatggctggtaagcctggcagtgataccatcatgcctgatgtccataacgagcaaaagaatatttctccaagctagaagatggagcgctggagctgtttaaagttgccaggcatgcggttgggcattccattgagaaccaagcacctacgtctggaatataagtcaccacattagggtaaatacgcatagacttcaggattcaagccgaagtagtggtgtccttacaaggcagggccttcctaacaggaggtggtagaaggcccancatatcttccgttggaaggcat

SEQ ID NO: 501446 - DNA, 427 bp, Homo sapiens
actctgaagctctacacaactttacacctgattgaacgccaaacctctatggatatataaagggaagcgtgtggattaattttacagttacagtgcacaaccagatgcaaaaaaattaaccagctcttcattcaaccaaatcctttactcaccatgcttcctcctgccattcatttttatctccttccccttgcatgcatcctaatgaaaagctgtttggcttttatgatgccccagaaatcctttattcacatgtggttaaacctgttccagcacaccccatcatcaacagtactttgaatcaacccacaaatggaggcacgcatttcactaacactggactggattggaacactcgggttcaagtgggttgccggcctccgttccacctacatctctgatggccagtccaccacctttgccctct

SEQ ID NO: 501447 - DNA, 324 bp, Homo sapiens
ttttttattttggttggtcatgcttcttctgaacaggtctgtggggggaaaagggaaacagagatgccccttggggccatgattaaacacagtttgcagtgcacaggcaaaggctcgggttcagtgcagaaagcaaagtcaccgccagtgctttggaatgggaatcacaaaaggtgacctgtggctgcttgagccattgtagaacttctgaccccagtgtggaacagagattaccacaggcagtctagaaatttcgtgggcaggggcaggttgggcatttacagacaaagttgattgaccaattcccagaacaaaatgttcctc

SEQ ID NO: 501448 - DNA, 615 bp, Homo sapiens
  misc_feature (45)..(45): n is a, c, g, or t
  misc_feature (74)..(74): n is a, c, g, or t
  misc_feature (92)..(92): n is a, c, g, or t
  misc_feature (107)..(107): n is a, c, g, or t
  misc_feature (201)..(201): n is a, c, g, or t
  misc_feature (225)..(225): n is a, c, g, or t
  misc_feature (290)..(290): n is a, c, g, or t
  misc_feature (293)..(293): n is a, c, g, or t
  misc_feature (315)..(315): n is a, c, g, or t
  misc_feature (470)..(470): n is a, c, g, or t
  misc_feature (481)..(481): n is a, c, g, or t
  misc_feature (487)..(487): n is a, c, g, or t
  misc_feature (500)..(500): n is a, c, g, or t
  misc_feature (517)..(517): n is a, c, g, or t
  misc_feature (531)..(531): n is a, c, g, or t
  misc_feature (545)..(545): n is a, c, g, or t
  misc_feature (613)..(613): n is a, c, g, or t
cgcggctctcccacctgtcaccctggcccttctcttgcttggatngtgtcttcctctcctcagccgagaatganttcgtccaccggatccangaggaactggaccgntttctgctgcagaagcagctgtcaaaggttcttcttttccccccactctccagtcgcctccggtacctgatccatagaacagcagagaattttnatctcttgagcagcttctccgttngggagggctggaagaggaggacggtcatctgtcaccaggacatcagggtacccagttcggatggnctntctggcccctgccgcgctcctncctcctgccccatcaggtaccacggtcctcggcccatctccaaccaaggagcagctgcggttccccgagtgtgcccgggtctggccgtgtggtatcgtggacgcatagcctgaccagcctttgtatgtgccctctgggtgtctgtcgcaagcagnaagaatggggngctgantctctaccctcgngtgctcaaagagagatngccccagcgtgtgnaggggaccacaganagaggcctgagagtatgttttggtgtctgtgagactcccaatctctgtactcaagggtactcccctgntg

SEQ ID NO: 501449 - DNA, 457 bp, Homo sapiens
acagtagtcctaggcctttgcattcacttaccactcactcactcacccaaacaacttccaatcctttaaggtcccattcatggtaggtgtcctacacaggtataccattttttatcttttatattatatttttactgtaccttttctatgtttaaatacacaaatacttaccgttgtgttataactgcctacagtatttagtacagtaacatgctgtacaggtttgtagcctagaagcaacagactatcccataaagcctaggtatgtagtaggctgtaccacgtaggtttgtgtaagtacactttatgatgttggcacgatgatgaaatcgcctaaagatgtattctcagaatgtatacccattgttaagcaatgcatgactatagttaaaagcaatttctaactgttctgaccgaattatgaaaagagtggaatgaatactatcagctctcctgc

SEQ ID NO: 501450 - DNA, 174 bp, Homo sapiens
agatctagaggatctttacactgggttctgagttcagaagatattaatgctctgtaaatgggagctgataggtaaagcatgcgaaattgtgacaccaaatataaggacaagatcaggatgacagagttaggaagagtttgaggaatgggacatctaaaatctaaatagctgatt

SEQ ID NO: 501451 - DNA, 1188 bp, Homo sapiens
  misc_feature (1)..(1): n is a, c, g, or t
  misc_feature (15)..(15): n is a, c, g, or t
natatggtttgaatnagtgtaacagacatccaggagcaagacagtgggtcagattcagactaaaggagaaccactgttaagtctctactaggggtgacaccgaatgctagttgatacaaggcatatacatggtagaacgtctctctacactcatgatgcgtgacctcgatcatacagatgtggctactactacttcacacactaggactacttcttggacctcgaagcattgtgagtactgaaagttgaccgatgtatcatcatgaagagtcactcgtctgatgcgataattcaattgacatcgctgcagtaacgaaaactatgcgacgatgtaaaagtcaagaatgagtgtacataggcacaggagcattccttgctagggatgagtggtgcacctaggcatgatccatcgcgtctttacgtcatgaaatgaaaaggcgaatcattctggccgaagggcccaggttaatcacctgtctggatccatgatgcagggtcttcgggtgctactggaagctcgtcgattccagggcatgtgctgttgcttgggctgggtgggaagttctatggggatgatgccaggaccatctaactgttcaatctcccatgattgtcaaggtggtgaatcggaggaactactacgcagagatgatccttgtatacaacaaatctactggaatgtcatggacagtagcgagtatcaccaatgaatcaaggagcatgggtagtacatcgtatgtgacaactgagtatcacacaacgctgaggtggcacaattaacagtgatgtatcggggagacatcagagatgcgatggcgacccagtaatctcgctgtggactcggtgggtccgattcggaattcatgtgcccctctcagagtatcgtcgcattgcaggtcacgtgtacgattggagtggcgacgcgtccagtgcacgcgcgatgcttctaaagggctcggacgtatgcgttacattgggcggccagcgtcttgggggaattcaccctgccctggaaagttggccacgtcggcccccaagtgggaaaacggcaaaaaaagtcttagcgtgtattgtgttcaggctgtgcaccccgggtaacacatgaacggcgcgggggagaaacacaacgggcgccaacggggcaggaccacaggaaaacgcacggtgagaaaaggtagttgtcaataa

SEQ ID NO: 501452 - DNA, 170 bp, Homo sapiens
ggcgcagtctgtcttcccatgagcgcagagtcgagtgttagagtgcatgtgctccagagcggggagatggctgggctggagttgggggcctggcggcttggtccttggttacttggttgcctgtgcagcgctctcctctggggggctgcagctcatcttgttgggagctt

SEQ ID NO: 501453 - DNA, 158 bp, Homo sapiens
actagtccacggttggctgccagtgttaagacgcccttcatcctcacggtgaccttgtgtggtagtactttattatcctctttggtggaagtgacaagctgaggcctagaaaagtcagggcacttgtccacggtgacactagccaaccgtggactagt

SEQ ID NO: 501454 - DNA, 219 bp, Homo sapiens
gtaaatactttaggtaaatatgttttgtttgtgttgtttttgagacagagtcctgctctgtcgcccagcctggagtgcagtggcacgatctcagctcactggaacctccgcctcccaggttcaagcgattctcccccctcaacctcccaagtagctgggtgcgtgccaccatgcccagctaacttttgcactttcagtatagagaagtgcgcctgggtg

SEQ ID NO: 501455 - DNA, 263 bp, Homo sapiens
  misc_feature (19)..(19): n is a, c, g, or t
  misc_feature (224)..(224): n is a, c, g, or t
  misc_feature (230)..(230): n is a, c, g, or t
gtgactctgaggatcccgnatatgctgtctcataagacttttttcttaaaaggaaattccaatttggtttaaaaaagggaaccaggtaggtccacttagagagatcagatataatatacagcctatgcagccacatgagaaatagtttttgctgctttgttattacacaggtagttgcttccttcagctaaagcctggagtattgtatttcttttatgcatatngggttnggttctattacttggcaggagattgtactcccc

SEQ ID NO: 501456 - DNA, 1392 bp, Homo sapiens
  misc_feature (516)..(516): n is a, c, g, or t
  misc_feature (1392)..(1392): n is a, c, g, or t
gagagagtggggacggtccggggttcggagtcggggagtgtgcgtggtgctcaggcgagtaaggaagagaattaaaatatgggtgatgttgatgaaatggcgaagaagatttttattatgaagtgttcctctggtgcctgacctgttgaaacagggaggctagcacaaggactgggcctagatctgccatggttctctttgggcggaagacaggtcaggtcccctggatactcttgacacagtacgcaataatgaagcaaaggcagtgatctggggagaggatacactggatggaggtatttggaggaatccgcaagaagtacgatccctggaatcgaagaatgatcttggtcggcatgaagaagaaggaagaagagggcagacgttaagtagcgttatctgaaaaaagctgctaatgagtattaattgggcggtgccttatttattagaagacagaaatgtctcatgacttttttgatgtgtgcatcctttaatagatctcatatcaccagagancgagatcatgaatgacttgaccgagatatttggtcgggcagatctgattttaaacttagaactggcttgtgggtaaatgaatatgtccagggggaatttatagtaagtccttccggacaaggttcctggtggcccttttaggttgtttgacccgggggaaggcaccgcccacaaggggggggggtacaacggggtgaggctcaagaacacggattggagcaacagaggtgacgacatccactttgtgttctatgtttttgtctttttttgttttttttttttttctctgtgtttataccgagcaccacaaataaacaccaacataacaaaaacaaaaggagcaggagagcagagagagggcgaggaaagaggatgcaaacagagaagagagaggagaagacgagaggggagaacaggacgggtagaccgagcaagcactagagaaaagagtagaaccaggcgagacgagccaggagaagagaagagcgagagaagagagacggagagaagcaagaaagcaagaggggaagaaaagaacgagagaagaagaagagaagaacaagcagaagaagcagaggagaagggagcaaggagatagagcggagacgcaaagagaaggaaggaagagagacaaggagaaaggaaagaaagaaaaaagagaagtaaaacagcgcggggagaagacacagagagcagagacaacaccaggacgaaggcagcgcggccaggaagaagacgagagaaagtcgcacaagagaagagacgaagacggagagagcaagagataacaaagcagcaagcagaacacgagagcagagggagcaacgagaggaagcgaacgagtccagggcgagagaggaagacgcgaaggacagn

SEQ ID NO: 501457 - DNA, 950 bp, Homo sapiens
gtccccctgtgggactgtccgcggacacgtgtgtggctgccgtacgcgatttcggcggcgttcgtggccggtttttgccgttgtcgcctccgtttctccggttgtggcaccattcccttgggccgacggccccccgccgttcctgccttgtctgtttcgccggtagcacacgtttggcacagggacgcacgtgctatcgccttttgggggggcccccctggcgcccaccatttttggggagcttttctgccctcgctccaccgttgccaaccactgcccccgggtgtgcggcttaaggggaagcccaaagtcccggctggttttcactgacacacaggggtgtctaatttcatggacctccccctgctgcacccgtccgtccccccgctggcccgctccaaagggtggttgttcaccacgattctccgagtgccatatctccggagatttaaaaaatgggggcacacacaccacggcggattttggtaagctgtgcctcctcgcaatgttgttataacctcaggccgttgtgttcctaaaaaatcggcgccccgtctccgccgcgtgtagtcccaagggagggacccctcgtcgccgccttctggctgcatcttatattgggatgcagccctgccggccacctttgtgtcctccttcagaagatcttcttgatccttcttaagcgacgtgttttccctgttccaaaacaaatatacaaaggggtgtctcttttgtcgctttctctgaaagatgacgctgcctcgtttcttgtttgcagccctaaggggtcactttacatctaaggggggaggctaatcagccgtcggaacaccaagctggggggtgttcgcaaacagcggggccccactctccctggtgggcaaaaccacatgatctgcggcccgccaaggggccaaaaaacccaaattcttttaaaaggaaacataaca

SEQ ID NO: 501458 - DNA, 105 bp, Homo sapiens
ggtaagtcttacaaaccaaggtgcaaagaaaaacggcctgccattcaagaaacgaataccaagagaaaggtgctctgcagaataaaaaaaaactaaaccccaaaa

SEQ ID NO: 501459 - DNA, 223 bp, Homo sapiens
gcttatgatgctacgtagtctccactttctcaatgcttaggagacagatcactcctggaggctggggatggtaggattgctggggatttgttttttttataaacagggttcttactcggtggcccaggctaaagtgcacgggggcaatcacagctcacggcagcctcaacctccggggttcaagcaatcctcctacctcagcctccggggtagctagcatcag

SEQ ID NO: 501460 - DNA, 284 bp, Homo sapiens
ttaatattaaaacagtggcgcgtcgtcgtaaccggccacagtggattcgtttgccaaaggaagtttactacgaagctaacgccatcacttatttgcaagatttgccatcagttaagcgtgccttcatcgtggccgatccaggtatggtacaattcggcttcgttggtaaggttttgagtcaattagaattgcgtcaagaacaagttgaaacatcaatctatggctcagtacaaccagacccaacattgtcacaagcggttgaattgcacgtcaatggctgcttc

SEQ ID NO: 501461 - DNA, 359 bp, Homo sapiens
  misc_feature (40)..(40): n is a, c, g, or t
  misc_feature (72)..(72): n is a, c, g, or t
  misc_feature (236)..(236): n is a, c, g, or t
  misc_feature (297)..(297): n is a, c, g, or t
  misc_feature (323)..(323): n is a, c, g, or t
  misc_feature (358)..(358): n is a, c, g, or t
cttgatggctgtttctccacttgagccttggccttctccntgcccaatcctccgtgctgatccagcccacgnttcaaattccccttccacgcagcagcctcccaaatctgtcagcaggctgacccgtcgcctgagtcacagtccaattatttcaagcatctcatatgaggtggccccgaacacctgaaacccgagccgacccctctggtgtctcctcctcctcccatcaacttttnttcctgtcttcctgggtctttgcattcccagcagcctgtggatctcataccgaataaccgnccccaggttttctgcagccaatcagntatcggaatttggtccaggaaatccctggttctgna

SEQ ID NO: 501462 - DNA, 264 bp, Homo sapiens
gcttgaagctgggatggtaattggctcttggtaataggatccttaagaacaggtaaattcttgcataaaagaatttgatgcaactgctgttgcccacggaggtggctccccctgccattattcccgcagagctttcttccattgtcattacagagagtcaggcgtgtgtccaggaaggagacgggatcctgccgtaatgactttgtcttcaccatcttttctcagctgcttaaattgctgtcagggcagcgtaggaatcttaaa

SEQ ID NO: 501463 - DNA, 145 bp, Homo sapiens
ggccagttggcagaggttcattcacgtaaagtcccgagcatgggtgctgataggacagccatccttcttgaagtagcccgttaagtcattttccaaaatacagcgctgggcataaccaggggaaacccatctgtagttgtctgta

SEQ ID NO: 501464 - DNA, 97 bp, Homo sapiens
tattgaaaaggaaaaaattccttaattttttattcctgggccccctaccacaatttacagggcaattttcctggtgttttgaaaagaaaaagaaaaa

SEQ ID NO: 501465 - DNA, 569 bp, Homo sapiens
  misc_feature (19)..(19): n is a, c, g, or t
  misc_feature (22)..(22): n is a, c, g, or t
  misc_feature (29)..(29): n is a, c, g, or t
  misc_feature (62)..(62): n is a, c, g, or t
  misc_feature (299)..(299): n is a, c, g, or t
gcctactactactactaanttngcggccngtcgacaaatgagccttacttcaaatacagccnaatgcagttcagtaattagtatatgagttctgcttcagcttgggctgggctccagttcttcattccagccttagctctggaatttccttctctagaaaaccttggcggcccactcccaaggccgggttagcggctgcttgagctgtcctgtagcacttatctggccttcgggttctcaaaccgaggcacctaacactgaatgtggagtacaaaaggttatagagcaggccgggcganggtgtcacgctgtaatcccagcactttgggaggccaaggcgggcggatcacgaggtcaggagattgagaccatcctggctagcacggtgaaaccctttctctactaaaaatacaaaaaaattagccaggcgtggtggcgggtgcctgtggtcccagctacttgggaggctgaggcaggagaatcgcttgaacccgggaggtggaggttgcagtgagctgagagcacgccactgcactccagcctgggtgacagatccagacaccgtctca

SEQ ID NO: 501466 - DNA, 525 bp, Homo sapiens
gtgtctttttgattggagtagctgtcacatggtgcatagatatgtgcttataggccgatcgtggtggttcatgcctgtaatcccagcacttggagaggtcgaggcgggtggagcacctgaggtcgggagtttgagaccagcctggccaacatggcgaaaccccatctcttctaaaaatacaaaaaattagccgggtatggtggtgcgtgcctgtaatcccagctactcaggaggctgaggcaggagaatcgcttgatgcagttaagcgagatcgtgccattgcactccagctggggtgacagagtgaggctccatctcaaaaaaaaaaaaaaaaaaaaaaaaaaaaaaaattgttttccccaaaacttaataaaaaaaaataaatagggtgctcatgaacagggttgctaggccaggcgttgatgggtctattgcgtggtatattccaaacattggggaacaccagggcaggagaatttttggaccccgggagtccaaaaccaggtgggccaacatggggagacc

SEQ ID NO: 501467 - DNA, 275 bp, Homo sapiens
cagttgagcatatctatataagtatatcggtcatccagattcggcattctgttcagttctgcatccatctcctttttctatttttttccttataagcagtcatatgttagtgaccttcaaactcttcctgccccttacttgagggcatgtgctaaggaatactttgaccgaaatcattagcttgcagaaagtagcttttatccttagacatatctctaccctacttaccccaacccgtctggtgtaggggaggttaccttgtacctacactgata

SEQ ID NO: 501468 - DNA, 362 bp, Homo sapiens
gcgccttgaaccaggagtggagcggcgagtggtaggttgcagtgagctgagagcacgccacttcactccagcctgggagagagagtgagactctgtaaaacaaacaaacaaaaacaaaacaaaacaaaaacctatctctcaccatatattaaaatcaaatcaaaatagattaaagatgaaagacataaatgtaaaacctgaaagtatgaaactactagaagaaaacattggggatatgcttcaggacactggtctgggcaaagattttttgggtaagatctcaaaagccaaaggcaacaaaagctaaaatagataagtgggattatatcactctaaaaacctgcacagccattgcactccgg

SEQ ID NO: 501469 - DNA, 200 bp, Homo sapiens
ggtgtgtcacgctataatcccaggagttggggagatgacgcgggaggatcacaatggtcatggagttcgagaccagtctgaccaatgtgatgaagcccctgtctctactaaaaatacaaaaataagccgggcgtgggggcgcacgcctgtaatcccagctactcaggaggctgaggcaggagaattgcttgaccccgtga

SEQ ID NO: 501470 - DNA, 412 bp, Homo sapiens
atgggctgtctgatcgctgtgcctactacaagaaggacggttctgacttcgccaagtggcgtcgtgtgctgtatgattggggaacactgctcctcagcgcctcgccatcatgtaaaatgccaatgttctggcccgttatgccagtgatctgccaggcaaaatggcattgatgcccatcgatggagcctgcaaatcctccctgattgggaccgatgcacttgaagcgctgccactatgttaacgaaaaaggtgctggctgctgtctacaaggctctgaagtgaccaccacatctacctggaaggcaccttgctgaagcccaacatggtcaccccaggccatgcttgcactcagaagttttctcatgaggagattgccatggcgaccgtcacagcgctgcgccgcacagtgccc

SEQ ID NO: 501471 - DNA, 183 bp, Homo sapiens
ctttcatttttctaagttggactctggcagtgatagtggttttccggaataatagcacacatctgctatgactgattaagaaatctgaggggggtgggggtgagaaagattcggcacaaagagccactcaggaatgagtgggaacagccatgttggagccattaacaagagtattatgaaaaa

SEQ ID NO: 501472 - DNA, 287 bp, Homo sapiens
  misc_feature (12)..(12): n is a, c, g, or t
  misc_feature (23)..(23): n is a, c, g, or t
  misc_feature (39)..(39): n is a, c, g, or t
  misc_feature (60)..(60): n is a, c, g, or t
  misc_feature (93)..(93): n is a, c, g, or t
  misc_feature (111)..(111): n is a, c, g, or t
  misc_feature (156)..(156): n is a, c, g, or t
  misc_feature (181)..(181): n is a, c, g, or t
  misc_feature (209)..(209): n is a, c, g, or t
  misc_feature (225)..(225): n is a, c, g, or t
ccaaacgcgctntccgccctgancgacctgcacgcgcanaagcttcgggtggacccggtnaacttcaagctcctaagccactgcctgctggtnaccctggccgcccacctncccgccgagtttcacccctgcggtgcacgcctccctggacaagtncctggcttctgtgagccccgtgctnacctccaaataccgttaagctggagccncggtggccatgcttcnttgcccttgggcctccccccagcccctcctccccttcctgcacccgttcccccgtggtcttt

SEQ ID NO: 501473 - DNA, 848 bp, Homo sapiens
  misc_feature (651)..(651): n is a, c, g, or t
gggggggggtacaccacaccattttttatctattggtataaacgcacctcctctcatcttccactcatggagataggtgctcacgtcgcctcgtccaccaaaccaaggggtgttgtgctgaactctcgctgggctatacacccccgcgagcgggataatatatctcctcccacataatataatagaatcacatttggtggtttgcgcgtgtaaagataactatattagcttagcgggtatgttgaagaacaccactcgtggtggtgttttttctatcgcggcgtgggttttttctcgcacgccaagttcatcgacaagagacgatgtttttttcttggacgcccccctccccccccctctcttttgtaacaactttttttgtgcgttctcactcgctcgagatatatatatgttgtttgcgatagatatatatatctaaaactagtgtatgttgaacacacccgcgccccctcttggagttagatggcccctttcgttattgtgctaatatatattgtagacatatatcacaagcaatgtaatcctcaaaaatatcctcgtccccaccccatacttgtttattagaaaactacgccaacacatattggttgattcaaccagccagtgtgaaaggagtgttcctcacccctntttcttcgggatattatcattccctgaataatactaagcagatacttcaagaaaatattttgtgggagagaacaacacccccttttgtaaccaccttttttgtggggaccaaggggaaggggaaaaaatttcttttttttttttagacggtgttttttttttaaaaatttttttaaatttttttttctccccctata

SEQ ID NO: 501474 - DNA, 381 bp, Homo sapiens
tggacaataatgtttaaatttatttaaaagtaaaaatcaattggtaaaagggcttccagatacagttcaccctcagccttaacaagcatataatacaatttatataacaatatacccgtgaatactgactgcaaggataccctctgttcaaacaagaacatttgttttccccataaaaaggggattgctcagacaccaaccgtggtgttcaagttctgtggtgacctatttcatacacatagctgtttaaagttaagtgagataaataaatctaccctaaagtgagccattaaaaacatcagttcacaaggtgctttcgggtctcttataactaaatacttatatctctttctcttggttagaaaaaaaacaacaaagggg

SEQ ID NO: 501475 - DNA, 141 bp, Homo sapiens
gggcgtcactgtgagaggtgcgcccctggctaactatggcaaccccagccagggccagccatgccagagagacagccaggtgccatggcccataggctgcaactgtgacccccaaggcagcgtcagagcccaggtgtgatg

SEQ ID NO: 501476 - DNA, 104 bp, Homo sapiens
agatcctacctggtatcccaccctcagactccaacataagtcgtttgcacagaacttttttttttttaaggaaataaagaaaacagtgactaatcccgctaccc

SEQ ID NO: 501477 - DNA, 159 bp, Homo sapiens
tgctgccggtcgactctacgacggactccccgtatacaccacggggacgactacggtacgactagcgtggtacgggcgactgacgtgtggggacggacctggggtgggtttgtactgttcacaccgtcacttttactttttaccgtttgttacgactac

SEQ ID NO: 501478 - DNA, 249 bp, Homo sapiens
gggtcttagccatgaatacggtgcgtcacatcactggttttccagaaaagagctgtatagagagagaatttacacagctgacaatgtgtccgtttaaactcttccaacccgtggctttctgtatgcagagacttgtgccaccatcaccacagtctattttattgctttacttatatttgttttttttttttttgggagacagggtctcgctctggtagcctgggactctcaggctaaggggaccctggg

SEQ ID NO: 501479 - DNA, 479 bp, Homo sapiens
agaggatcccttcacacatttagtcctccagtaatatagtggaacggctataagtgtgtcatgatttctacaaatagacttcgacttgggaaatggactttgaatggacaatctgaaagagtctcaatgatatgcttgcaaaaatatattttaatgagctggtactgacagttacatcataaataactaaaacgcttggctttcaatgtcaaagttgtgccttcacattaaataaaatatatggtctgtgtagttaccgagatgtactatatacagtatattttcctaagaaaaaaatgccttgacccaccgtgcctggcaaaataagataatttctcaaaataattgggttccatataacgggagtagtaattaatattttaacttcatcaactagatgtatctcctcagtagcatagtaatgggtacttccagaaatctgaaatccgagttacttgatacaaattctactaaatgtg

SEQ ID NO: 501480 - DNA, 179 bp, Homo sapiens
ttgcatctgatctggtagtggcccttccaaatttcagattctgaagcactttcttcctcatcagagtttctaagtagagcactcttcagatttctattgaagacttaatgtcctttatctatttatcttgcgaggcctcttcctaacgccacggtagcgggatcctactagcagtcgac

SEQ ID NO: 501481 - DNA, 412 bp, Homo sapiens
  misc_feature (16)..(16): n is a, c, g, or t
tagaggatctactaanctaatgcagaagaaacagcaaatgcaaggctgacagtatatatggtatggttgaggactagcatagctagcgtggctagagcagagagcaggggttgtaggtgattaggtcatagtaaggctactgtcttttagttagagtgagatggagaccctttgaagggattgagcagactaacatgatctggctatctaaaaggctcagtctcactgctgtattggcagtagactgaagggaacctggatggaagcagagtccagttaagggtcttttgcaataaccttggctagagatgagagtagcttggccctattcatcaccagtgaacgtgcatgacactgcactggagtccaggatatactttcacgcatctcagctttatggcaatcccacctg

SEQ ID NO: 501482 - DNA, 306 bp, Homo sapiens
ttatatttaaatttatttttaaaaatttatgtgggtacatggtatgtgtatacattcatggcatagatgggttactttgatacagacatgcaacatgtaatcacatcagagtaaatgagttattcatcacctcaagcatttatcctttgtattacaaacgaatccaattatacacttcatttttaaatgtacaattaaattattttttattacaggtaattttatgattgtatttagaattatatcagaatataattataatttagacatttctgtgtcctgaataaatatgtttttaaatgttcc

SEQ ID NO: 501483 - DNA, 269 bp, Homo sapiens
  misc_feature (22)..(22): n is a, c, g, or t
  misc_feature (50)..(50): n is a, c, g, or t
  misc_feature (61)..(61): n is a, c, g, or t
  misc_feature (198)..(198): n is a, c, g, or t
gtagagacggggtttcaccatngttgggacaggatggtcttgatctcctngacctcgttantccgccttcctcggcctcccaaagtgcggggattacaggcatgagccaccatgaccgaccaagatttattaaaaaataataaatactatactactgttttccataatggttgtcctagtttacatttccaccggcangtgtagaagtgttccctattcactgcatccacaccaacatctattatgttttgattttttgttatggccat

SEQ ID NO: 501484 - DNA, 1165 bp, Homo sapiens
gcttattccgtgctaactgccagaggggtccatacgggcgattgttctgggatatcctcggtcgttacacttaaatgggaaactattcacagatgtctcggatgccgctatgagtgatccatgtcgaagatgaatggagagaggagtgtccttaaagattcctttgacaggcagtgaaacccaacattaaacgttgggcaactaaaatacttaagatattgcctacgcattggaacaccaggtcaccaatgctgtatcaccacatatgggcacacaagtgcatcggctattctcatatatgctatcatacatactgcatagcagtgcaccctaggggcaagagaacttatcctgggcttgggacagagtcctgtggccaaatgtgaggtatagcgctaattttggcaccaatccccttgggttcgaaacgtcggagtgtataattattgcaatcccgagggtaaattagttggggcccaagtaaaggggctagttgcattggacaggtattcgcttggcgtgccccaatgtggcaagacccaacttccccaatatttagctacgggaacaggatatattggaattgcctgttgagtaaaaacacttttgagcgtaaagactaggaaattatcaagcagaaagtgaacatatactcgggagaatgtaaccaaaggaggtgaaaaatgaaggaatgaggataaagattggaatcggtccaagttgggaggttgtttacccaatactaagtatgcaatcatacaacgtgtaaggtggacaagttactgtggaatgggtataaaaaacgtttaagcaagtaacacaggtaggacgtaaggggggataaaataacagaggagtgttcattggaatcattgtggcattaaatggtgaggacaaattttgcacaagttggacaactgtacaaataaaaaagcagtgggaagacatgcaaaccaacaaggatggagacaatacaagacaataaatggcacgagacattgccaggggaaaccacggacaacggagcaccatagatggcgcaatgacacgatggaggaacccaaagagaacgccaatgacaaaagacgacacgaaatagggaaaaaggcacaaaggcacacggagaccaaacgggaaaaccgcaacgtagaagaggcagcaaatc

SEQ ID NO: 501485 - DNA, 175 bp, Homo sapiens
ccaggaagtccccttcctgccccccagaattctgcttcagagagcttcttatacttggagcgtttgttctgaaaccagatctttaccttcgtggaagaaacaggggaaatgaagtgaaacgatcaggaggaacgatactgtgtgaaacagtttcgaaggaatgggaaatgggatc

SEQ ID NO: 501486 - DNA, 213 bp, Homo sapiens
tgaaccaaaagcaaacttttttattggacacaggacaaaatataacccaacttggcaggatgcataccggcctgcgcaagggaaaggatttcaaatcaactggcagggtcaagcctttctgcactggaaactttccacactttggaaaagaagcaaacaaaccaaccccaaagaacccccgaaaaaaacaaaaaccattcgggaggggcatga

SEQ ID NO: 501487 - DNA, 112 bp, Homo sapiens
aaggaccctgaggagagagaatggatatgatcaaagcggggagcgagtctaatcagagatatgaagatggcattcttcacgaaaatgaaacagtcatgagatgaaaaaacaa

SEQ ID NO: 501488 - DNA, 979 bp, Homo sapiens
ggtgtcttcccctgcatagccggtgtatccgcctgggtcactgctgatggcagacggagctggtagtcagatcccgaaatgcgccctcgtcgtggactcggtcctcagggatgcgtataactggtggtgccgaggctgtcgttgccatcaatggcactatgcgtggcgcctttccatacctcggaggtgacatggtgctggtactactgccagccctctgtgctcatggcatcgtgctgcgccatctgtcttcgaaggcgcctggcgtctgctgatacgctgcgcctgcgagtaagcaatgtttcaggaagatgactgacctcctcactaagacggggagtggaggccggttctccatcattgcgcggatgcaaatgcttgtgtgctctacctcttttaacagattattctcccaggagtgagatgagcctcctggtgtctatgtatttcttcgtgtgtgtgaaatcctggatcgctgtgcccatggccagtcaaaccccttcatggaattgagttttagtccagccaatctttccaatcggactagtgacagcatgatctgcaatacagggcttctggggaagaacaaggatgagatcatcggttatgaagtttggcactcaatggacctggtgtgcctgggtcctgggcagcatcgttagtgtgtggtacctgtttgaggaaagctgtggttgcgaccacctttttggcctgacatctcccttgattggagaggaggtcctgaagcgtaaggaagttgggcactggtggttcagggaggggactgttatgtccgacgtgtccgcggtcgggccaggggggtgcgactggcgcgctaacggcccaaatatgtgtttcccggtttgggcagggcggccccaagttctgtggctggcagcggtccgagaaggggcacgcgagagggagaaaccccaaaagtatcgggaacaaggaaagcaatctcttagaagaaacacac

SEQ ID NO: 501489 - DNA, 223 bp, Homo sapiens
ctatcacattatcgaaacacagaagagaagaagtacgagatgctggtggcagggcatgtaggacagcaatggttgtatcaagctatgaagcagcgtcgtccgcgtggtgctgaactggctgagcgaccattcccacgtctccaccagcagtcctgtgtcctttaccctgctgttgacatttccgtcatcgtccgccgtacaacgatttcctctacgtgacttt

SEQ ID NO: 501490 - DNA, 1221 bp, Homo sapiens
cggcgaacgcggagtagcacgccatgaaggcctcttgcggcacgctacgagagtacaaggtagtagggctcgctagtcactgcgccaccccacagagatgcgcacacgccgccccgtctatccgcatgcgaaatcattctgcagaccttataactcattgttcagtcgcctaggatcccgcttctggtactttgtactctcacgttacaagaaggatgaatgatagtcttgcagagggaagattgtcatacttgtgtggtcaggttgtgtgaggaagtccacgctcgcttgcgggtgaatgaactttcgtggatctggcttgctgcctatgagtcccggagctgggacgcgcaggagacatgtaccgggaatacctgggatctgatcaccgtagtgcgcatgtcagcgcatgtgctagccgagacagtggagtgccgcggtagcgggcccgagtgccattccattcagcatcatgaaggtgcaggagcatcgctggccgagatagagtgccgatcggccggcttgtcagagcagattgccatgactccaagatcaaggttcccgcgtgtgcaccgaccggggtacctggcgccgatcagcaacgaggtgacgcttcgacaacaaggagaggccaagaagcccttctgtctagcgtagcaggggcctcgtcctgtgggtgattgctccgaatataaaaactcaaggtaacgctccccggttaaattaaaaaaataaattcacacttgggccctcacacttgaagacagcagtcacagcaaagatgtgagtcccaagtccattctaccaataactgtggcggaaaccaggtggcaaataattcccaatatagggccactataagtatggcctaagccgggaagtttacaataggaacacataaaatgggaggcatagaaaagacccaaagagacccagcgcacagcgaaaatcaaccaaagaaagtctaggagaaggcgaagaaaaagaacagcatagtgacacgaagtaacgaacgaagcggcacacccaaacacaagacggtggatcaaacagactaatgtgaaaacacaagcactccacatcgaagagaagacaacagacatgagcacgaaagaagtaaaacaaacacatcgccgtcgaaatcacacagaacacagacgacagcacatagagggcaggcaacaaaaggacgaagacgaagaacaatcactccaaactaag

SEQ ID NO: 501491 - DNA, 357 bp, Homo sapiens
cttgacagttgtagggtatgcgggggaatcgatgatccgggagtcccctgcgtggatgtcgtcccggcaccaggacgggaccgattgctgggtccagtgtccccagaattgcggactgcgcacacctggaaggacccgaagtcccgtgttatagttgagaaactcaagactcagacaagtgaaacgactttggcttcatgacagctggaactggaacccagttcccttttagactatggcgagcagtacctggagttcagtccagcagaatgaagaacgggatggtgtgcgtttgagttggaacgtgtggacttccagcacggctggaggctacaagaatggttgtacccctggcac

SEQ ID NO: 501492 - DNA, 593 bp, Homo sapiens
taccacctctgacgagtcttcagatgtcagatgtgtctttgttccttctggtgggttcgtggtctctgacttcaggagggaagctgcagacctccgcggtgagtgttaccgctcttaaagacgtggcagacccaaagcgtgagccgcagcaaaatttattccacgctgtggaaacgaacccaagcagatcgcggcggcaaactgggcagcctgtttattcccttatctgaccccacccacatcctgctgattggtacattttacagagagctgattggtccattttacagacagctgattggcccgttttgacagggtgctgattggtgcatttataatccctgagctagacacagagtgctgattggtgcatttacaaccctctagctagacataaaagttctcaaagtccccacgagacttgctagacacagagcactgattggtgcgtttacaaatctttagctagacagagtgctgattggtgcatttacaatcctctcgctagacataaaagttctccaagtccctaccagattagctggatacagagtgctgactgttacatccacaaaacctgagctagacacaga

SEQ ID NO: 501493 - DNA, 121 bp, Homo sapiens
gatggggactacgtgtggtttcgcacgaccgactactaccactactgacttacgttcttgtgggctgtgacctgttactcacttaccggacgactttgtacgtggacgacttacgtactac

SEQ ID NO: 501494 - DNA, 305 bp, Homo sapiens
acaggaaaaactgagacgaccaaagatctggcaaaagctcttgccatccagtgtgtggtctttaactgttcagatggtttggactgcaagatgatggggcgcttcttcagtggcttggcacagtcaggggcctggtgctgctttgatgaatttaatcgaattgacatagaagttctgtccgtcatcgcgcagcaactcattaccattaggaacgccaaagcggcaaagctctctagattcatgtttgaggggcgggaaataaagttggtgatgacttgtgcagcctttatcaccatgaatccagg

SEQ ID NO: 501495 - DNA, 860 bp, Homo sapiens
agcggggcagagcagccgcgcagcgcctgaaccgctgcgggccgccgcggacgacccttcccaccctcgccatcatgacatgtctccagaactcgcttctccgactttcctgctcctctgctgccttcgtatcatggtcctcggccgtcctcgccggccgaccagaggagtccccgagcccgacaagaagccgatttccgcatggcaccgaagccgccgcgaacttcgagcacagatttcatcccatctggctagtctcccaaaacggacgactccatcgacccgcgggaagaccaggcatgagaacgcgaacgccacgaatcactctccaggacgccgcagagagacgcccggcggacacgccccgacgaacacacacaccggcaggctctcggaccagagacgcctgccttcgaccgaccgccgtcgctcctcgaccgctgcacgaagacgcgacgcaccctgcctgcaggcggcggaaccgaccggacccagacccagacgcaagatggcgacggccgcgtgactgcctcagcgtccccgagctcggctccgagtgcaactacggactgactgtgggggcagagaagggcgagatcaggactctgtcttagagaatcgtagactgcatgaagggtcgactcaccatcgggccataattggagggagatgtctggtcatgtaactaaaggcaggagcacaggtgagccacaagtcctggaaagagacgaactacggcgtcatggatagtcgagacacacggacgcagacactggaggaaacaccggatgacaggagagatgcaatgtgaacaacacacgaaagccccagcaacatctggaagcatccccaggaccacg

SEQ ID NO: 501496 - DNA, 528 bp, Homo sapiens
ggcccccccgtgttcctccctttcccggggagcaagccaaagccccggtatggaaaggggagttcccaccaggatgaaggttcccccatcagttcccccaggccctccaagcaaggaggtttccttttgtcacagaaatcagaggaaaaatggggttgggggccctttggaaaaagccagtttccccggcccccggcatttattgggtttgcaaggtccccccccctttgtttttggggccggcaagattttttaaaaaaagttttattttttcgggccccttgctaatcatgggggggggcccggggaacagcgggggccctggggtagtttttcaaattgcccccctattacgggggccaaaaggaaacccagggggcgggggttgttttttccccccctgtttttttcccccccaaggggaaaggtttgggggaaccccgctttttctgtttttgaaaaaatacaggttccccccggcaagttaacaaggaaggccggggcccaaaaaaggtttttcccccttga

SEQ ID NO: 501497 - DNA, 457 bp, Homo sapiens
tcgtctctgatatcaaacagagagagcacatcaacagatgagcatcagatgcaccaatccacaagaccaggtagtcagtactacaaatggagagtacaacacagatgaccccaccgcaggaacgtgcaagtgcacccatcacagcccctactgaagtagaagtaatggatgaaaccaagtgctgctgttcatcccaaacgaaggaaaaggacaaccatacagcgccacaaatgactctggacacagacagatcctggggagttacttacgtgtacatctgctgtcttgtgatggacatcagtctctgtagtgaccacgtgatatgttcaaggactcactcgtagaaacaaaaatgtcatactttcatacttcatgttgtggtagtcttgcattcttttactatcatgctgttccacaaagcaagccgtataggaaagactaaaggcgtggacaaaga

SEQ ID NO: 501498 - DNA, 673 bp, Homo sapiens
gagcgtgatggtggatttcccctcctcacgccagctctaggagaagaagttcgtagtcccagaggtgtctgccgagttggtacacagtggatcacatagaagaggagttgtacgcgtgtcagagaggttgcgggctgtttgcatacttggtcagtggtgtggatgactggaatggacttaaatcgacagctaaatcggcaatgtgaatctgctatgtgcagaagcatattcccaagtctgatgagcacatatgcttgcccatcttggattgccagaatctagcgtgccattcgctgaagtgagacaagaacaacttatgtccctgatgccaaaaatgcacctactctttcctctaactctggtgaggtcatgtctggagtgacatgatggactccgcacagagcttcatgacctcttcatggacttgttatcttcaagccgatgacggagaagatagttatattccagtctaagccagaaatccagtacgcaccacatttggagcaggagcctacaaatttgagagaatcatctctaagcaacaatgtcctatctgcaaagtgagacattcacaagcgcacaggaatttatcttgcaagatggagaaaagtgagtggctttaaagatgcctctctcttaactctgggtggatagaactacaactcttgtcctc

SEQ ID NO: 501499 - DNA, 452 bp, Homo sapiens
catatgtatcaggtacagcggaaaccataaattatattttagagttattccaaaaaataaatccaaatatttagtaatgaggagattgctgtgctctgtggcaattctttgaaactggtgactgcatttggcattgttcctcagggtgtcatatggaaccatgtggcatcaacacaattaaaagatgatcctggataatatctcagttaaaatcagaaacactgacaagccaagtgattaataaaaggtcccatcaggaactttggacttgaaataaaaatgaattgctcaaattctcgccctactgttttactaattatgtcattaagtagggagcttagtgagccacttacatatctttcacatctctttttttacatctgtagaatgaggacaataaaacctgtcctccctcaaaggattgtagtgagggtcaatgagagaatgagtgt

SEQ ID NO: 501500 - DNA, 221 bp, Homo sapiens
cctagcgccaggactcttaaagtgaaattactggggcatagggtatgagggttttcatgatcctttgtatcttgacaccacgctccccgggtgtgccccgcagctgactttgccatcgaggccttgcgcaaggggacctatgagcggatgttccgctggctggtgctgcgcttcaacaaggctctggccaagaccaagaggcagggcgcctcccttcatcg

SEQ ID NO: 501501 - DNA, 982 bp, Homo sapiens
cgctgctattgtatagaaatccccatgagattggttaacattccatgtctcagcctgcccaggagccgggcttcaaccggtagcttcctgggagattctggattttcaggcttgcccggctaaattgcagtcaaccaaggttttccatgccaagatttgatccggtgcgcctgctgtagttgggactcgaagtacacggccacgattcctaacccattggctctctaatagtcagccctatgctgtcctgcagcgccctttgtggcccagcatggtagcatgcaaaggccagctggactgggtaagagagtcccctgcttctaacagcctgttcccagttctctgatggctctaatctactttatacggctgctacacggagccgctgtctggtgaacctgccgacaccggacttcagcatgccctacaacgtgatcatcgccttacgtgcactcgtggtaggccgtgctcgctatggctccttctacaatctcctcacccgaacctgtccacatcgaggagccctgcacaggatggcctaggccaagcggctggccaaccttatccggcgcgcctgaaggtgtccaccccactctgattcattgccctttaccagcagctgcagctgccgtttctctctggggaggggagcccaagggctgtttctgccacttgctctcctcagagttaggcttttgaaccaaagtgaccatggaccaggtcagggcctacagactgtgttgtccagtatcaggagccacgagcgctaaatgtggcagtattgaatttgaagttaactgtagaaattcagtttcctcaccatgctatgtggccacctgatatattgaggtgctcaataagcaaaagtggtcggtggctgctgtattggacagcacaggaaaagatttccatcaccacagaaaggtcggatggcagcactggccaaggtgatggggtttactacagagtgtatgtcactgtt

SEQ ID NO: 501502 - DNA, 1174 bp, Homo sapiens
gttggtttctttgtttgtagtaaaaacaacaacaaggcagaaggcggcgggtggtcgtaggtggagacggccccacgagagcggaggaagctcgtatatatcaagttacattccgtccttggtgggtgggtggtcgcctataagggttggtcttttcctcacagccctaatttttctgaaatggcctagaaatgtgattgcgtgtccacagggcgccaccactgtctccgccgcttgggagcgcgatgtgctctcccctcttcgtgtggagaagacacgtgggtgtaaccgcccgggggcgttttctgccgtcgttggtgggagtacctaccgcacgagagctctattattttggggcagcaagatatttctgccgggcaagttgtttcttgtgtgtccccggagaccacagttatggccggcgccggcgtgttcgacccaccggcgctgtaccagggccgtctctcctctttgctggtgagaagattgctcagggtctcacttacgcgccgcccgggggtgaaagtcgccccgcattgttagaggcggcgccccccccggccggtggtggggcgcgccccccctctgtctggtggacgcttcctccttgtggcgggatatatatgtccgggcgccaaagtgtagctcgccccgcacccttcctgtgtccgcgggaccaagaatgtagttccgagggacgcttgtctccacgggattacagcaggtgtttcccccccggcttcgttattctcccccctcgggtcatagtgttcgtcgcgtggacaccactgttctcacatcgtctccagattgcgtataaaccccgcgccccacattgttgggaacgtgatattatctctgggttttgaataaaacaaatgtggcaccctgtttccacgcagtattcatacacagagtacagaaggggtccgtcttgttgcagggatcagtttgcagagacactagttgtatggcgccgcgccgtgcgaatcgttctgtagaaacccccattatgcagttttgttccccatcacctctgtttgagtgcgcaccgaggggtgcccacaccacctgcgctttctatggagcggtagtgaagcggcaacatattctgttcacagagcgataatttgggagagacaaaactagaaaacaactcaacaaatgtcgagaa

SEQ ID NO: 501503 - DNA, 711 bp, Homo sapiens
catcagggcctggtttcattgtaacttacctgccctcggtctccttacatttccacacagttcgcgcaagtggagctatggaaggcccatgctgtgctgttctaatcatgtgagggattcttaggggtagagggggaaggactgaaaacggctgcagaccgtttaggatgcctggagtggagacaggagttaagccccttactcagagtcagctcttaagaactgcccagggccgggccacagtaggctcatgcctgttatcctagcactttgggaggctacaagtgggcagatcatctgaggccaggagtacgagacctgcctggcaacatggcaaacaccccgtctctaataaaaatataaaaattagcctggcatggtagcatgcgcctatagtcccagctgctacaggaggctgaggcatgagaatcgcttgaaacctaaggaggtggaggtagcattcaacttgagatcataccacttcatatccagcctgggtgacagagcaagacctctggcctcaaaaacacaacaccacacaaacacacctggcgagaccacaccaaaccgggacggcgcgcccaacaacggggacccctccacggcacacgggcccacacggctgtccgaccccagtatcctgacccaccagggaacacggaggacaccaaaagagcgccgccaatatcgaaaccccggtaaccagcctag

SEQ ID NO: 501504 - DNA, 888 bp, Homo sapiens
  misc_feature (249)..(249): n is a, c, g, or t
  misc_feature (848)..(848): n is a, c, g, or t
  misc_feature (862)..(862): n is a, c, g, or t
  misc_feature (883)..(883): n is a, c, g, or t
gccgccatcctcggcgcgagctcgcgtcttgcgggttctacctgggagaatccagcggcatccgacagcatggtgaacttcacgggagaccagatccgacgcgatcatggacaaggaggacctctacctgaagccaatccagagaacaatcttgatgatgggccgctacgtggagcccatcgaggatgtgccttgtgggaacattgtgggcctcgtgggcgtggaccagttcctggtgaagacgggcancatcaccaccttcgagcacgcgcacaacatgcgggtgatgaagttcagcgtcagccctgtgtgtcagagtggccgtggaggccaagaacccggtctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggccttccccgacggcctggccgaggacatcgataaaggcgaggtgtccgcccgtcaggagctcaagcagcgggcgcgctacctggccgagaagtacgaagtgggacgtggctgaggcccgcaagatctggtgctttgggcccgacggcaccggcccaacatcctcaccgacatcaccaagggttgtgcagtactccaagagatcaaggcacagtggtggtggcggctnccagtgggcaccanggagggcgactgtgtgaaganaacat

SEQ ID NO: 501505 - DNA, 540 bp, Homo sapiens
caatgcccagatagcccttagaaatccagatcattctgtagcgggagtggtcccattacaactctgggtttatgaaatgtgcatctggtgaaatacatgagcctttgtcttcagattatgagtggaatgtgataatataaagaaaaagaatgaaaaggaataaagatagcctacaatatatagaaaattgcctcaaaagaccaaatcttagaattactggtgttcaagagggagctaagcagaacaaggaaggggaagaaagcttattcatttcctttgagacaggatctcactctatcacccaggcagaggttgcagtgagctgagatggcgccactgcactctagcctgggtgacagaatgagattccatctcaaaaaataaaaattaatataataataatagtaatagaaaactttccaggtacaagaaagcctgagatcactaaacagattcaacccaaataagatatcccaagggatatagtaaactctcaaagatcaaagataaggagaggatttgaaaagcagcaaaaaacaa

SEQ ID NO: 501506 - DNA, 726 bp, Homo sapiens
  misc_feature (45)..(46): n is a, c, g, or t
  misc_feature (49)..(49): n is a, c, g, or t
  misc_feature (51)..(51): n is a, c, g, or t
  misc_feature (53)..(54): n is a, c, g, or t
  misc_feature (56)..(56): n is a, c, g, or t
  misc_feature (686)..(686): n is a, c, g, or t
  misc_feature (700)..(700): n is a, c, g, or t
  misc_feature (721)..(721): n is a, c, g, or t
tcccgacgtttgcccgatgtatgtggccaagttcgccgccaaggnngangncnngnggtggcctgccgagcgggccaagaaagtagaggacatgatgaagaagctgtggggtgacaggtactttgacccagccaacggcaagttcagcaagtcagccaccagccccgaagggaagaagctgctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggccttccccgacggcctggccgaggacatcgataaaggcgaggtgtccgcccgtcaggagctcaagcagcgggcgcgctacctggccgagaagtacgaagtgggacgtggctgaggcccgcaagatctggtgctttgggcccgacggcaccggcccaacatcctcaccgacatcaccaagggttgtgcagtactccaagagatcaaggcacagtggtggtggcggctnccagtgggcaccanggagggcgactgtgtgaaganaacat

SEQ ID NO: 501507 - DNA, 408 bp, Homo sapiens
accttctgctctgagattgagaaggctgtctatcttgccagcttcggtgaggaggaggtggcatagggctctgccttgtgagagttggagcagcagttcgtcagatggcacgcaagaacagtgcagatacagttcactatcaggctgtgccaggaagcagtcagaacaagacagaaccgcagggggcgcgggaaagggcctccctgtcacccctggaagggtcaggcgtccacggagggtccggcaggaacgagaaaaattaagtcagatacgggtgtaaagacgcaaaaatctcctttaaggtaaacaggaaggagaactgtccgttgagaagaataagtacaggaatccaattgtaagagcagaagtccccatacgggttgcagggcaaaagattgttacagtgta

SEQ ID NO: 501508 - DNA, 1135 bp, Homo sapiens
  misc_feature (230)..(230): n is a, c, g, or t
  misc_feature (270)..(270): n is a, c, g, or t
  misc_feature (273)..(273): n is a, c, g, or t
  misc_feature (320)..(320): n is a, c, g, or t
  misc_feature (338)..(338): n is a, c, g, or t
  misc_feature (364)..(364): n is a, c, g, or t
  misc_feature (374)..(374): n is a, c, g, or t
tcctgcggcgtctggtggcgagctgaggtggaggcatggctgcggcagacggcgacagtggcggctggcgccatggcagggcttgcaggatccctgctgccttggtgatcccgggctgacagccagagagcacagcggctcagctcctggagagtgagggttgaagaaagcggagggcagccgactgcgcctgctggctcccattaggtcggttcctgcagcggtgcccnggcagccttggtgaaggccctgcccggcagagatcatgtnttngcctccagtggctgctgcccgtcctcctcatccccaagcccctcaancccgacctgtggttcagncactccatgttcatgggcttctaccntgctcagctncctcctggaacggaagccttgcacaaatattgtgccttggtatttccatggcaggcctgttccttatactgctatagctgctggggaaactgtatcctgtaaccagtggtccgattcccgcgttccagaatcgggagcatgaatcccggcgttgtagggcaccttaacggtgcctgaccctgtataggcttaccaaaggaaggccgaaagacggggagaggcgaggcacttgacagtagcgtcagtaaaagcattgggaggtttcagaaatacccgcaggcctcagacgaggtgtcaacattatccgtgaacgagaacgcctatttgggggccctaggtggaatcggtgtgaactccctttaacaacttggttgacattaaatttcgggcaagcttgacacgcggttggcttattacatttggaaagcggtaaccttatacggacggatggagctagagactatggattggagaaaggaaagatcgagatgcaagccatggagacgcccgcgagctacaaaaggggataccactgggaatggcggcgcggcaagtgagagccaacgcgccgatacgtaggcaaccgttacaatcatacagatggccgaaagagcaagagacaaaggggggcagcaagagaccggcgggaagacaaagaagtgacgccccaacatgggggaacgcacatggtgcaggcagagaacacaacacagggcaggaacgacagcatggagacgcaacagaatgtagagaagaacacc

SEQ ID NO: 501509 - DNA, 1424 bp, Homo sapiens
  misc_feature (45)..(46): n is a, c, g, or t
  misc_feature (49)..(49): n is a, c, g, or t
  misc_feature (51)..(51): n is a, c, g, or t
  misc_feature (53)..(54): n is a, c, g, or t
  misc_feature (56)..(56): n is a, c, g, or t
  misc_feature (542)..(542): n is a, c, g, or t
  misc_feature (550)..(550): n is a, c, g, or t
  misc_feature (568)..(568): n is a, c, g, or t
  misc_feature (601)..(601): n is a, c, g, or t
  misc_feature (606)..(606): n is a, c, g, or t
  misc_feature (633)..(633): n is a, c, g, or t
  misc_feature (785)..(785): n is a, c, g, or t
  misc_feature (1384)..(1384): n is a, c, g, or t
  misc_feature (1398)..(1398): n is a, c, g, or t
  misc_feature (1419)..(1419): n is a, c, g, or t
tcccgacgtttgcccgatgtatgtggccaagttcgccgccaaggnngangncnngnggtggcctgccgagcgggccaagaaagtagaggacatgatgaagaagctgtggggtgacaggtactttgacccagccaacggcaagttcagcaagtcagccaccagccccgaagggaagaagctgccacgcaccttctgccagctgatcctggaccccatcttcaaggtgtttgatgcgatcatgaatttcaagaaagaggagacagcaaaactgatagagaaactggacatcaaactggacagcgaggacaaggacaaagaaggcaaacccctgctgaaggctgtgatgcgccgcttggctgcctgccggagacgccttgttgcagatgatcaccatccacctgccctcccctgtgacgggcccagaagtaccgctgcgagctcctgtacgaggggcccccggacgacgaggctgccagtgggcaattaaaagctgtgaccccgaaaggccctcttatgatgtatatttccaaaatggtgccaanctccgacnaaggtcggttctacgccnttaggaacgagtcttctcggggctggtctccanatggnctgaaggtcaggatcatggggcccaantatacccctgggaagaaggaggacctctacctgaagccaatccagagaacaatcttgatgatgggccgctacgtggagcccatcgaggatgtgccttgtgggaacattgtgggcctcgtgggcgtggaccagttcctggtgaagacgggcancatcaccaccttcgagcacgcgcacaacatgcgggtgatgaagttcagcgtcagccctgtgtgtcagagtggccgtggaggccaagaacccggtctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggccttccccgacggcctggccgaggacatcgataaaggcgaggtgtccgcccgtcaggagctcaagcagcgggcgcgctacctggccgagaagtacgaagtgggacgtggctgaggcccgcaagatctggtgctttgggcccgacggcaccggcccaacatcctcaccgacatcaccaagggttgtgcagtactccaagagatcaaggcacagtggtggtggcggctnccagtgggcaccanggagggcgactgtgtgaaganaacat

SEQ ID NO: 501510 - DNA, 351 bp, Homo sapiens
aaaggataaagaaaattgggggtgaagttccctgctcacctcctaacagagattgagcaggtatctgtgcagacatcctttaagaaagcagttagttttccatgtcatgagggctggtcctgaagcagttaaaatgtgatggtgttggctcaggagtgatcgtcgcccacaggaagttaactggaggaagattctaggaggttcagtgctatgcaggagcctgttaccccagcctccaataagctaacagcggaagctgccgcctaaagctatttttttttacatccaaggttttgggaatagttcatcctttcactatgctattaataaaaattcataagtcaatttcca

SEQ ID NO: 501511 - DNA, 1471 bp, Homo sapiens
  misc_feature (45)..(46): n is a, c, g, or t
  misc_feature (49)..(49): n is a, c, g, or t
  misc_feature (51)..(51): n is a, c, g, or t
  misc_feature (53)..(54): n is a, c, g, or t
  misc_feature (56)..(56): n is a, c, g, or t
  misc_feature (589)..(589): n is a, c, g, or t
  misc_feature (597)..(597): n is a, c, g, or t
  misc_feature (615)..(615): n is a, c, g, or t
  misc_feature (648)..(648): n is a, c, g, or t
  misc_feature (653)..(653): n is a, c, g, or t
  misc_feature (680)..(680): n is a, c, g, or t
  misc_feature (832)..(832): n is a, c, g, or t
  misc_feature (1431)..(1431): n is a, c, g, or t
  misc_feature (1445)..(1445): n is a, c, g, or t
  misc_feature (1466)..(1466): n is a, c, g, or t
tcccgacgtttgcccgatgtatgtggccaagttcgccgccaaggnngangncnngnggtggcctgccgagcgggccaagaaagtagaggacatgatgaagaagctgtggggtgacaggtactttgacccagccaacggcaagttcagcaagtcagccaccagccccgaagggaagaagctgccacgcaccttctgccagctgatcctggaccccatcttcaaggtgtttgatgcgatcatgaatttcaagaaagaggagacagcaaaactgatagagaaactggacatcaaactggacagcgaggacaaggacaaagaaggcaaacccctgctgaaggctgtgattttttttttttttttttttttttttttttttatatttatttttttttgcgccgcttggctgcctgccggagacgccttgttgcagatgatcaccatccacctgccctcccctgtgacgggcccagaagtaccgctgcgagctcctgtacgaggggcccccggacgacgaggctgccagtgggcaattaaaagctgtgaccccgaaaggccctcttatgatgtatatttccaaaatggtgccaanctccgacnaaggtcggttctacgccnttaggaacgagtcttctcggggctggtctccanatggnctgaaggtcaggatcatggggcccaantatacccctgggaagaaggaggacctctacctgaagccaatccagagaacaatcttgatgatgggccgctacgtggagcccatcgaggatgtgccttgtgggaacattgtgggcctcgtgggcgtggaccagttcctggtgaagacgggcancatcaccaccttcgagcacgcgcacaacatgcgggtgatgaagttcagcgtcagccctgtgtgtcagagtggccgtggaggccaagaacccggtctgacctgcccaagctggtggaggggctgaagcggctggccaagtccgaccccatggtgcagtgcatcatcgaggagtcgggagagcacatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggccttccccgacggcctggccgaggacatcgataaaggcgaggtgtccgcccgtcaggagctcaagcagcgggcgcgctacctggccgagaagtacgaagtgggacgtggctgaggcccgcaagatctggtgctttgggcccgacggcaccggcccaacatcctcaccgacatcaccaagggttgtgcagtactccaagagatcaaggcacagtggtggtggcggctnccagtgggcaccanggagggcgactgtgtgaaganaacat

SEQ ID NO: 501512 - DNA, 284 bp, Homo sapiens
tacacatttactgccagaacatcaaggagttcactgcccaaaacttaggcaagctcttcatggaccaggctcttcaagaatacaacaagctaatgaaagtggaagtttccagtaaaagaagtttacatagaactcttgtaattcacaccaggagcaactctatggaagaaatatatttgcatatatgaaatagcacagagcgatttctattaggtgtcagttgccagattcttggctattacaagtgtctttctagcctataataaaataaaacaaaatcttgt

SEQ ID NO: 501513 - DNA, 195 bp, Homo sapiens
ctgagaaactttaggtctagcgacagatctacccatgcctaggtactctcatacaacgcttaccagcaataagacacagagtcattcatctggtgagtacttacagttaccaacagatgggtgcaaggaaaagaaacatctgtataccttatgataaatcaaataacctcttcctcaattcctcatccttgggcg

SEQ ID NO: 501514 - DNA, 190 bp, Homo sapiens
gactagagcatccgggtcggcaaaggatgaggatgtctttgatctccttctggagcctcatccacatatttctggtaataggccaccaggctttggagatggactgacggatagcataaatctgggccacgtgaccaccaccctttacacggacacagatgtctacaccagcaaatcgctccttgccgaa

SEQ ID NO: 501515 - DNA, 157 bp, Homo sapiens
cagcaacagcacacagagacgcataaagacacagcacacacaggcacacacagcacacacacgcgaacacagcacacacgaacacagcacacacagcacacacacaaacacagcacacaaacacgcagcacacacgttgcacacgaaagcacccacc

SEQ ID NO: 501516 - DNA, 473 bp, Homo sapiens
cacttatcctacccgcactctggggcgctccaatatctgccgttcctgcggtatcccctctcgcgagggtggccccttccccgggtcccgtcagcacacacggccccggttttccccgccctgtcgcggctgagaagaactttgcgtctgcaacaaggcccaatcccagacggccctcctccggtgtgccccccgcgcactttttctatcctcctcgttgcaccggtggctccctctccttgttgaggaggcacacttcgtagactctcgtcgcgactatttaacccctggggtcgtgtgcaccagagcacccttgcgcacagtcgcttgggcgttgctcggtgtcatctaccctgttgacaccaccaccccctggcggccgcaagcacgctgcgtggcaagcacttttgggcccggggtttgggcccccccccgccaaaaaaaaaaaaccctttttccacccccaaaaaaaa

SEQ ID NO: 501517 - DNA, 366 bp, Homo sapiens
gtctacagcaaatacagactgaccagaaggtctacataacagcccagactcttccaactctcatgcatctgtagatagaacgagagctgggtcttgctcacacacaggcgagcccttcttagaagaactgcctgtcccttgtaaggttcagagtcttgggtccagcagcagagaggagcccaactctgacgtggatcgacgctccttgagtgcgagccccttggatctcagtctgcctctgggctgcgcagcaggtttaaggtccatagttcacatgttcccaccagagcaagtcaaactcaaggtcctgaaatcttgaagggaaacaggggaatgctggaaaagggagcctgtgaagaaattgaa

SEQ ID NO: 501518 - DNA, 108 bp, Homo sapiens
ttgagctcaggagtatgtgcaggaaatgatgccgtgaggagagaggtttgctgaaacctcagcaggccccatgtgtggttagtgtagaacaaccgatggaggggatcc

SEQ ID NO: 501519 - DNA, 712 bp, Homo sapiens
gcctttagctgccatcttgcgtccccgcgtgtgtgcgcctaatctcaggtggtccacccgagaccccttgagcaccaaccctagtcccccgcgcggcccttattcgctccgacaagatgaacatgaaacaatcaatgaaccaggaataaactcggccgaaacctgcaaggcacaagtgcgcattgtgtgggaaaggaactgcgtcgcagaaagaagcaaggtggttcatagatgcagccacagacaggatgacaaataaacttgcagtgctccttaaagaaagttaggggtaaacaatatctctggtatcgaagaggtgaatatgtttacaagaccaaggaacagtgatccagctttaacaacccgtaacagttcaggcatctctggcagcgaacactttgcaccattcacaggccatgctgtagacaaagcagctgacagaaagtgctacccagcatcttaaagcagcttggtgcggatagtctgactagtttaaggagactggccgaggctctgcccaaacaatgctgtggagtggaaaagcacgcatttgctactggagaggatggatgatgatgatgttccatgatcttgtggagaaatttttgatgaggcttccaagaatgaggcaaatgaattgagtcaattctgaagataaaactgaagaagttactggggagctggtattttatattatgatgttttttaagaa

SEQ ID NO: 501520 - DNA, 271 bp, Homo sapiens
gagaagactccagaagatggccatggcaacagcataggatttgctataatgggattcatgggcttcttggtgaaatgatccatattcctattaataacatcatggtgggtggctgaatacatttgggaagagagtttttcatcttacgagatgggtgaacaagtgtgagggtgtgagaaactcacagaatacaaattggccggtatgtgtggtgggttttttttttcctttcaagaggttttctatttctaaattaaagtcatttcaaagt

SEQ ID NO: 501521 - DNA, 305 bp, Homo sapiens
cttcagtactccaccggattgctttattggttaggtaatgaagcacgctagggaatttctatcaaacaggagtcaacatactgcccaataacatctgaaatgactgaactataagtttagggagcatgggatgaggtgtactgttaaatcgctcctatgctggaaagtgttccctaagttcttcccatcactacctggagaagttgatgcgggattactgggagaaggcttgtgacttttaggtcctctcagagctcttcactttgctccatgttgtgtgttgttttcttgttcgtgattttttt

SEQ ID NO: 501522 - DNA, 102 bp, Homo sapiens
actgagtggcctcttcatttccatgcatctaggcgtagtcagtgcaggaagctgcattcatggtaagaatgagtgtgtgggatggatcctctaccatgtcga

SEQ ID NO: 501523 - DNA, 376 bp, Homo sapiens
  misc_feature (195)..(195): n is a, c, g, or t
  misc_feature (224)..(225): n is a, c, g, or t
ggggtgggtcccaaaaaccccaaaaatttttttgggggccctgtggcagtttcttttccccgggtgggaaaaaccccaaaatccagtggggggttggggaaggagccttggataaaaggtttcagggggggggtgtcccaggaaaggtaagggccccttttggggccccgcccttttttttaacccatggggtanttaaagtaaggagaccagggaatgtcaanntgggttttttaaacccaaaaccccccaattttttccctgaaaagggggggctcctgttttaaaattttaaaaggggggggttccaaaaaaaatttggggttttaaaggaagggttttttggcattaaaaaaaaaaaaggttttggaaccca

SEQ ID NO: 501524 - DNA, 325 bp, Homo sapiens
  misc_feature (188)..(188): n is a, c, g, or t
attcgcgggcgcgtcgacatggtggttcacgcctatagtcttagcactttgggaggccgagatggtcagattgcttgagctcaggaattcaataccagcctgggcaatatggtgagacccccatctctactaaaaatacagaaaaatagctgggtgcggtggtgcatgcctatggtcccagctactanggaggctgaggtgggaggatcgcttgagactggggtggtggaggttgtaatgagccgtgattattaccactggactccagcctgggtgacagaacgagaacctgtcttaaaaaaatgaaatcattaaataggtctac

SEQ ID NO: 501525 - DNA, 658 bp, Homo sapiens
aggccggtgaaggatcacggagggcagagaactatggaggcagagcagaagtggtgatgcaagatgtttgcccgcaacctccgagatgatccggtaagatatcctctgcgcgtgtcttgacaacgagccctgtttcccagcaacgtgtatctgtacctgtacacactgtggggagacttatacagctgggccaagggagtcagacgtctaagaacaatagatgtcgcttttcccgtgctcatgtaacattgtgttgcacgtattcatgggcgtagagctgttaagagtgggcttctccaggcaggctcgagcagccagtgacatttcccaagaagatgaagaatggtgactgtgtatttgattgaaggaattcaactgaagaataatgtttaaaatgtgtatatagagatagtatagactcctccgcggaagcatggagggaacaggaggttgtaaaatagactccatggagactcttaggaagcagtagattcccgggggctgtgcctttagcgttagaggaaaccacatagacgctggacactgtcacatggacaaaggcagtccacagcgttgagtttacggagacccaagacaattaacatacaattgcacttactggttacctcgtaacatggtatcttctctctggaaatta

SEQ ID NO: 501526 - DNA, 543 bp, Homo sapiens
agcggggtctcattgaactcgcctgcaggtcttgggtattagtggcttccttcgttatgggagccggtctacatcccagacaaccatgtccaagggacctgcagttggtattgatcttggcaccacctactcttgtgtgggtgttttccatgcaacggagaatagtcgagataattgccgaatgatcagggtaaaccgaacgcactcctaagcgtatgtctgctctttacgggacactgtaagcggttgactcggtgatgccgctagaagaatcagagttggcaatggaaccccaatcatacgacagtgttgtcgatgccaaaacgtctgattggacagcagagtttgatcgatgcatgtcgtccacgtctggatgatgaaagcattaggcccctttactggatggctgaactgactgcatgccgagtgtccaatgggtcgcagacgtagaactacagatgggacgacgagccaatacacgcttgatagtccgagataggcaggtgtgcttctgatggattctggacgagaagatggaatgtg

SEQ ID NO: 501527 - DNA, 503 bp, Homo sapiens
gcaacatggagaaaccttgtctctattaaacgtacaaaaaattacaggccgggcgtggtggctcatgcctgtaatcccagcactctgggaggccgaggggggtgaatcacctgctgccaggagtccgagaccagcctggccaacatggcgaaaccccacatctactaaaaatataaaaaatcagctgggtgtggtggcacatacatgtagtcccagctactcgggaggctgaggcgggagaatcacttggacctgggaggcggaggctgcagtgagctgagatggcgccattacactccagcgtggacaacaagagcgaaacgccatctcaagaaataaaaaaaaaatgctgaaaaattatctcatttaatccttttgaaagctcagggagtataaatacaacaattactcccattttatagatgaggaattgaaacttagggtaagggatcttcccaagatttctcagcaagtggatagcagagctgggatttcaaccaggt

SEQ ID NO: 501528 - DNA, 202 bp, Homo sapiens
tacgtctagtgttggctagggaactgtggtgggcctgaaaagctgagagataccaggaacagcagaaccctattgtcctcagtgtggcgaggtgggggaggcactgtttcggggggcactgtttttgggccaaattgtgttatagctctttcaggtctcacttacccatgctctgtgcttgcagactcctgtggctagatcc

SEQ ID NO: 501529 - DNA, 525 bp, Homo sapiens
gtacgatatccgctctccagaccgtgcagtctgctggcgtctgccactacctggattccgatgcaaggttgtgaagacgtggctgaacctagtgaggcagcacggatctcggatggacgcaacgcgcaatgcaagaagtcgctaatcaatgtggcatggacccacaaatgaaaagccactgttagttccactcgcgcaatgggctccaatctagcattcgactcgtccggagaacgctcgacgtactaaggcttcaaggattgtaatggattgattttaaaggaggtataaccatttatggcttgcgaaatgcagagggactcaacgagcttgcaacgagcattggtttgcgtatgttggaggaatgaacgcactttccctgcaaagagcggcacttgaagcgtcctcagaagaggaactggcagacaggatcgttgatgagtctgggatctgtgttcgcgtgggggatgccaggcagctacttggataccgtagcctagatgccggtagacgagctgcagtgca

SEQ ID NO: 501530 - DNA, 418 bp, Homo sapiens
cgtcgacaagacaagaggctataaaagggcatccgattccctagacctggagttacagatggctgtgagccatcatgtgggtgctgaatctggtcctgcctaggcagtggatacatcaacgtatacgcctagttcctcttctgttgggttctcccattaggatctttcctgccaaaatctagtctcaatgctatgagagtcccaaactacctggaaaggccatatataggtgtgtgctcattgacagactcgatggtctcccaacccgcagcagcagcagcagcagcagcagcagcagcagcagcagcagcagcagcagcagcagcagcagcacaagcagtcagcctggcaagtaacttagaagggaccctgttgtagctgtctcatatgaggctatgccagtgcctggcgtcgacgc

SEQ ID NO: 501531 - DNA, 395 bp, Homo sapiens
ggccaagtccacgtgttgcaaagtagaaaaatctttgtgggcccaaaggaatccctctatttggtgactcattatgcccgcccactccgctcccccgttcccctcatcaaggggaatgataccattcagatttatttggaggctggccagatttctgatttcatcaagttcgaccctggtaacctgtgtatggtgactggaggtgctaacctaggaaaaattggtgtgatcccccacaaaaaaaggccccctgggtttttttacgtggttcccgtgaaaaaagccaatggcaacagctttgcccctcgactttcccacctttttgtttttggcaagggccaccaaccctggattttttttcccccaggaaaggggatccccctccccctttttta

SEQ ID NO: 501532 - DNA, 103 bp, Homo sapiens
cctgatgtacgttattatgttacaggcaaactgggtacaggggctccgttgttgaagttgcagccaagcaaagatggggctgcagtcatcttagggcttgatt

SEQ ID NO: 501533 - DNA, 182 bp, Homo sapiens
ttacgcagttacgtgaaagaaatagagtattaattagcacagcagagcaaaatggcttggttggcttttcttgtcatctaaatctatggcttctggttctggtttatgcaggcatccaaataaaacttctctatggcatgaaaaaaaaaaaagggagtgaggaatcaggatccgaaatcggg

SEQ ID NO: 501534 - DNA, 579 bp, Homo sapiens
aaccacaaagttggtgaaggaaagttgttgattagagaattccaatctggttaaaagggtcaaaggaggccaggcgcggtggctcaagcctgtacagtcccagcactttggagaggccgaggcatggtggatcgtgaaggtcaggagatccagaccatcctggctaatacggtgaaaccccatctctactaacaaattacaaaacatattcgtgcgtggcgctggtggcatggcgccctgtattcccagctacttcaggatggctgagtgcaggagaatggcttgaacccgaggtgggcggagcttgctatgtagagccgtacgatcgcggccactgctagctccagtcctgtggtgacagacctgagactcgtgtctcgaaacaaaaaaccaaaaataacaatacactaaaagagtcaccagtgaaattgcatacgacattttggaaaaaactacacgcctcctttcaactctttcaccaaaagagtccacctgggactccacccgctgggctgcactaggcgaaattgggagtggttccaggaccacttcagggtgtacccaaaatgggaatagcga

SEQ ID NO: 501535 - DNA, 126 bp, Homo sapiens
attatggtgaatcatccgctatccttcgcgcccatggcgcccaatattctttagtctgcctcttcctacagctcgggtcgatggcctatattacgaatcatttctcttactcagcaaacctggaaa

SEQ ID NO: 501536 - DNA, 117 bp, Homo sapiens
actccgttgagcattataactgaacatggtcacaccacgaagtaaagtcagacctagagacacgagaacgctccgaaggctggattggcgtcatcgcgagatcattcagaaatggct

SEQ ID NO: 501537 - DNA, 873 bp, Homo sapiens
tcagggagccatcagcactctggtccagccctaagactgcttgtaaaatgaatatcaactgtaattgtatctgtctctagttataaactgataaaagaaagagtaccagacttatataattctagccatgcggttgacagttattactttttttttttttggggtacagataatcatgatttaggattaaaaattaagcgcaaccaattggggcacacttttatttggatgggtattcaaattggtggactagctggcaaataatggattggtaacaagaatttcacggtaaaattatcaaagtccttacgggcctgaaaacctcttagaaatcacaactatggtctcttatttagagaattccaggaaaatcaatggataaggcttaaaggttctcacaaataggtagtggaagggaaattacgtggtcagactatctctccattccagggggattctctaagaccacaggttcaagaaaccagagatttaggcatgaagtgacctcgtgctcataaccgggggagcagtgactcaagttacaacaccgtgacattacaacgggtggtgcttacatttcccaccagattagaactaacttattactcaatttaacgggtgtaagaggaaaaggaagagcacggtattgagagaacaagagtctgagccctggtcgccgaagagctgtgaaatgtgcaaggtgggcaagtagactcacgcgggacaccacagtggaacacctccgggacccccccggggtccaaagcggaattctaccggggccttcaagacctccccaaagataccgtcggcaactaccagcgcacccaacacaccagtgtccaagcaaataagaggcgattcaaggcacac

SEQ ID NO: 501538 - DNA, 363 bp, Homo sapiens
gtgttcttcaagagtgcataactttcctttttttctttttttggagacggagtctcactctattgccaaggctgggaatgcaatggtgcaatcttggctcactgcaacctccacctccccagttcaagcgattctcctgcctcagccgcctgagcagctgggactacaggcgtgcaccaccacccccagccaattttgtatttttagtagagacggggtcttgccatattggccaggctggtctcaaattcctggcctcaagtgatctccccaccctggcctcccaaagtgctgagattacaggcatgagccgcggcaccccactctccttatcatcttaattccaagttcttgaagaacact

SEQ ID NO: 501539 - DNA, 530 bp, Homo sapiens
  misc_feature (55)..(55): n is a, c, g, or t
tgtgctcccaggttccaaggggccaggttggaagccccagccaccccaatatgcngcaggccgccttcccactttcaggcagcttatgggaagcagggccccatttgtccctcggtcgccgtgtggccagagtgggtccgtcgtccccaacatttgtgctcgctcagacactttggcaggatgtttggggcctcaccagcaggagggggtgcaagccgggcagggggtccacttagacccacagcccctcgggggccccccccctttgggtgtgaggtagctttttctccctcagcctgcaagggtccgatttgccattgaaaaagaccacctctactccttttttttgtattttgcaaacccctgaagcgggagctgttaaatttatcttggggaaccctcagaacgggtctattgggggtcggggaccctcttacggctttcaaaacacgattagtaaccaactgtttggtatacttgttttcagttttcatttcgacaaccaagcccggtaattaaagcgattagaa

SEQ ID NO: 501540 - DNA, 117 bp, Homo sapiens
gacgtccgctggtatgttgcaaatagtgggaagataagtttagcatggagtaggtttaggttatgtacgtagtctaggccatatgtgtggagatgagactagtaggggtaggctacg

SEQ ID NO: 501541 - DNA, 236 bp, Homo sapiens
  misc_feature (36)..(36): n is a, c, g, or t
  misc_feature (61)..(61): n is a, c, g, or t
  misc_feature (108)..(108): n is a, c, g, or t
  misc_feature (131)..(131): n is a, c, g, or t
  misc_feature (181)..(181): n is a, c, g, or t
  misc_feature (200)..(200): n is a, c, g, or t
  misc_feature (222)..(222): n is a, c, g, or t
agagccccaggacccggcagcggggcaggtgggagnccagctcttggggagctgccggganccgcggcttctggcagggccgcttgtgctgtctgcgccctccgcttngtcccctcctgcgcctgcctccncacccccacgccgcgtcgccagaatttcctcagccgccaggattttcctntccgccagccgcctcttcnccacgcacagggagctctgggngcacacggtctggc

SEQ ID NO: 501542 - DNA, 112 bp, Homo sapiens
ataatgtgtgccctatccccagatgtaatttaaaaactgaatagaaactaagagaggaaaaatttcaaagtacggcgcagcttgagtgatctctagcgaaatgcatgctctt

SEQ ID NO: 501543 - DNA, 224 bp, Homo sapiens
cttttgctttggcccattggaaaatggaaatttaaggagagaagaaaaaaaaccccgatgccctttaaacatggaaagaattttttttatgattaaaatatatttagcttttccaagccccagactgaataaaagggctctttttatgctttttggagatggttctgtttaatgtctttttacctcagggttaataaatttgtaatgacctttgatgggtttga

SEQ ID NO: 501544 - DNA, 285 bp, Homo sapiens
gaagttggagcagaggcttaaaacacaggctgctgaagttttttggaatgctggtcgtaacacgttcgtagagttaacgttttttttttttccccagaagtaggtcccccgttaaggagcgtcagtgcagaggacccaaaaaaaggtttctgcagtataaagcagcacagcctctctaacagccagcaatgagggtgcccacagctttgtcacacggtcggcgcaggcgcctaaaagagtgccgatccacggcctaaagggccccagagggacggggtaagggaa

SEQ ID NO: 501545 - DNA, 159 bp, Homo sapiens
tgcgcacggacgtggctcgagtttccttgcttccgcttcgcccgctagctctcctcccttccgctcctgcttcttccgggttcccgctccagctccagccccacccggccgtcccgcacggctccgggagccatggaggacccacgctcatattgtcga

SEQ ID NO: 501546 - DNA, 409 bp, Homo sapiens
  misc_feature (336)..(336): n is a, c, g, or t
gcaaattgcttttactttctcaaggtcttaatttaattgtgctttcaacttggcagtgttgtatattttataagctccactaaagaacacatctacacattatgacatagcacgttcttggaaacttgacagaactgttgacaagtacagattggtttttggttactgtgagtattttttgtgctaattgaactgttgttagttcttggtagctttatgtgcttgtcagtctgttttcttcataagtgatgattaatttaaatctgtgtgatgtgttccagttcacttacttgatgggaaattgggaggaagtgcatagctttctggatattcttnaattactgggttcccattaagtgacgggagaggcaaatatttatgtctcagggtattgttggtattggatttc

SEQ ID NO: 501547 - DNA, 312 bp, Homo sapiens
  misc_feature (156)..(156): n is a, c, g, or t
ccaagatcgtgcccactgcactccagcctgggtgacagagcgagaccccgtctcaaaaaataagaaaacatgactgagaaatggaagatacagaaaagaagcaagttggacaaaatgtcactggaactaatctcccaagtagaagaattccacatngtttactgagatagttccccttcgaggaggtgatgcttaactcctcactccagaagcctgggctttacctagtgaccctcttccaaagagcagagcacagagcaggaggagcagctttccagtggagacctccagcaacacagcctcaccagggac

SEQ ID NO: 501548 - DNA, 309 bp, Homo sapiens
ccgctgatagcctccaggtgctcagtatccttaactgttacatggggataataataggacctacctcacagcgctttcattagaattaatttatgatacgtaaaacactaagaatggtgtaagcagtgctgggcacctataatcctagtgctttgggagaccaaagcgggaggatggcttgaggtcaggagtctgagaccaggctaggcaacaacactacaagaccctgtctctaaaaataaaaaataaaaaattagccaggcgtggtggcatgcatctgtagtcccagctgctcaggaggcagaggtg

SEQ ID NO: 501549 - DNA, 279 bp, Homo sapiens
atttgactttcagcatggcccacgctttttaaaggccctatggagaaaatttataaggggcggggaacacaggtatggtaaacccttcccacctcccacttccatcaaatctcaagaaatcctcctgcttcaaaacataaacaatctcacaggatttttattggaccataagggggaaaggaaaactgtcttcctatcctttttgatactaacagttttacggaattcgtttccactttctgtcaaaaaaccacgtatgttgctgatatggattctcaa

SEQ ID NO: 501550 - DNA, 639 bp, Homo sapiens
  misc_feature (11)..(11): n is a, c, g, or t
  misc_feature (88)..(88): n is a, c, g, or t
cacctgccccnggttttggcccccctgttccgccctccgaaaggggagagggttcctgccaacccacgccggccttcccattaatttnagtgggtccttgggggtcagtcccaggtcaggggggttgtgtatttctggcagttgagggccatccctgcccgggaagcaaaaagacagagcatcctgttctccccccaagtttaaaggtcccggtccatttcttggagggggacaaatggcctggaaacctttggttaattgggccatccgtaaagggggaaccttccttaggggtccttgggccccccccaagggttgggcctttttccaaaaaaaagggccccaaaaccaaaggaaaggggggttggaaaaatcccccccaggtttgggggccccaggggggccccaaaatggggtttttttttgggcccccaaggggggccccaaaccagttttttttggagtccaggcctggccccgggaacacaggggaaaggggggggtttttataaacttaacttaggggttaaaaaatttttttggggtcccttgtcaaaaggggccccttttggggggaaggggaggggggggggttccccccctgggggtttttgaaaaaaaggggggggtttttcctga

SEQ ID NO: 501551 - DNA, 1800 bp, Homo sapiens
  misc_feature (1661)..(1661): n is a, c, g, or t
agcgccacgcgctgatcagcgcaggaaacatgatatgcagcgtagaagtggtcgaaggaatgtcagcacttacgataaaggcaacaaaggtgcataacaagcacgcacgcacacgcagtcagcactgccgtgccaaaggtctcgtgcgtatgcgcacaatgagcttggaacaagactcgcgtagaggaggccgaacgttgcctgagagcgagtcgtctctgtgcgatcctagaggcgggaatcgccatcaccgcgaacgccggttcagagggaacttgtgcaaaactggccgcaagggtgggcataccccaatctggctggccgtttggcaggcgacttacgtagggagcgtgtctactcccgtaacccatcgccataccgtccggatcaccacaccttagacgagacgtcgccttgttgcccggtccgtgccctcttccggtccgcctacgtgcagtgagctttcgtaagccatagagactctagtgggtggccggtcacttcgtggttagccctgggtgtcctccgtaggttgtcggggcacggcaccgggttgggcaggttaacttttgtacggtggatatcccttgccataaggagcgccactagcgggtcaatgttgggttcgggttccctacctcggtttgtgggttcctcactcgcagtggcgtgtcgacaacccggaattctcagcaaagacacagccggaccaagggttaaaatacaatttcctgaggatcccttgttaatattaagtcggcctagcgcctaagtttgccacgaaaggacccgtgcgttcggcgcatcgcgtgggcaccaacggccattccgtccaccggcgtgggccccggtggcaaccacaatagctccgctttgcaggggcctttggttgcctaagaaggttggaatcccaacactgggataacttacgcttaggttaacgctggggtaacataacaccgtgtgacttcggattgtaccctggttacccggatagggtgggcgtaacacttccggcgccggacggggagcttatgaggattatggaaacccgaggggaccacacaacataagacgttaggaaatccaccacataatccaacaaccatttggtgaccacaaacaaccaagaggacacagtggggcacgcttagtccccacatttttgaggctggttcccaaggcacgtggtgtcaacctcctaaaacttccggcgttcggaaacaacgcgaagctgtcaccaaaggcggcccacccagaaggacagataatatagaaccccggtcgccgggtggccccaataaccttgagcgccccccgggtggcgaactacatgttccaggggcgccaggtgttggggtctctacagccatccaggggagctcttccccacaccaagtgtgtgggccattctcgtgctcaaacagcacccttgtgtgcgcccgttggcaactgctcctctggaaacagcgggaaaacacacaccgcaacctcggggaagccgcgaccacccgggggtatcccaggaggcgttaacaaaatgaaaaacaagcggccatcagcggtaacccggtgtagatggtgggcaggcgcccgctaacaaacacgaccatccccttgtgcacaacaggttgcgcctgccgcaatagtaacactggcgngttgagcgccacacccctggttagcgcgaaacaagctgagcccgggcccccactgtgcagcaaagcagcccctcacgtgccatgaggtcgctacggccgcacgggccactcctaccacgagacggctagataccactca

SEQ ID NO: 501552 - DNA, 289 bp, Homo sapiens
  misc_feature (99)..(99): n is a, c, g, or t
  misc_feature (210)..(210): n is a, c, g, or t
acagaattctaggcagtactgctgtctgttctataaattggatgtaaggagaaggctgatttataattcaacaaactcccaaattaggcatcccttttncccccttgctgggatttaaggaggatttttttctaataactagccaccttattcttgatcattcaaaatctgggtgagaattttcttaaaagtcttagacagatatatttnaaacgtaattctatattgggaacataagtgattatgccacacataggcataaacaatgctttcatgagttcaattatac

SEQ ID NO: 501553 - DNA, 308 bp, Homo sapiens
cccatattagtgtcagtcatctccctgaatgcacttcttcctgtgcacatccacatagtcaacgactaccacatctctcagaatcttctcgtcaccatcagtaacaacgctgccattcagtttggaaactgatggcaatctggctattaccaattaccttcgctcctcggtggtatatggctgcagaagaggacttcctaacaatctcacttcttccagtattgagacactgaatttacgttatcactgtcttcccaggactgcgaaaactgactatgtggcggctgatgcatcggaagatacggaca

SEQ ID NO: 501554 - DNA, 158 bp, Homo sapiens
agttgctgggactaatccagctctcagtctcgcaagttactgaatctctctctcccccatttactcatgcgtacaatggggaaactaacggcacgctcctccagtgccatcagtagggccaagtgagttaacgctgcagagtagcaggactaggggcc

SEQ ID NO: 501555 - DNA, 344 bp, Homo sapiens
gcttatttaaagcgtcagggagaggatgtgcacacagatgtcactgaggtttcgtgaacgcctgtgggagagcagatgcagcgggggggattcaggcagtggccactgattcgtgggctcgccttaccaacaattaccgggagaagaagatagtacacagagccaagagggctgtgtaaatcacaggaatttagcgggattagcacaagtattcctagggtaaacaccaaggcggcccaggggtccctaggcagcccacttttcacttcccaaaagctcatcttgaggccagggcccccgttcaagcccctggcaggccaaaggcggataagtcttcaattctg

SEQ ID NO: 501556 - DNA, 128 bp, Homo sapiens
tcccttctctttatgttagtgtcataatttctcatcaatctccacagtgattgtttagaggttagtgggattagtcatggtggggtggtgattagtcggtgggtgatgagatattgggaggtggggat

SEQ ID NO: 501557 - DNA, 2055 bp, Homo sapiens
  misc_feature (260)..(260): n is a, c, g, or t
  misc_feature (1760)..(1760): n is a, c, g, or t
ggtgcctgcctttcctgtgcctgctgcccctgtattcccatgtgactgaatgtggcactcctgcacctggacccctgtgtccctgtgctgctgctggctgtgtggcactgctgcccatccctgctgctgctgctgtgtgtgcttgctgttgtgatgtgtgtgtgtgtgtgctgtgctcctgcctgtgcttgtgtgtgaccatgtgctgtgtgtgtgacgctgtgcgtagtcctgatgtgcgcaagcctgatgtgtgctcncttgctgtgcttgctttgcgctgtactctgttgcgcgtgctcattgtgtgcctgtggtgactttccagttgagccattaagcgagtggggctgtttcagaggatcgcataccagtcgcccaagccattgagtttgtggataagagcatattcatggcagcgccacaagtttatggtgcacttaccgttccagggacccagagtgacgacccgatttagccaatcacagagagttggtcctttgggaaaccccatatggcttgatgatattcccgactccgtctagttagcatttggatcgcccagtgtgtgagtttataagccgccaggttgtgggcgcaagaggaagaagcgagccaatgtttcaagtttcgagcggctgaggggggtcgtaacaggacagctgtacaagcggctatgtggtaccttccgaagcgtggaaccatggtgattcatgttaagagacgcccgccgagggcccattaccgaacgtggttttatacgcggcttaacgttatcaatggcttttggtgggtggttttggaacagcacaaagagagtgtccgccgagaagctctggccctttatttggtatggttatggcaaacattatcccttttggcagattattaccgaagccgcagcaggtgtgggacgttcacgtgtgggaaacaattgcactgcgcgcctggaagccgagatttccatggcgaacagcgtggcaattccacgagaagaagacaagatgcgacatggaaagacgtgcggttccgcggcctatgtaagttttggaacaagccgttggccttttgttagtagcaccccatggctgccagaccaacagatgggccccgcgagtggatatttaaattacaccccctggtttgatgattgggtggattaacagagacgttattattatatccgtatattggggagccgaacgagcaggttccgccagtttgcgcctgtctttcaggcgagagaatgcgccatccgacaataatcactgtggtgggttccagactggcaagacgtggtggaaattcccttggattggagattgtggcccggcaccgcagaggagagttattttacaacgcatgggtgggttacacttcgctgataacattctcacgaggggataacacccgttttggatacgagctcaagcttcagtagaagcagacaaagttccacaaacgagagcacgataatcagccaccattatgaactatggtcgaacacccccgatttttacaatgttgtggtagatcacccgagaccaggtggggtgaagaagatgagagataatcaacggattggagatacgcacgtaatcccctgccttattgacgatgaccattctcagacacggcatttctagatggaagaagagagagccttttgaaatgaattaacagcgccgggtagttattgtgtaccacaaggatgactttgattacagcacgggagaccacccaaagagactcaaagacantaagctttacacgccacataagtccagttgtgtgtcatgtcagagagcgtttcattgtccccgagactcagtatgtcgtagttggcaccagatctgagttacccagtaagtgtaccccagaagtgccccaatagaacacggtgtcagcaggactactgtcgttggtagcccacgatggagcgaccttacagcaaaggttgagtcctctctagtaaggtggtccaacagatactgagcagatgggagagttcctagactgccgtttgaagtggtcgtggagggcggcagcaggcat

SEQ ID NO: 501558 - DNA, 252 bp, Homo sapiens
cgtcccgctgtatcttgatgatcgtcgacctgtgctgtccgtggactgagtctagtggccctgttagataactcatggctgcggtcgatatgtcatggcactgtccgccttgtatgatccggccaacttttcttcagcatctgcattactgcttctgagcttcttgtgcgatttggtaaccacggagatgggggtcatgtggggtcgagccacggatacaacggtcttgtgtctagcattccacgtagtaca

SEQ ID NO: 501559 - DNA, 304 bp, Homo sapiens
tcttctcccctgacacatttgggagcactgtaatcccagctacttaggaggctgaggcaggtagaatcgcttgaacccgtggagcagagggaggtagaggttacagtgagccgaggtagcaccactgcacttcacttcagcctgggtggctgaacaagactctgtctcagaaaaaaagagtctgggtcggtggtggtaggacagagtaaggagacagagtctctcacagggttccaaatcaggtgacctggaagatgacgagttgtcgactgggaaagagattccacactgtcaggggagaaga

SEQ ID NO: 501560 - DNA, 468 bp, Homo sapiens
  misc_feature (103)..(103): n is a, c, g, or t
  misc_feature (145)..(145): n is a, c, g, or t
  misc_feature (149)..(149): n is a, c, g, or t
  misc_feature (158)..(158): n is a, c, g, or t
  misc_feature (160)..(160): n is a, c, g, or t
  misc_feature (229)..(230): n is a, c, g, or t
  misc_feature (256)..(256): n is a, c, g, or t
  misc_feature (299)..(299): n is a, c, g, or t
  misc_feature (411)..(411): n is a, c, g, or t
  misc_feature (467)..(467): n is a, c, g, or t
gattcggcactaggaggctagccctgagtcaccaccacctgcgtccccggacggtcgtcactgagatccgaggcctgctggccaaaggtctgcggcctgaganccccccaccagccggccccctgctcaacggggcccccgctgngacnagtccccanantaaggccgcccccgaggcctcctcgccgcctgcctcacccctccagcatctcctagtctggaaaggtgnngtaccttgggccccccaagcccagcnaccaggagactggagagcaggtgtccagccccaagcaagacancccgccctccacaccaccaccgaggacaagtgcaggggtgcagactgagttctaaggccaagtgggtccctgactggctgcaacatggcacaattccgttcccttccggganccaggcaaggctcagctctgggggagggcaacctggtcttgtgccttgttgggttng

SEQ ID NO: 501561 - DNA, 497 bp, Homo sapiens
gcgttcagaggattcccgtccagtaaggtgtgccaggtattggctatgcctagtttatggagggtgtctatcatgaagggatgtcgggttttatcaaaagctttcttgcgtctatgaggtgaacatatgggtgtggtttttaattctgtttatttgatgaatcacatttattgatttgtgtacatggaaccaaccttgcatcccagaataaagcctacttgatcatggtgaattaactttggatgtgcacatggatttggttagtgttttgttgtgtgttttggcatcaatattctttaggaatatggtcctatagttttcttttttcatggtgtcttggccagctttgggtatcagggtgacactggcttcatagaatgagttagggggaagtcccttttggatttttgggaataatttcagtagaatgggtaccagcttttctgtgtgtgtctggtagaattcagctgtgaatcaatctggtcgcgggctttttg

SEQ ID NO: 501562 - DNA, 209 bp, Homo sapiens
ccccggagcagttcgtatgttgctcaggtgagtgagtggtattcaaggcgcgatccactatgatcagcacggatttgactgctcgtttcgacctgggcggttcaccctccttaagcaacctggtgtccccgctctcgggaggtcaccatattgatgccgaacttagtgcggacacccgatcggcatagcgcactacagcccagaactcc

SEQ ID NO: 501563 - DNA, 823 bp, Homo sapiens
ggctagtacgaggccgggtggttaatgggcgaggggatgttttgctttagctagggcagtgacataagaattccatgttagataagcatatgttacttaccttgtaattaaatatttcttgataagcaattttaatggtttaatttctatgtggacgtatgttaaattttccaacctaccctatgttaagcattcggttttaaaatttttatgctgaatataaatgctcaagtaagtttacacaagtattgaacagcatccctgctcggtatcaatttctgtagtaaatgcattggatcagttggactttgaacgcctttggacaatggctttgctaaaatgctcccgccacgaacagttgtaggaccatgggacacgcaggagtcacactagcaggcaagggagttgcagagagctgcaactgtaaagggcgaagaacaggcagaggtaacaaagatgatggaaggtgtggtgactaagggccacggttattgggtgaaatttgagattgtaggccaagctgtattttcaacgcttctgaacttaggcaaaatattcatcgcaaagtctctagcgtcatatttttctcacccaaattacgtttccacgagattatttatatatgagttggtctatctctgcagtccttgaaggtgaagttgtcgtgtaactaggctgtgtttagggatgtcacgcagatggcctgaagtgagttgtgcaataaatgttaagttgaaacctcaggaaaaatgactaaaaaactcccagggaattatggccgagtcgggagaaccccggtattgcacaggggcctgggccctag

SEQ ID NO: 501564 - DNA, 152 bp, Homo sapiens
tccgaacttggaataacctacaatataacttcagagatgaccgaaaatcacaatacgtgattggtatagaatggggtctcctcctccggcggggtcgaataaggtggtgttgaggttgcggtctgttagtaatatagtgatgccagcagcta

SEQ ID NO: 501565 - DNA, 123 bp, Homo sapiens
ggctgattgctgcggctctgcttttttcccaccagcagccacactaagcgagcccccagttgaggggaggttcgactactgttcgtgtcggctcgcttcagtgtgatctcttctgatggaggt

SEQ ID NO: 501566 - DNA, 142 bp, Homo sapiens
catctcaggctgtctctaaattttacaagtactatatctactggtaatactgcaggtgtgatccaatctgtgcttttgtaaaagagagggttgcttcattatacagaagaaactttagaactcaggaaattccagtgactgc

SEQ ID NO: 501567 - DNA, 119 bp, Homo sapiens
aggaagggccctgctgacagaggacggagacaagagctgcatggagggcttaaggaactctacaaaaggccaggatggctgctacagaactccctccagtcagttctccatgtattagc

SEQ ID NO: 501568 - DNA, 182 bp, Homo sapiens
atttggggccccccttttgcttttctcccccttttattattaaatgcttcccccaaatgaaaaatatgtctggacccatatgttattatacagggtcataaaaataatcaaatacccgcccccccagttttttttctgtattatcaaagtctggtttaaataaactatatagttcccattga

SEQ ID NO: 501569 - DNA, 1463 bp, Homo sapiens
  misc_feature (9)..(9): n is a, c, g, or t
  misc_feature (783)..(783): n is a, c, g, or t
  misc_feature (801)..(801): n is a, c, g, or t
  misc_feature (829)..(829): n is a, c, g, or t
acgccaccntgtcgaacgcgacacgacagcacttgccgcgacggcacggcgacacgcagcccgagaaatttgtttgatcatcgccgggtaattattagtctgtcttgtttcagtgactccctgctcgttgaggttgcttctccgtagtggggtggcgatatagtgatccacgtgtgtttggtttcccctatacgacacatccgttcttgtgctgattttgtatcgcctttggtaacaagtctcgctgtttttatctccggcggtaacctatcatggggcgaccattctacgaaatggtttctcccccccgtctgcggggggcacgccagtggttttccccacttggggaaacaaggtttgttcgccacagcacaccggtttatatccggggttccacattttggggggaaaccccttttgccccgcggaggtttttctgggccaatttttggcggccatctacttcccctcgcgtggtgtgggggaaaagtctattgtcgcgatgatatactcctgtgccctgtacccctgtgccgggggcccccttcgtagtttacgtctcattgaaagggggagctgggacccagattggttccatttaacccctcccatccagagtcacatgggtttttcacacagggagtgaaggatttggattctcggggttaaacactccacgggaaagggaatttttagggaaacgaaatgtttgggccccacccgctcctgctgtttgatatcccaactcggagttttataggtgaggataaacaatatctcggnggaactaatatagaaagnctccttttctcgccttgcctctctcgtngggaggaagatgtagctataacgctggtgtccccgcggggaaagaacgcctctccctcgctcgtggtggacctcgcaccgcacccccacctgcctgttcctctcaggcaccctcttatggccgcacattgtgatgccccgtggcgttaacacacacacttgcctctaatgtcacataactatgcacattggttcactgagcccacacacacacataacacacgttcactatagagaagaaaaaatatatttggtggcgtttctcttgtctcgagtgtcttctatagtgggagattcttctttgagctcgctcgttagtgtacttaaagtggtgacttaatagggttactcaagttttaatagcctcggccctatttccctcttataataataatattttttaagaggccttagagtggctcttttagcccttgttttaaaactcccatttatgattgaccatattgtgtaccctgatacttttaatctcagaagcgtttagccttgaaattgtgaactttttgggaatagtttatttagtcgaagttccgccaacttgaacttaaacctgtgaaatttatgatggattgtattccaaagattaatggaaaatacaaccattttgtccccctgga

SEQ ID NO: 501570 - DNA, 164 bp, Homo sapiens
gtaggttattgccatggaagatagcccatgtggcagctgtaacatcaccacagatgattagggtttgccgagaaggcaggcagtcggtgggttctgctgtttgtgacgtcccatacaagtaaagccttttcgatgaacgtttattaaaatgcccggtcccaata

SEQ ID NO: 501571 - DNA, 201 bp, Homo sapiens
agaaaaaaaaaaaaaaaaaaaaaaattttccacccccccacccctaagaaaaaacggggtttttaaaaattcccccctccctttttcccctccccccaggactggcccatttttgggggggccagtgggtcccaaattggttccccctaaaaaggtaaaaactccaaacaaaatttttattaaattaaatttgggttctca

SEQ ID NO: 501572 - DNA, 443 bp, Homo sapiens
  misc_feature (443)..(443): n is a, c, g, or t
taagctaactgtataatcatcgtatgatactttgatatcgctaatgtagagaaccacactttatataaagtagttttggcatttgtttattgaatgatgcatcttcttcggtgaaagtattgcatatgcataaatggccaaaggaacagcaaataatatatatttaacatgtcattgagcaatcattttctcaactagtcgtaccctcgtctctactggaacgaacatattgccaggtactatacagaccacgatttgtctaaagtggcatattcagaacttccggtactttctgtacaataggttaaaaataacactttctccctgggagcgttaacacctttaacgcgaaacaatttaaacgttattatcatgcaatgggcaacaagactcggtgtgaacagtggattggtcatggaatcacccagaagatcatagtatan

SEQ ID NO: 501573 - DNA, 331 bp, Homo sapiens
tgaaaaaataatccagagctgagaaaacgtctgcatttgcagagaatgaaagtatttaaataagacccagatgggccgggcgcagtggctcatgcctgtaatacccaacactttgggaggttgaggtgggcagattgcttgagcccagtagtttgagagcagactgggcaacatagctaaaccccatctctacaaaaagtacaaaaattagctgggcgtggtggtgtgtacctgtggtcccagctactctggaggctgaggtgggaggattgcctgcgctcaggaggccgaggttgcagtgagctgagatcacaccactgcactccagcac

SEQ ID NO: 501574 - DNA, 448 bp, Homo sapiens
actgggaagtatacattttatttaacattccattaatacgccatatttacatatataaatgaatgaagccttaatataaaatagaaaaattgcctggactgaaacaatcactccatatggagttactttacttattgaagaccttctgtttacataaaaatttacaataatttacataaattattttcttccaaactagatatctaataatccacactattctgatgactttacaaataggtgtgcattaaaatcttcccaagaaattacagcatttgtctgcgtaaaatttgctttggattggaagacagattctttctgtcacatttcacacacctgttcctgtcacttctgtagcagttctaggttagatattgactccgtcagctgggctatcctagggggaaaacatccgaatttctatgggaggaggtgaccaagcactctc

SEQ ID NO: 501575 - DNA, 282 bp, Homo sapiens
acgaggtccccagagtctgaaatatagaaagagagaaaatggacagtgagatcacaaggaataggaccaaggctcttgtaagaggatagtagcgtaaacagagagacgtaatcgtgaagcactacccccaaagcttgcctacaggaaagtgaacggagtatctaggtagtagatccccacccaatttcaatgcttacatataagctgtactatcgtgatggatattttggaattctgaatgaccagtgtacagacttcacatcctatattcaacgcccccga

SEQ ID NO: 501576 - DNA, 436 bp, Homo sapiens
aaattcaggaacgatgggaaaaaaaaaaaaagattgctaaacgtgaactaccatatcacccagcaattgcactcttgggcatttatccagagaaatggaaacttatgttcacactaaaacctggacttggaaatttatatcagttttattcataatagccaaaaactagaaacagcctagatttccttcagcagacgagtggctgagtaaactgggtgcatccacgtcacgggatgtggctccacaaagaaatggaagaaactagaactctgatgactctctagggaattttgctgagttaaaacaaccccaaaaggtctcatactatgtgattctctgtatataacattctggaaatgacgaaattgtggaaacggagaacaggtgagtggttgctggcgtttcccgacacagagaggggtgtggttattaaaag

SEQ ID NO: 501577 - DNA, 332 bp, Homo sapiens
gagaccacactgaggatagaacgcgccacactacaaaacaaacgttgatctcatcctgacacactgacttcttacagaaccttctgagactccaggaactctcggaacttagcatatacccaccagctattacaactatactcaagctcaatgtccgggccactagatacatagataccagagcgcacaaagctgaagtgcacggcagttccggaccatcctatatcacagtgcacccagcatataatcaggtcctattacttagactcgactgtacaacaaactcaaggggtgggagtgtagggcagctggcaaaaagtagcaggtaaaac

SEQ ID NO: 501578 - DNA, 96 bp, Homo sapiens
tgatagaattgagctggtaccaatgaggcggagttgctcattgcctgggtttgtcggcatgtgtaatcgtgcaaataaacgctcactccgagaaag

SEQ ID NO: 501579 - DNA, 470 bp, Homo sapiens
  misc_feature (40)..(40): n is a, c, g, or t
  misc_feature (73)..(73): n is a, c, g, or t
  misc_feature (95)..(95): n is a, c, g, or t
  misc_feature (119)..(119): n is a, c, g, or t
  misc_feature (130)..(130): n is a, c, g, or t
  misc_feature (172)..(172): n is a, c, g, or t
  misc_feature (193)..(193): n is a, c, g, or t
  misc_feature (221)..(221): n is a, c, g, or t
  misc_feature (232)..(232): n is a, c, g, or t
  misc_feature (275)..(275): n is a, c, g, or t
  misc_feature (320)..(320): n is a, c, g, or t
  misc_feature (330)..(330): n is a, c, g, or t
  misc_feature (373)..(373): n is a, c, g, or t
  misc_feature (390)..(390): n is a, c, g, or t
  misc_feature (406)..(406): n is a, c, g, or t
ccatccacaaacttcatttttttatccctcttttctcttnttttcccatataccacaacctctcatccttttnccccactctccattattaaccncatctcatcatatcatttcctccncacatcaatcnctcctattattttttaactcatatactcttccttttcaattncacatatacctctattttccnccttttcatcataaatctctacacttcnctctttaaatncatatctcttcttatctacttcatttttttccctaatcctccntcccttctcaccaataacattcttttttcttttttctaatataantatttctttncttttttttttaactctcacctcaactccatattatccatctncatccatccccctattnataaactcattcattncatcttttaatattccatcatctacaaacttcctcttctttttatattttcacttccatctttc

SEQ ID NO: 501580 - DNA, 166 bp, Homo sapiens
agggagggagatgagtcaggtttgagctggtgagtaggatgggaaagtagagcaggagtggcagagagaagggtggttacggagaagtgaagagcgcctgaatataaggaatctcagaccattgtctcattgcgagtggcaagaagtagtctaagctctctaaggt

SEQ ID NO: 501581 - DNA, 926 bp, Homo sapiens
  misc_feature (44)..(44): n is a, c, g, or t
  misc_feature (137)..(137): n is a, c, g, or t
  misc_feature (147)..(147): n is a, c, g, or t
  misc_feature (175)..(175): n is a, c, g, or t
  misc_feature (178)..(178): n is a, c, g, or t
  misc_feature (192)..(192): n is a, c, g, or t
  misc_feature (292)..(292): n is a, c, g, or t
  misc_feature (304)..(304): n is a, c, g, or t
  misc_feature (313)..(313): n is a, c, g, or t
  misc_feature (359)..(359): n is a, c, g, or t
  misc_feature (361)..(361): n is a, c, g, or t
  misc_feature (370)..(370): n is a, c, g, or t
  misc_feature (384)..(384): n is a, c, g, or t
  misc_feature (390)..(390): n is a, c, g, or t
  misc_feature (392)..(392): n is a, c, g, or t
  misc_feature (394)..(394): n is a, c, g, or t
  misc_feature (397)..(397): n is a, c, g, or t
  misc_feature (402)..(402): n is a, c, g, or t
  misc_feature (411)..(411): n is a, c, g, or t
  misc_feature (417)..(417): n is a, c, g, or t
  misc_feature (427)..(427): n is a, c, g, or t
  misc_feature (430)..(430): n is a, c, g, or t
  misc_feature (434)..(434): n is a, c, g, or t
  misc_feature (440)..(440): n is a, c, g, or t
  misc_feature (445)..(445): n is a, c, g, or t
  misc_feature (484)..(484): n is a, c, g, or t
  misc_feature (492)..(492): n is a, c, g, or t
  misc_feature (503)..(503): n is a, c, g, or t
  misc_feature (519)..(519): n is a, c, g, or t
  misc_feature (539)..(539): n is a, c, g, or t
  misc_feature (544)..(544): n is a, c, g, or t
  misc_feature (568)..(568): n is a, c, g, or t
  misc_feature (663)..(663): n is a, c, g, or t
  misc_feature (683)..(683): n is a, c, g, or t
  misc_feature (693)..(693): n is a, c, g, or t
  misc_feature (697)..(697): n is a, c, g, or t
  misc_feature (728)..(728): n is a, c, g, or t
  misc_feature (734)..(734): n is a, c, g, or t
  misc_feature (753)..(753): n is a, c, g, or t
  misc_feature (755)..(755): n is a, c, g, or t
  misc_feature (762)..(762): n is a, c, g, or t
  misc_feature (769)..(769): n is a, c, g, or t
  misc_feature (773)..(773): n is a, c, g, or t
  misc_feature (775)..(775): n is a, c, g, or t
  misc_feature (782)..(782): n is a, c, g, or t
  misc_feature (785)..(785): n is a, c, g, or t
  misc_feature (794)..(794): n is a, c, g, or t
  misc_feature (797)..(797): n is a, c, g, or t
  misc_feature (803)..(803): n is a, c, g, or t
  misc_feature (807)..(808): n is a, c, g, or t
  misc_feature (816)..(816): n is a, c, g, or t
  misc_feature (818)..(818): n is a, c, g, or t
  misc_feature (828)..(828): n is a, c, g, or t
  misc_feature (833)..(833): n is a, c, g, or t
  misc_feature (847)..(847): n is a, c, g, or t
  misc_feature (849)..(849): n is a, c, g, or t
  misc_feature (860)..(861): n is a, c, g, or t
  misc_feature (888)..(888): n is a, c, g, or t
cccatgagcagcagagtcgagtgtaagagtgcaggatccagagnggggagaggctgggcggagttgggggcctggaggctggggcctggttacttggtgacgtgcagagctctctctggggggctgcagctcatctnggggggagcnggactcagatgcccccgtaggtgcaaangcnacatccacatctcnctcctcccggtgctttttgcggtattcctgcagcgctttctccgccacggtctccataaatttagggttcttcctggagacttctacagggaccgtcacngatgatgggatnagagtcaangagcttcacgaccacctcagtgacaccggaaggaacgtccgagtcngncgtgtgggncgcccccgtggtgncccgangntngtnctggncttagcctngcgtangagtttgccngcngggncacccngttanactgctcgttcagctgctccagccaggaggaggtgttgnacatcttncactggtaggnatatagcaactcgttntatttactgataaacctatnaacgncctggagggattcgtcgagctccncgccgaagcttagcctgggagagggtataattggaggaacagtacacagacaagaactcccggcactagtcaccctggtccttcatccgcaggcngaccgtggcgttgtggcggntctcccggcncccngtccggtcctcgtcgccttctcgtctgcctnctgttngcgggtgctggcaggccgngntgtggcngtggctntccntngcctgcngcncctcgtgtntcntctccnggcnnggctggcncntggcgtggcngtccnggggctcgtccggngngaagggcatcnngctgcggaccgatgcgggcattgggcnagcagaagtgcaggctccagtggggccggctgccgggc

SEQ ID NO: 501582 - DNA, 266 bp, Homo sapiens
tggcttccgttacatcttattctaactcaggtttacggacccaatgctggaaaaccaattcctgctttacccacgccttaacttgttaagaaaaaaccggatctaaccccgaggaatgtcccattttcgccattcccacttcctttctgccctaggcattcgatacgtgccaccaggggccatcaggactagggctttgcacccatggcagcagacaggtgtgaagctcggagtccctcctaacagccttccttttggcgtcttct

SEQ ID NO: 501583 - DNA, 792 bp, Homo sapiens
agcggttgggttgatgggttttttttctttactgtgtgtgtatgtacgggggagtatagctttatctgtgctcaattcgaaagagagtattataagttttcccagcacaatccccctttcgaagcgcccaacgagccagccccgccgtaccgcgcacccatagacgacggaccgcctgcacctaccgacgcaccacgcgccagcaaaccaagagacgaacaacaaccaacaggaacacgccgcaaccaaccccaagaacgacaatacgaccacagcagaagacacacgcagccacaaccacaccaggagaagcacccacacgaacaacaccccggccagacccagccccactggcagagcagagccgcagaccgcgccacgctgcgccaccacacgacgcacgagacacgaaacgacaggagcagcagacgcagcgaggacgcacaccagggaagcccgagagacgaggcaacaagcaccagaccgacgcaagccggcgctccggaccagcacggccgccgcgcgagcgtacgcccacagcgccgccagccacacacacacaaacaaacaccaacagatagcacacgcaacaccgcacacccccacagaccacggaccacgcacaccgacagacagcacgaccaacaaaagctcgcggccacaacccggccggcacacgaaagccgacaaagcccagcaacaccgacaacacatacagcccgcgtaccgcaaccaaaccagggctaaagaccaagaaacaacactcgcacgcgcgcgcggacagcccacaca

SEQ ID NO: 501584 - DNA, 101 bp, Homo sapiens
cactgctgagcgcaggatgacgtcggcaggagcgtgcatgagctggaacgagcctgccgggtagcagaacaggcagccaatgatctgcgagcacaggtgac

SEQ ID NO: 501585 - DNA, 545 bp, Homo sapiens
  misc_feature (424)..(424): n is a, c, g, or t
  misc_feature (431)..(431): n is a, c, g, or t
  misc_feature (496)..(496): n is a, c, g, or t
  misc_feature (499)..(499): n is a, c, g, or t
ggttaagactgaacggggcatggagcataccaacagcaacgagagtgacagcagtccaggcagatctcctatgcaagccgtgcatcctgtacacgtcaaataaagagcccctcagatccagaaggaagctagaagggccccatgtcctttagtagacaacgagccacaccacatgtccatgattttggacccatgacatgagattacggaagaatgaaccatgtaaacggaggacattggagtgactatctggggcgggccaaccccgatgaatgaagatgggaaaatggagaaaaaaaaaaaaacaggccaaaggttcgcggtgaaatggtcctccattggtggtccggtcggggggatttccactacgtttggacacctctgaatggtgtgacctctaagggccatcaaaaaccccattggngagtatntggagattttccaacttttggtggaaaaagggatttggtcctctggtgcatcggagggcctggtnggntactggggatttccctctctaagcggtcaacatcggtgtggtaatt

SEQ ID NO: 501586 - DNA, 730 bp, Homo sapiens
  misc_feature (452)..(452): n is a, c, g, or t
  misc_feature (465)..(465): n is a, c, g, or t
  misc_feature (657)..(657): n is a, c, g, or t
gggggcagctcctaactcaaaggagcggggggggcttaatatacctctaaaggagcctgtccagacacaaataaaccccaatcaacctcaccacctctaactcaccctatataccgacatgtttaacaaaccctgaagaaggatacatagtaaacccatgaccccaccttatgacacaattgtaaggggtgccccacgaggaggcgtgaaatggggtgcatttactaccccaaaaaactacgataaccttaatgaaactgaagggtcgacggtggatataaaactaaactgagagtaaagtgtttaattgaacaggggcctgaagcgcgaacacactgtccgtaaaacctcctcatgaatacttcactggacatgtatctaataccccaacggatttatatggaggagacttttagaaacttgggaagcgtactccaaagaacactttctcnaacaccaaaaggngaaaaaaaaagaaaaaactcttcgtaattccgcttgtcccaacccttctctagacctcaaggaagtatttcctgttaagccctcataaagagctcccttgaccaattagccctaaagtgagtcgcataaaaataacctgcccgtgttcttcaacctggtgcttggaaaaccctagtgatccccattttattnccattggaaacatcctcttataaacagtttttaaaaaaaaagggccccaccattccccttccacacaggggcc

SEQ ID NO: 501587 - DNA, 453 bp, Homo sapiens
tccggacgctcagtatcagtctaaataatggtaagtaggatatggccaggtctttgagtcagcttatttatagctaagaaaacataattggatgaggtcactcctcttttctaaagataccaaaattaggtgggttgtgtggtgtgtgcctgcgatcccagctatacaggaggctgatgcagaactgcttgaacccggacagcagaggctgcagcgagccgagatcgtgccactgctctccagcctatgtgacagagggagactccatctcaaaaaaaaaaaagagtcatccctaaaaaaataggttgaggtgcaattaaaatatgagaggctgctggtatttttatgggacatagattacaaataggaggtgttgaggagttaaagaggtatttatatattggcaattaggttagccagataggaaagaaagtacctcatgtagtcgttgaa

SEQ ID NO: 501588 - DNA, 612 bp, Homo sapiens
gcaccgttatcgagagtgtcggcgctgtgcgtccacgttgttatacgcgtcgtgctttatgatccggcttatagacgatgccgttatatggtattctctgctcaggtattgcaatagtttgaaattcccaatcctctcgagccacacaagcccagggccagcaacaacacttcgtgagagcgggaggatgaagtttcgctgaagtttgtgtctgaaaagcaggccttccattggcaaaggattgttaggagctgctagggttgcttggagactgacccccacaagtgatcagcacagtgcctaagattaccaggtgcaggacgccccaattccacagtgaggtgaagcctcgccaggggggcctgagcagcaggcttgctcttgtccctacattaggacacccgaaccggtgtgacaggagagctaaagagccacccacaaggggaaaagctgatgtcaacttaagagccacaacacctctggaaaagcaacaagcctctccttcagtttagtccagaagggaatcccctcatttgtgacacatcatcatctcacccaagctgctggctctgggactggcctgggcaggttgtctgtcctccaggatggccc

SEQ ID NO: 501589 - DNA, 438 bp, Homo sapiens
  misc_feature (34)..(34): n is a, c, g, or t
  misc_feature (37)..(38): n is a, c, g, or t
  misc_feature (57)..(57): n is a, c, g, or t
  misc_feature (185)..(185): n is a, c, g, or t
  misc_feature (203)..(203): n is a, c, g, or t
  misc_feature (292)..(292): n is a, c, g, or t
  misc_feature (304)..(304): n is a, c, g, or t
  misc_feature (334)..(334): n is a, c, g, or t
  misc_feature (425)..(425): n is a, c, g, or t
  misc_feature (432)..(432): n is a, c, g, or t
tgttttcctgcgcaggagccgcaggcctgtacanacnnatggcgcccagcggaatgnatggtcttgaagccccacttccacaaggactggcagcggcgcgtcggccacgtggttcaaccagccggcccggaagatccgcagacgtaaggcccggcaagccaaggcgccgccgcatccgctcccgnccccgcgtttggtttccnatccggcccatcgtgcgctgccccacggttcggtaccacacgaaggtgcgcgccggccgggcttcagccttggaaggagctcaagggtnggccggcaattnacaaaaaaggttggcccgggaccaatcggnaatttcttgttggatcccgaggaaggcggaacaaagtccacggaattcccttgcaaggccaaacgttgcaacggcttaaaggagtaaccgntccaaanttcaat

SEQ ID NO: 501590 - DNA, 134 bp, Homo sapiens
gttggtctcctagggaccaaggcctttgcatttttttctaccctgactcccacttctaatctctccttacccttcttattattattttctctgccattgtaatatttttttgttaattaaatgttttggtcaga

SEQ ID NO: 501591 - DNA, 348 bp, Homo sapiens
  misc_feature (1)..(1): n is a, c, g, or t
  misc_feature (10)..(10): n is a, c, g, or t
  misc_feature (31)..(31): n is a, c, g, or t
  misc_feature (36)..(36): n is a, c, g, or t
  misc_feature (41)..(41): n is a, c, g, or t
  misc_feature (44)..(45): n is a, c, g, or t
  misc_feature (54)..(54): n is a, c, g, or t
  misc_feature (58)..(58): n is a, c, g, or t
  misc_feature (63)..(63): n is a, c, g, or t
  misc_feature (70)..(70): n is a, c, g, or t
  misc_feature (123)..(123): n is a, c, g, or t
  misc_feature (140)..(140): n is a, c, g, or t
  misc_feature (142)..(142): n is a, c, g, or t
  misc_feature (155)..(155): n is a, c, g, or t
  misc_feature (162)..(163): n is a, c, g, or t
  misc_feature (177)..(177): n is a, c, g, or t
  misc_feature (182)..(182): n is a, c, g, or t
  misc_feature (185)..(186): n is a, c, g, or t
  misc_feature (191)..(191): n is a, c, g, or t
  misc_feature (219)..(219): n is a, c, g, or t
  misc_feature (228)..(228): n is a, c, g, or t
  misc_feature (231)..(231): n is a, c, g, or t
  misc_feature (263)..(263): n is a, c, g, or t
  misc_feature (297)..(297): n is a, c, g, or t
  misc_feature (300)..(300): n is a, c, g, or t
  misc_feature (302)..(302): n is a, c, g, or t
  misc_feature (306)..(306): n is a, c, g, or t
  misc_feature (312)..(312): n is a, c, g, or t
  misc_feature (322)..(322): n is a, c, g, or t
nttcaggaancaaagacagatactgcgacanagggngctcnggnnccagcgtcncgcnatgcnatcgcgngcataccccccagacgaaaataccaaatgcatggagagctcccgtgagtggtnaatagggcgatagaccngngatccatcgtgangccttanntaaggggaacgtgngggcnatnnaggcnctatgaccctgaagtaggaaccagatgncggatacangtncactttagctacccccaagtgctatgggcccngagcgaggagagtagcactcttgtgcgggatatnganancacngagganggtggacaanggacccctatctgaggggggcatcca

SEQ ID NO: 501592 - DNA, 150 bp, Homo sapiens
cgagtgagtcaatgaatacgctgacaacacacagtacaacattcacagagtaatcctgcattcccacattcatagggaaggattctctaaaaacaatatgagtgggcgtttgtctggtgtgggttgcccagccagagctctggcaggcac

SEQ ID NO: 501593 - DNA, 461 bp, Homo sapiens
  misc_feature (27)..(27): n is a, c, g, or t
  misc_feature (65)..(65): n is a, c, g, or t
  misc_feature (439)..(440): n is a, c, g, or t
  misc_feature (442)..(442): n is a, c, g, or t
  misc_feature (445)..(445): n is a, c, g, or t
  misc_feature (447)..(447): n is a, c, g, or t
ctccagctcctccccagaagcaagtancttcagcctctctccaatctacttgctcctttcccaanaccccaagcaatatagacaagttctatttcttttgtttaaaaaagaaaaaaaaaaagacttcttcaatcccaccccgtctctgttgctgcggcctcctgccccaccccagcccaccaaggtggctgcgaccctggagtctccagctcctcccttcctatggcctttagcctgctgcaaccacatccctccttgatgtgtcactcgaccgccagtgtggcaaaactctctaacctctgcccatgtcgtggtgaagaaaaaggctctgccagtcaagctgcctggatctccttcagctccactgctcaatcactgtattactttggcccgtaacctaacttatctgtgtcttggctaacttgtctgtaaagcattnnanttnancttttatgcacact

SEQ ID NO: 501594 - DNA, 813 bp, Homo sapiens
ttcacatggatcgagcctgcttattcaggtggtccacaattagtgaaaatctgttggcaaccactggttatcctggcaaaatggcaagccagtttcaaattcatcatttaggacaccctcagcccatcctcatgggttctgtagccgtggatctggactgtcctggcatcgaactctccctctgtgtgtaattggggggagaccaaaaggttggtggttggggagagtagaagtatagggtgtctgtggtcaccataaggatccacaaacttggtatagaagtacatatgggaagaattctatagtacatatttggaagaatttttatatcaaatatacggtatactttagaaaatgtctcagtgtgctttattaaataaaatgtggatggttggaaaaattatttttctactctgtcctctgtgtgtgtatatatatatattttaaatcttacaaaatcatatggatcagcagtcactccagagaagagatgatacggaaaaataatgctttgagtttatcaaaaaaggagttattcgaagtgtatcgtgtttctatacttgggtatatgctgctttgctaaattctcagggacacatttatcaaaagagaaaaaaggcaggtacaaatgctcaacactgtaatcccaaaaatgtggaggtgaagggagtggatcacttgaggtgaggagttaagacaactggcaaattggggaacgtattttataaaagataaagataaaatttggcaggtggtggaaatgggggaaaaactgactcggagagagttcgtgaggcaagcgatctattgatg

SEQ ID NO: 501595 - DNA, 181 bp, Homo sapiens
cgcttccctcaggtttagataatcgtgtcgcacggccacagaacaatctgctggcatagcctttgacctgtttggctagctgaactagcacgctcagagcccagctctctagagttcaagtatccgacagttccccactgctcccaggagctgttacctctggcactctgtacccatcatt

SEQ ID NO: 501596 - DNA, 1115 bp, Homo sapiens
ggtagtaggtgatcgtggccttccttgggatccctgtttcccccatttgattcccttttcacccagtaaaacccatgcattttctcacgtctttaaagcatctgatgagcgtaaagtataagtggccatgggatggacaagaagcacatgtgtactcgtgaagtcctgtgacattgtgggttagtgcagcatgggagctccagaagtgacattctttcaggaatgccagtaggatgcttattagcaaaagatgcgtgcccatcttcgatagatactgttgatacacagttctgaatcagaaggcatgacatgatggagacccaagaaagccagagatctcatagtgtagcgtcagtgctaggagataccagtggagatgatctctggctcgagtgcaaacccatacccgggctcctgagagattcaaagcagtttctacctagcattgcagcatctaggcgtgccgcgagtaggcagggcatgaacgcgggcaacccccggtacacaccaatggccacgtgggctacagtggtaaggcgctacacgggacttggagcctacgaagaccatccatggaggctaacaaaagacagaatccgaagacaatgacgtataggacgcatccaccaagaggtggccaccggagaaatcgagcacgagcgattgcagacgtggggcaaacaacccccagggcgttaccacaaagagaacaccactgagaacacgtgaaaccaagtcacgagaaagtaacaaggggatgagaccacatggacaccgggaaggaaaacccgggagaaactggacagagacccagagcacaaaagaccgaaaggcatgccgccgcaacagccgaaaaacaggacggacaactagcacaatccaaacagacacggaagaagaccaacaaagagacagagagaaaccacaccggtaccagagagggaggaggggacaaaaccgagaagaagaaagagaaggcgaagaagagcatgagagaaaggaggaagcggggcgagcccaggacgaggaggcgaggaaagaaaaacaggaggggacagaaagggcggctgaggaccaggagaagacccggagcgagcgagcgagagcgacgggga

SEQ ID NO: 501597 - DNA, 227 bp, Homo sapiens
tttctgtgcccccgaaggttctatctccccgtcagcaccgaggcctggttcagtgagggagcggagcatgcattctccaggcgctgtggttgcccctggacttgtgcgtctgctgctccggggtggagctggggtgtgtgatgcacgtcctcgtgggggccgggccgtcctccagccccgtgtgctccctggccagcccccattgtcgctgacgggctagtcggggt

SEQ ID NO: 501598 - DNA, 932 bp, Homo sapiens
tgtagtctcgtgccgccggtgggcgtccttgtggacccttgttcaaaatggggcgcgtgtttcccttttccactgggtgtctagagccgcagtgtggcgaggttgcgaatattcccgggccccagattgcgtgtggcgggagcccattttcccggcccgtgtgggcgctccccctgcggattggaggcgttcctcggtgagccttcttcgccgaggcttttcaacgcccgtctcaagccacaggcgggtccacaggcttcagcccgcgccaggctcctctggacggtctctcgcaacaatatcccccgcaaatatcggagggggcgaaggcagaaacacccaaggggaggctacaaagctcgtcgagccaggaacactagcatggcgacagggtctgaaagccaccaccgtgccgtccacggccaccgattgggggacgcctcttgaagagggcaagattacccctccccgtctcccccacagcaatccggttggacagagggcccccacgcgcccatggaggcaagacctgcccaaagccaaccgccagtacgtgcgcgggcaagcaatcataatcacgatttctcgaggggccccccctgtcataaatggggaactccccttccttcactcaagatttggcaggcttccccaaaatgtattatcgctgcatctctcaccagtagaatctttgaccacacaggcagttgactaccaaaaaacgctcgttttccatccaccagcacacagcagcagctaccatctctgacaaatcctcccaataacagttcatacccaactccccccaccccccttattgtaaagactcactcaggaccgccccattcttttttcataagaggaagtttcccacacttttccgccagagaataacacagcaaaacaaaacataccttccgcccaacataaca

SEQ ID NO: 501599 - DNA, 421 bp, Homo sapiens
actcctcaaatcaccgggcgctgacatttgggatttttgccttcctggcgcaccccacccccacatgcacactcacgtgcatggcgtcggcagaatgtgggtgctgcgaaggtgcccccacttctgtgtctcccacgcagccccgggaacctgggcatcggcaggatgtgggtgctgcggaggtgcccccacttctgtgtctcccacgcagccccgggaacttgggccccacaggagccaggagttgcagcacaggaccaagaagcttgaccttttctccccaactgataaatcgccagtcctttggagcaacagtgtcctctacataaaggagcagttagactaatttaaaacagtattgacctttccttcctgcccttttcattttgactaaattacagggtgcggctctgcaaaaaaa

SEQ ID NO: 501600 - DNA, 490 bp, Homo sapiens
  misc_feature (34)..(34): n is a, c, g, or t
tttgtcgcacaagtcacccatttcaagcgctggnaggctgcgttctcatgtggcctggacacccccaggttgaaaaacccccctcctttccctggccgggagggcaatttaaagggtttcggaggggtatcccccccttttacctgacccactcctcaggtttggatttaacggggtggccccagggttgttaaaaccggaaaacccccgggggccccccttgcagggtcccccccttgggttccttcctttttgcaaagacctttaacaaccggccccccaattttgcccctctccccttgggggtccgctttcaaaaatttttgggagggttcccctaggggccccccggggttttcccccccccccccccgttttcagggggtaagcccccggacccccccaaggtttttttggggtcccccccccccccctggtccgtttgcccctttccctggttttgggtcctttaaatttcctttgggtttca

SEQ ID NO: 501601 - DNA, 193 bp, Homo sapiens
ggggtgacccagggggctgttaatttttcccctttggtttttttccccttttggggggggggtttaagggtttaaccggggttttcccccccccccccctttttttttttccccccccccccccccccccgggggggttggggttttttttttttttttttcctttcccccccgggggggggggccattccca

SEQ ID NO: 501602 - DNA, 817 bp, Homo sapiens
  misc_feature (1)..(1): n is a, c, g, or t
  misc_feature (77)..(77): n is a, c, g, or t
  misc_feature (81)..(81): n is a, c, g, or t
  misc_feature (176)..(176): n is a, c, g, or t
  misc_feature (180)..(180): n is a, c, g, or t
  misc_feature (209)..(209): n is a, c, g, or t
  misc_feature (238)..(238): n is a, c, g, or t
  misc_feature (262)..(262): n is a, c, g, or t
  misc_feature (265)..(268): n is a, c, g, or t
  misc_feature (279)..(281): n is a, c, g, or t
  misc_feature (306)..(306): n is a, c, g, or t
  misc_feature (313)..(313): n is a, c, g, or t
  misc_feature (318)..(318): n is a, c, g, or t
  misc_feature (323)..(323): n is a, c, g, or t
  misc_feature (341)..(341): n is a, c, g, or t
  misc_feature (351)..(351): n is a, c, g, or t
  misc_feature (353)..(353): n is a, c, g, or t
  misc_feature (356)..(356): n is a, c, g, or t
  misc_feature (363)..(363): n is a, c, g, or t
  misc_feature (379)..(379): n is a, c, g, or t
  misc_feature (382)..(382): n is a, c, g, or t
  misc_feature (388)..(388): n is a, c, g, or t
  misc_feature (392)..(392): n is a, c, g, or t
  misc_feature (403)..(403): n is a, c, g, or t
  misc_feature (414)..(415): n is a, c, g, or t
  misc_feature (425)..(425): n is a, c, g, or t
  misc_feature (430)..(430): n is a, c, g, or t
  misc_feature (447)..(448): n is a, c, g, or t
  misc_feature (454)..(454): n is a, c, g, or t
  misc_feature (462)..(462): n is a, c, g, or t
  misc_feature (476)..(476): n is a, c, g, or t
  misc_feature (502)..(502): n is a, c, g, or t
  misc_feature (505)..(505): n is a, c, g, or t
  misc_feature (507)..(507): n is a, c, g, or t
  misc_feature (517)..(517): n is a, c, g, or t
  misc_feature (519)..(519): n is a, c, g, or t
  misc_feature (522)..(522): n is a, c, g, or t
  misc_feature (524)..(525): n is a, c, g, or t
  misc_feature (531)..(531): n is a, c, g, or t
  misc_feature (542)..(543): n is a, c, g, or t
  misc_feature (557)..(557): n is a, c, g, or t
  misc_feature (561)..(561): n is a, c, g, or t
  misc_feature (574)..(574): n is a, c, g, or t
  misc_feature (584)..(584): n is a, c, g, or t
  misc_feature (600)..(600): n is a, c, g, or t
  misc_feature (668)..(668): n is a, c, g, or t
  misc_feature (670)..(670): n is a, c, g, or t
  misc_feature (676)..(676): n is a, c, g, or t
  misc_feature (702)..(702): n is a, c, g, or t
  misc_feature (718)..(718): n is a, c, g, or t
  misc_feature (720)..(720): n is a, c, g, or t
  misc_feature (802)..(802): n is a, c, g, or t
ngtcagtctataattccttaatcaaagtcagcaatttatggacagcttcagcatctacagttgacctttcactagcnaggnaaacttcccgaaataatcgtagtgactgattcatcttctcaaattctcttgcttttctatgtcccttttgaataacttcctctgggagattagcnagcnttgctgcattaaagccatagcttttaggncaagctcccttaatgaatttatagaggcnacgtaatagtctccgggcgtggcncgnnnngggtgcgtttnnnggcatgcgtgcgataggtgctaggngggcggngacantttgngaatgatcttctactaangagtggtagngngtngaaaatnatgtgggggattttanggngtgggngggngctttgggggnggggttggggnnggggggggcngcggnggggggggtggctcggnngagggnagccacgngcggcagagagtgngcggtggcgtgcgtgagtgtgcgggnggngncacttaattnancanannaatgtnctttcacctgnnattattctgtctgngcgnaccaagtctagtnaacactctancaattgcgcgcgagcntgcgcacttcagcggcgcgcgcgctgacaaccccatctgggccatttacagctaaataagccagcctntnctcatnagcgttgaacttgccccccatatttngtccagtaacaagcananaataggctttgccattttcctgctcctcttcctcacagcctattagaatgtcattaggaataaaatcatctccaaaaaaagncttcgtaatgcaagg

SEQ ID NO: 501603 - DNA, 378 bp, Homo sapiens
gttctcacgggaccagctaggggtccaggcttcagtcagttaaataagagtggtccatcgtcctaaagacacctctcctttacaaagacttgtgatgctcttggggctctctgtgccaagccccaccttttcttggtcatggtacccttacagcgttgatggctacagctcgaaggggggctttcgtttccccctgtgcgttcagttttttcagtatctacctttttcccgtgcccatttggctatttacttagtgttattttttgtgtgcctattgtatggtgggtgggtgctgggctttccctgccacttccaccccttttttgacttgtccttccgtacttattaaagtgcgcttgggagtgttttaaaaaaaaa

SEQ ID NO: 501604 - DNA, 377 bp, Homo sapiens
  misc_feature (6)..(6): n is a, c, g, or t
gcaacnaggccgagatttgggtgggcctcaacgacatggcggccgagggcccctgggtggacatgaccggggcccgcattgccttcaaaaaatgggaggcttagatccccgcgcaacccgatggcggcaaaacccaaaactgggcggtcctgtcaggggcggccaacggcaagtggtttgacaagcgctgccccgatcaactgccctacatttgccagtttggggttgtgtaaccggcggggcgggggccgtggggggcctggaggagggcaggaaccccgggaggccgggaggagggggggggcctttcagcccccctcctttccgggggcttggagcctctttttgcaaataaagttggggcagctttgcggaga

SEQ ID NO: 501605 - DNA, 812 bp, Homo sapiens
atggtagttattctgccttccagtttgcttgatatatttgttgagtatgaagattcttgagcttatatttgaatgggttctagctgaaaaaggaatgatatatcttgaagacatcgatatacatttatttaactctctatgattctacatatgtataaaatgaggaaatgccacaaatatgtatggtggatcaaagtcacttgagcacagaggtgatatggttgcatccagcgcctattgtcgtatggatgctttcatgatctccctctaagcacattctcaatagctttagcaacagttatcaccagctttgtaactttgcatagacgaaaagtttcacgctgtattgaatcaggtaatgccttcaattgaatgtagatactatcacataagatatatgaggaaagtgtgtccggctgcactaacgtagagtccggagggacagatcagtcataggggcttgcctgtatccagtagtctcaggccctgtgttccccggtgggtactctggtgacttgtcacgtctattcgctatgtactccatgtgattttgatttctcctgcaggactgagttagcaaggtatctggaattcttatagccaacacataggcaaacatccataaatatagagtctcatggacctgccctaaatcatccaattttctttgccaattttgcattgttttctccaggaccaaaatcgtgcgtcaaatacataatttttgatggtgaaaagcacattgttacgagtgcagcccctaagggtggtttcgcacgctggaagctaataaagtgctttccgaagaatga

SEQ ID NO: 501606 - DNA, 129 bp, Homo sapiens
  misc_feature (18)..(18): n is a, c, g, or t
  misc_feature (70)..(70): n is a, c, g, or t
  misc_feature (86)..(86): n is a, c, g, or t
acctacaacgggaccctngaagaagtcagagctatacaggaaatcaagccgggagaggaggtttttaccnactatattgatctccngtacccaacggaagatagaaatgaccggttaagagattcttat

SEQ ID NO: 501607 - DNA, 229 bp, Homo sapiens
cagacgctgactcttcccccctcgtggcttccctgggctactccctttctggtgaccttagaattccaggtttctcgagaagctcccctgtacagacccacccagcttggatacgactaagtgcagacctccctggtaggagccttgggcaaactgtctggaagccctaggcagccctctaggtttcctagtggccagcccctagtgagtagtggccaggccctagccc

SEQ ID NO: 501608 - DNA, 1306 bp, Homo sapiens
  misc_feature (461)..(461): n is a, c, g, or t
tcacgttaaaaaaagttttatttagggagctccagggaaatgtgcggggggaaaggagagggtgcaggtgctcattgtgccgcccttcttccttcccaccatagtgtgcatttaaataggtggagtgggagcattctgacagaaggtgagactcaggcaggtgggtgtgttcgtgcaccccaacagcgcatgtgttgtggctgtggaacagccaaagtctcatatcgtgcgtgaggtttataggcaagttctcaggttgtgcccatgtgaattttgtgcacaaacctctcctctcacgagcgtggacggggtgacgccgagggttctcaagagtctcctctctctcctctctcctcacacgcgggtgagacccaccgtggtgacacccacatgtggaaaaagctcgcgtgagagcacacgggcataagatctcaagacacagagctctctctctgtggaangtgtgtgtgacaagactctcctcttctcatgtgggaccccggatgtggggtaaccaagggtctctttgggcaacacgccttggcctgggaatgttctgggtcccggcccaaataccacacgggtatccaaccagggggacattctcgccatgtggacaggcgccatggcgtggggggtccatatccaggggacagaaggtgtgagaccacaggctctgggggtgtggtggcgcctaggggtctggcgcccctgggttctcacaaaggcagaaaggcgcccagaagcgggaatggagagtctcaaattctctacaattggtggtaacgtacagctctggtggcccccatctataaggggcggggagacgaatcgacacgactgtgggcacgcctagggggacggagcgccaaacggggatccaagcccccagaacgccttgtaatggtgcgcccagcgttggcaggcggggcatattccaaaggcaataggagaaagccggaagccccaaaggccccttgaaccaagcgtggggaaatccccagagggcgcaggtacccacggaaggggggcgagacaaaaccggtctcccgggaaactctctggtcacccaggcaggggataacgcgaaaagggggcacgcccacacaagggctcaacaacttgccgcagaagaaagggggccacaaacccggggggctgcgttacagtgccgccgggagaactcgtaaaagccccgcacgggccccggggggcagcaaacacaaggcagggcggcaaaaccccaggcgcagaacacgccacatctgctaagcgccacagcagagcaacaaggacggagaaacag

SEQ ID NO: 501609 - DNA, 1279 bp, Homo sapiens
aagaaagtcctgggcccctccagtgaacgtgtcccctttgctgtcacttccggaagggtggtcgtccccagtgtcccgcgatggtcccccagagctgctgcttgagtcccagtgtgaccactattcaggtgatggcttcgagctctgaggaagatgcctccatccccagatgataaagagaaccaggccccaaaacggagctggcccagatctgcgcttcgagatcagcagtgaggatgggcttcagcgtcgaggcagagagcttggagcggggcgtggccgaactctgatcgcgaaagtgcacgaggcccgagggcatgcccgactcagacatctctccttaagtggaatgcgtggggcgagacatcctgggcagtccaccatgatgctgatcagtcttcctggccgagcagctccccggaggcccagcgttgccagaacatataagattccgatcaccagcagacacgggacgagggccacggacgcgagccgcacccatgagatcccacataggggactgcatcgggcagagcgtactactctccgagacagtgcacctttgacatggtacacacattccctggcactccacagccaccaggggtggcacccctgagcgcgagccaacctgtgaatgcaggaacgacgcatgacccgtagcaccaccagtgaaccaccaagaccgtgacaccaggcgcatgtgacgctgcccgactggacacaatgccgggaacgggccacccactaccgagcgacaggtcacaaacggagcccggcggcgatggcaaacgggaccaaggccaacccacgcgcacgacggcaccgtcacctgcgcccgcgccaacaccccagcaccacaggccgcgcacacactggaggccgctagaaggcgacaccacgcacgtacatggtaccatcgcgacgcccccggcgagcctcagcgccgagcgccccccacccgggaggcgagccaacccggagcaaatacaaaacgccagcagaggagcaccaacccaggacccccggccagaccgacgcacccacgccaaagacagcacagacacccaccaaacagcccgcgggccacgcccactcaccagccacagccgcagaaacgcccacgctaagaagcacccacagcaacacagcgcaaacgagcgcgacgaccacgacaccacgcggaccacacacgaggcgagtacacacaccagacgggacgacaccccaacacacagaggaccacaccacagacgccccactcgagaacgacgccacc

SEQ ID NO: 501610 - DNA, 160 bp, Homo sapiens
gtgcagggttcagaaagttaaatatagaattaccatataatagactgggagaggtggctcacacctagtaatgccagcatttttgggagaggcaggcagatcacatgaggtcaggagtttgagacaagcctggccaacatggtaaaaccccatctctact

SEQ ID NO: 501611 - DNA, 330 bp, Homo sapiens
ctctctgggtacgaatctctttctgtctcccaggtggagtgcagctggcctgatctcagctcactgcaacctctgcctcccgggttcaagcgattctcatgcctcagcctcctgagtagttgggattacaggtgcgcaccaccattcccagctaatttttgtatttttagtagagaccgggtttcactgtattgaccaggatggtcttgatctcctgaccgtgtgagccaccacacctggtcacgttttctttaaacagtattaagaagtacagattatatagaggcagagaagagagcttcaaatattgtcgtgtttacctaactttag

SEQ ID NO: 501612 - DNA, 612 bp, Homo sapiens
  misc_feature (2)..(2): n is a, c, g, or t
cnttttcggtcagtgaggcgcgggcgccggttgtttttcctcttgtttacgcctcacccccgctctgtgtgttttaatccacccccccctttggggggggaaagggggttcctccccgccccccctgggtgttgggggggctgggtttttcttttgcaaagggcccttatttttttttgtcccctgtggcccccattggggggggagaaaccgtcccccctttttttttccccaccccccctcccccccaaggccggggtttcctccctttttttttttttttttaaaaaaaaacccggggggggggggggggggtttttccttttttccccccccttttgggggcccggggggggggtttcccgggggtgggggtttgcccccttttgggtttcccgggggaccccccttttttttttaaaaaacccaaaattttttgggggggggggggcgggcctttttttcccccttttttgggggggggggggggggaagggggtcccccccgggggggggggtttccttttcccccgtttttggggtccccccccccccggggggggggggggggcccccctttttcaaaatttatttttttaattttaaaaagga

SEQ ID NO: 501613 - DNA, 546 bp, Homo sapiens
  misc_feature (51)..(51): n is a, c, g, or t
  misc_feature (73)..(73): n is a, c, g, or t
ccaggtacaaaatcccctgggacaaaacagaactttcataactggctgtanagttattgtttttgccttttgnaagcttccaccttgtgacgggaagagcactgtcagcccaacacagaaactctgccgcctggagtcacgtggatccagatgcgaagggactccaacgtcatgctaaggagtttgggctaagaatttgtacagccatattacagatttggaaaatgatgtgaagagaagctaagggatttgccactgccactcagctgccaaggatcagagacattacttctacttctcaacgtccatcctccaaccattgtccagtgattcaggcagaattccctcctgctcaggaggtagccatcctgtgaccctggaagaaaccagcccaaggaaggtgctaacctacagaagaaggacatggccagggtaatcacatagacccggagttgaagccctgactgcaccacacccgaagcctccccacctttcaacctctcggtgatggtgaaccaataaactctttttattgttcaagccaaa

SEQ ID NO: 501614 - DNA, 492 bp, Homo sapiens
  misc_feature (51)..(51): n is a, c, g, or t
  misc_feature (73)..(73): n is a, c, g, or t
ccaggtacaaaatcccctgggacaaaacagaactttcataactggctgtanagttattgtttttgccttttgnaagcttccaccttgtgacgggaagagcactgtcagcccaacacagaaactctgccgcctggagtcacgtggatccagatgcgaagggactccaacgtcatgctaaggagtttgggctaagaatttgtacagccatattacagatttggatcagagacattacttctacttctcaacgtccatcctccaaccattgtccagtgattcaggcagaattccctcctgctcaggaggtagccatcctgtgaccctggaagaaaccagcccaaggaaggtgctaacctacagaagaaggacatggccagggtaatcacatagacccggagttgaagccctgactgcaccacacccgaagcctccccacctttcaacctctcggtgatggtgaaccaataaactctttttattgttcaagccaaa

SEQ ID NO: 501615 - DNA, 274 bp, Homo sapiens
tctaaaagtaccgctgacagcagtccaagtagcttgatacaaatttcctctcctggcttaatatcctccagagcagtgacatgcaaagaggacagttgtgttctggaaaggaggtctctgcattgggcacaccactgtggttgccgcagttctgaagcacaaagaggccagatccttcacagttcagaaactctccagttgctgcctacggatgtccttgtctagctggtcaatggaggcgtcaagctgctcacggaccgtgagtgcttcaact

SEQ ID NO: 501616 - DNA, 758 bp, Homo sapiens
agcggagtaacgtcgcggcgggttgcgggtaggactggacgccagagcagccgcgcagcgcctgaaccgctgcgggccgcgcggccgacccgttcccaccctcgcctctgctgtctccagcctcgcttctccgactttcctgctcctctgcatgccttcgtttctggtcctcggacgtcctcgccgggccgaaccagacggagtcccacgaggcccgccaagaaagccgcatttccgcgtggcccgcagacgccgcgacttcggccacagatttctcccatctgagctagtcatcccaagacggacgcatcctcgacccgcgggaagaccacggcatgcgaccgcgaacgccacgatcctcatccaggagccgacagcgagcgcccggcggcacacgaccccgagacacacaccccggcggctctcggacccagcgacgcctgccattacagccagaccgccgatcgctcctcgacccggctgcacacgacgaacgccaacgccacacatcctgcaaagcgagaggaacccggaacgagacccaaagaagccagcacgcacagcatgggccgacaggcacagcagatgaactggccctaccagcgatacacagggaagcatcgagactccagagatgacaaccataaaggaacgtggaaatggatggtggggcgacagacggaaaggggggagaaaaataccaagggaaagtaattgatcatatagggtaaaatcggttgaaaaatggcaaatgaaag

SEQ ID NO: 501617 - DNA, 246 bp, Homo sapiens
aaatctaactggaatacagctatatgcatggtaaatattgagaagctcagttagaagtactattgaatggactgtttaaggtattccacttaccacttaccatggccgtgctgatgttgagtttgctccctgtcattgtagccacaagtgatagaggcagggaataggacaatgacagggacatgaagcaccacccagagtcctcaagtgacattaatagtggttgggaatagctggtggaagaga

SEQ ID NO: 501618 - DNA, 229 bp, Homo sapiens
acacgctcaaggagcggtaccagcaagatcggggacaccaatacgcgcccgcccatcgagggtgctctgcgagaacttccccgaggagcttgccacgtccctaacgctatgtgcggcgcctggacttcttcgagaggcccgactattactacctgcggaagctcttcaccgacctcttcgaccgcggtggctccgtgtacgactataagtacgactgggccgggaagcc

SEQ ID NO: 501619 - DNA, 165 bp, Homo sapiens
agcccggtacactgcactgacgtcacagaggagctctatagagtgttaccacccaagagctggtgcaggcctttaaccatgctcctgcaacattagaagcagacagaggtgggaaagttccacataggtaagataggcaacgtctctggggaatatactgatact

SEQ ID NO: 501620 - DNA, 623 bp, Homo sapiens
  misc_feature (1)..(1): n is a, c, g, or t
  misc_feature (238)..(238): n is a, c, g, or t
  misc_feature (245)..(245): n is a, c, g, or t
  misc_feature (254)..(254): n is a, c, g, or t
  misc_feature (272)..(273): n is a, c, g, or t
  misc_feature (279)..(279): n is a, c, g, or t
  misc_feature (288)..(288): n is a, c, g, or t
  misc_feature (290)..(290): n is a, c, g, or t
  misc_feature (293)..(293): n is a, c, g, or t
  misc_feature (316)..(316): n is a, c, g, or t
  misc_feature (324)..(325): n is a, c, g, or t
  misc_feature (328)..(328): n is a, c, g, or t
  misc_feature (359)..(359): n is a, c, g, or t
  misc_feature (373)..(373): n is a, c, g, or t
  misc_feature (382)..(382): n is a, c, g, or t
  misc_feature (384)..(384): n is a, c, g, or t
  misc_feature (390)..(390): n is a, c, g, or t
  misc_feature (393)..(393): n is a, c, g, or t
  misc_feature (398)..(398): n is a, c, g, or t
  misc_feature (424)..(424): n is a, c, g, or t
  misc_feature (431)..(431): n is a, c, g, or t
  misc_feature (439)..(439): n is a, c, g, or t
  misc_feature (447)..(447): n is a, c, g, or t
  misc_feature (459)..(459): n is a, c, g, or t
  misc_feature (466)..(466): n is a, c, g, or t
  misc_feature (471)..(471): n is a, c, g, or t
  misc_feature (478)..(478): n is a, c, g, or t
  misc_feature (480)..(481): n is a, c, g, or t
  misc_feature (486)..(486): n is a, c, g, or t
  misc_feature (513)..(513): n is a, c, g, or t
  misc_feature (515)..(516): n is a, c, g, or t
  misc_feature (518)..(518): n is a, c, g, or t
  misc_feature (528)..(528): n is a, c, g, or t
  misc_feature (541)..(541): n is a, c, g, or t
  misc_feature (598)..(598): n is a, c, g, or t
ngctgacaggagtggggcagggttcatggacctttacctcagagcagcttaccctgagctatacccacatctcaaggatttgggggcgtctagatctcatctaagggagacacaacttttctggtcctcagatggaaagctgggggaaggtaccagtatttacccttccataaaaactttggaggtctttaggaggatacccctcaggagggctaggagaggaatgacaaatacagangatagangtcccgtgncctggttgtaccctcccnnagggtntgggttatncnggnctgccactcccgctgccacaccnccatctgnntgntcgatggctttggttcgaagtagatgccccncagtgcatttttcntcacgagtntnttttcntgnctganatagaccccaaagatgcccagctctnaaatgcnctggaccnctcgggcngggctgccaggncgtagcnggccnttctcananngctcnggttcgatcttctccatgaggatgtcngnngncctctcgctnactttcgcttcangctttttgcagggcgcttagcgcatttgcgctgcgcgcgcaataatagggtttgttnaggctggcagggctgctgctgcttt

SEQ ID NO: 501621 - DNA, 417 bp, Homo sapiens
  misc_feature (15)..(15): n is a, c, g, or t
  misc_feature (23)..(23): n is a, c, g, or t
  misc_feature (153)..(153): n is a, c, g, or t
  misc_feature (186)..(186): n is a, c, g, or t
gataataaatgcccnatgttacnggccatatgtatttattatgcccgtatttttaaacccattattttagagtatacctgccttcctgccttataaagaaaaagttaaactgtaaaacagccctcagatgggtccctttagccaggtattccnagaagaagagattatcatagaagatgactgccnctgtgtgtgttattgccccctgaataccctcccagtgggatgagataaggaggtgaaagacagtgactttgatgatcctgacactgtgtaggtctaggctgatgtatgtgattgtgtcttagattttaacaaaaaagtttaaaaactaaaataaataattttgaaaatggaaaaaacttatagattataaggatacaaggatataaataaaataatttgtagagctgtgta

SEQ ID NO: 501622 - DNA, 103 bp, Homo sapiens
gcttacaacttgccccggcgttgttgctgttgctgcaacggcaaaaactcaatcgctgggcggtgggtgtactggtcaacagcttgtggttgctggccttgct

SEQ ID NO: 501623 - DNA, 498 bp, Homo sapiens
tactggcatatgctaggaaaagcaatgttgtaacacccaaatcacaataatgcttttattttccacatcaagattaatttatatgttagttttagtacaaggtactaaaatgtatacttcttggcctaatagctaaggtatacataagcttcaccatacatcttggaggcacctgtctggtcctatgtcattgttataaatgtagagattttaggaaactattttattcaacctgggacatctatactgtgggagttagcactgacctgatgtcttatttaaaagtaatgtatattacctttacatatattccttatatatttaaacgtatttccatgttatccagcttaaaatcacatggtggttaagagcatgagttctgagtcagatctggactgaaatcctgatgctaccacatgggttaggttgtgattgtggtcaagtcacttaacttcttcatgggccaggtggctcatttttaaaagagaaaaccttcat

SEQ ID NO: 501624 - DNA, 896 bp, Homo sapiens
aagaagaaaaacactacttagtgtccttatacctgttgtataactgtgactaatgtttgatgacttttctttacactgtctggttaatttcgtttttaaactacggcgtgtccttccactgtggccgtcgctccaattggttatcctgttccgcatcgaggtaccccttaacctcgtgatggtcgcgacctacaattattggtgttgccctctgcacatttctttttccccccccgatattcttgccgtttcgatactcaaccctcccgtgcgtttccagcctgattgaacaccctaagttttgtgtgctgtgtttccgtaaaaatactgggcctaaatcatgttgccttcgtagcattaccccccccgtcttctttgtgaaacagtaaccgcccccccccccctcttgggtgcccatgagcacaccaatgccgttttgcctgaaagaccatccccctccccacaatatagtagctagtacccccgttaaacatctctccccacttcgattatagtttgcgtaaaaagcttcccccaccaaacaggtgtgctcgtgaataaccagaacaaacatctttatcgtgttctaccataagttcgtagacgggcgtcttacccacctccttcagtgcctcgatactccgaggggtattttccccgcacccctcccgcccaacaactgaattatcgatctttaacatggtaatttctataggaggacttcttgacccccacacgacgtgggtgtgacccacaacaaaggaccctcactttgggtcttgaactggaaacggagcgacgagggtacggtgatctggcagaattctcaaggctaattcaaagccccctcaccaggtcaaaaaaaacattcttttctttttagatcaaacaaaaca

SEQ ID NO: 501625 - DNA, 313 bp, Homo sapiens
  misc_feature (33)..(33): n is a, c, g, or t
gcaggaaagtggaaacccccacggggggccccngggtttggttttttttttaaaaattgggggccccccgggggggggtagggttggggggttctaaaaggggttccccccccccccccccaaaaaaacccggggggttaaaaaaagccctttttttccttttgggggaaaacccttgggggggggggaaaatttttaaaaaccatggggcaggggggggggcctcatttttttccccttgggggatggggggggggggccctttcccttttttttaaaaaggtgttgttaaaaaaaaaaagggtccctggga

SEQ ID NO: 501626 - DNA, 1748 bp, Homo sapiens
ggagagaactagtctcgagttttttttttttaggatttaacaaaactgaggtttttactccagtttctacagatgacaaatccaaagtcaggggcatagggcagggcaccaatgccgagtgtgcacagaaatcataggacagaaagacaccccacagggtggcacagaaagtggaggtgctcgagctagagatcccatagagggaaagtgcccacttcttcacagccaaccctcccgtggacaagatcgcgcacaatgacggcacacacaaactggctgggcaccagcaacaacgcgaacgagggacacatcagactggagggtctcacaggggcccaacgggcgccgtggagacaggacggcgtgccctatcaaacggaaaagaaccaaccataattctagaacgcgtatcatcacctgtggcacaacgacaagagttaagacaggccgagagtgacccaacaccatatcagataacatgtgccggacccataaagtgacacacgagcacacaccagcgcgatagcagacgagacagacccgcaattatgccaacgtgtgagagcgacaaatactacacaacacacatgagacgacagcgcagcgcaccggcacaaattcaccggggggcggcacaacacgcccctgcgaccgacgaaacacacactagaggcatacaaaaatcacacatggccacaactcttcccgcacgaggcggagcccacaaacaccaccaaacgtgtgcccaaagggggagggcgacaccaccaataacaccgggacccaatgccagcgccacgccccgtgaacaccacgaacaggcgccagcgggccacacgtccccaacccacagaccagatgaatccagccagcagagcaccaagaaaccagtacgccagacaccagccgaggacgcgcggctacaagaggagagaggcgaaacaaaaacccacacccagacactgagccacttaagaaccacatccgaggaggcactctacgaacaaacaccatccccacaccacacacggcgagagagaacgacaacacacagtcggccaccaacacgccacaacgccagcaacagagagagagcaacaagcagcgactactaacgcaccacaacccacagcaaagaggaacaccactcagaagcaaacacagaaagccaactcgagccacacgatcaaccagagggcgaccgcacgcgacatcacacaccacgagcacaacaccgaacacatagtacctatatacaacagaccgacactcacagagcaccacaccgccgcagagacgataccaactagactcaggaccagggagcagagcgcacgaggggaacacaacccagcacgcacatacggccgagcccgcgccaggataccaaacgtagcacaacaaagtcagcacagcgaactaggcgaaacagcgaagagaataatgatgagacggaacacaacagaacagcccagcagcagaggcgaacgacaaaacaagaagagaacgagagagacccacaaaacaccaaccagggatcaagtgaggtaaccatgtacacagacgagacctccaacggggagacagagcaagaactacgagaagaggagggtcaacaggacaccgatcagcacatatagacgcgagacagagtacaacgaagggcacgaagcacgcaagcaagacacaaaacgtcaacaaagacgaggcacagcgaaccaagagcagacaggcctgcccacgaacac

SEQ ID NO: 501627 - DNA, 729 bp, Homo sapiens
  misc_feature (44)..(45): n is a, c, g, or t
  misc_feature (60)..(60): n is a, c, g, or t
  misc_feature (78)..(78): n is a, c, g, or t
  misc_feature (111)..(111): n is a, c, g, or t
  misc_feature (558)..(558): n is a, c, g, or t
  misc_feature (608)..(608): n is a, c, g, or t
  misc_feature (617)..(617): n is a, c, g, or t
  misc_feature (717)..(717): n is a, c, g, or t
ctagaggatcccggaggcagactggtaacaggcagaagggaacnnaggtggaggagtggngggcagaggcactacaancacaacttcagtacacttctttccagcgttgtntcagaagtgccatagctcagctggactccattttcaatctgattatgatcatagtgagttccccatatgttacattgtcctaccaggacagcctcctcactgcctgctaagattaaaagtaaataaatagactaactgaagcatgaaggatttcggctagacataaagaactatttcctgttgttaagcaggagggacaagttgccaagaaagtttgtgaaatcctcttctcaaaggacttgaaaaggagaaaagttttcccagtggtctgaggttttagatgccatgttcactagaaggagtgggttttctcctctccaaaccaattaattcctgagatatcctggtctgcctgcagcaaacagagggttaacagcatcactacatcatttgctattggcaaaattttcgaagatggtgtgcctctattgcccgcctcagtttatnttaggtctataatttcttttcatttggagtaagtagtcggcaattgaaanaggtgattncttctcataatgtgtgcattgagttgtgtgggccggtggctgttgagtatgctttctccatgttgttgctggtgttgtttttcaataaaatttatattcntttttatccaaa

SEQ ID NO: 501628 - DNA, 348 bp, Homo sapiens
  misc_feature (90)..(90): n is a, c, g, or t
tatcctctgtccatcctgtgtgatcttctgtgcacagaggcagctctgctccctctggaacattagcccagtggcagaaagctgttctcntgatcccactggggacactgcttgtgcttgtaccgtggagagcctgagtgaggacttgcctggtccagtcctcaccaggctttgccactttatgagccctggtagcataacacaatggacaggcatatgtggaggctccatagccccgcccattgcctgagaccccagagtgcctgccctgggtaacataaggcaagcacaaattccactactaccaccgcacccggtactcttttgcaagcaccacctcctggctgg

SEQ ID NO: 501629 - DNA, 198 bp, Homo sapiens
ggatttcattggattatctcgtatagatttcttcactggcgcttatttcttcagcttcctcatcatcaaaatcatcatcatcatcatcttcatcatcatcctcttcatcatcatcgtcatcatcttcatcagcagcaagttttacttatttctgtggtaccattgctaccatcctccagttgaactccaacgttcgcg

SEQ ID NO: 501630 - DNA, 133 bp, Homo sapiens
gcatcttttgcattcttcctcatccgcctccttccttgccgcagactagctcacgccggagtgccatccttccccttttttcgccggaacttcccgccagcctttattcggccagaggtccctgaaacttttg

SEQ ID NO: 501631 - DNA, 109 bp, Homo sapiens
gaggctaactctagtagtgatccccacctgcactgtaatacccctcacttcaccctcctatgtccccataacctctccattctaattctccaaccagtcgcaactatat

SEQ ID NO: 501632 - DNA, 326 bp, Homo sapiens
  misc_feature (34)..(34): n is a, c, g, or t
  misc_feature (140)..(140): n is a, c, g, or t
  misc_feature (194)..(194): n is a, c, g, or t
  misc_feature (318)..(319): n is a, c, g, or t
  misc_feature (321)..(321): n is a, c, g, or t
  misc_feature (323)..(323): n is a, c, g, or t
acgtacaatggacccaggccccttccccaagctntgtgtccccccaggctcactataacatgtaccccacagaaccctgactaagtccttgacaccgatggggacttcgatctggaggacacaatggacgtagcgcggcntgtggaggagctccctgggccggccaatggacagtcagtggatcccgcacgcanaatcgtgaccccgcgacctctccatcttcagcttcttcatcttcaccagaggaatcactcttgtggatgttttaattccatgaatcgcttctcttttgaaacaatactcataatgttaagtgtnnananact

SEQ ID NO: 501633 - DNA, 194 bp, Homo sapiens
atgctggcatctttactaatgattggcatctttactacatgcggcatctttactaatgagcggcatctttactaacccggcatctttactaatgagcggcatctttacaaaatgcggcatctttactacatgcccgtgcctctttactacatgagcggcatctttagtaatagagcggcatctttactaatgcc

SEQ ID NO: 501634 - DNA, 375 bp, Homo sapiens
tcacggtggctcacgcctgtggtcccagcactttgggaggctgaggcgggtggatcacctgaggtcaggagttcgagaccagcctggccaagatggtgaaaccccgtctctgctggaagtgcagaaattagccgggcgcggtggtgggcgcctgtggtcccatttgcttgggaggctgaggcaggagaatcgcttgggcccaggaggcggaggttgcggtgagctgacatcgtgccactgggctcaagtgaggctgatggatcaggattccataatgatgggactacaggcaagctcatgattaaatgtcctagtccatcggctcctataagaataatgtaagtgggcgggcacgggcctcagcctgtggcccgc

SEQ ID NO: 501635 - DNA, 1156 bp, Homo sapiens
gtttaagaaaacaggctggcaagttttatcaaacagcttgattgtggcccactcgttcttatcttattcccatcgctaggcatggccccggtagggtattttatccgttcagctgagcagacgtgactcatacagcaggccaggcatgccttcgactctataccatctagcttactcatctcctaagcacccgtaccacagatttagattctcttcctttctggcaactaacgctcaccggcgggctcggccacgcgccctccccactcccacacggcatggccgctgctgcaccaacactacgacttagccctgaacaccatgcgctccaccaggcgaaacaagttggcaccctctgccgctacaataacacggccagcacccgctcgctcctcaccttgcaactcccttctgccccttcacctatcagccgccccttccgtctcgcctcctcccatcttcccgcgccctacctgctcctactacctctcgacccgcggcggacacccccgctcctcttgtctccttctcctccagcgctcctcgcgcagcgccccacgccccccccactgcccctcgcaccgcaccctccccaacacggccctcactctcacccacgccccgcaatactgccacgaacgcgccgcgcatcgcgaccctccccacccccccccactccccaccacccacgccccccccgacccctactctcgcctccccgaccccccaaagcatgcctatccagccacccacccgctgacccaccaccatccccacaggctcgccaacctgccccgctcccgtccgcacgccccccacccccgcacaccccccgccccccacgcccgcgcccgcaccccacgccccacccgcggagcccacaacccccagccgtgcgccgcgtggatacgcacccctcgctcgaccgaccgcccccccactcgccgccgaacactcgccgccacgcaccaaacaacgcaccaccgcaccccacaccacgaccacccgcccacccccagacccaaggggaggaagcacggaacatgagcgcagagccacacacaccgccgccgcacacgcggccccaacacggccccacgcccccgacacccgacgcgcagcagcaccccccgaccatgaccacccaccccacccc

SEQ ID NO: 501636 - DNA, 1831 bp, Homo sapiens
atgtgttttttgtaattcccctgtgtgcccataaattttaatgggcaggtcaggaaaaaagcggggggataagggtcccttccttcccatccctctacccagaaaaacacccttccaagaggacagcagaaagccccagaagccggggtgcctcagaaggaccttgggaaggcagacaaagtgggtggataggtgattcttccgtggtccctcgaggcaggcgtggcggataggtgtggcacatcttcctgtggcgctccacagcgcggcggacatattgggagagctccaatggacgccggctggggtcacctccgggagattcttggcgcggtctcaaacatatatcagagctctcgcgcaacatatcgagcgccagagcgtgggcgcttcttcaacatacacgcgggatggaaatcaggcgccgcgggaatatatgtggcgcaccacgtgcgtgtggtctctcacaaagagggcggcgcccactcgcggattctgcgtggcacacgagtgtgtggtctcttctcacacggaggtgacagcctatctacacatgtgggccctacagcgcgtgtgtgagagctgtgtaaagggctatacaaaagcttccatcaccagaagaccacgccgccgtgacaagaggggggtgtgcgcgctacgacggcgagaagggtgctaccagagaaaagcaccgcagcttgcggggaacccgcggtgtggcaacaccaagatccggtggggagacgcgcggtgtcctctcgccgcgttggtgtgtgcccccgacgagaagacaacacgactcggcggcgaggtgtacacacaaaagacatcgttgatacgaaggactcctgcgggagactgttggggtgctggacacacacgccgaagggggtctttcatcagcagcagaagcaactccaacagatactaccgcagaggagttcaaccggatggcgctaccggggaccgcacatgtggaaacagcccttttcacaatatcaatttagggggggctttctgcgcgaccactggtggtctacccaccctaccgagggggaaaactccatcttggtgtgagagtggaaagacactctcgggggatggaccccgcgggggaacgagtgggcgaaagaatcatcgacaacgacgtaccgacaaacgatgagattgacagcgctgtgtaggcgaccactacccacaaactattgggggacccgcgccattacgcaggccaggaaacgcaggagaaatacgcccactcccccagccaaagggggggattacccatatatcccataaacgaagaggacaaagcgcgccacaaagagcatatcaaatcgccacatatacgacgagggcgctgagtcgagagacgacgtgggcgacatctaccccaagagggatccaggaccccccgtgggcccacaggagggtgctaccaggaaacaagactccgaaaggaaccgccggttggtggccaaggttccgcgagagtgaaagtcacaggcgccccacacaagacggcgtcaactagtcgaccacaacagccactgggtacccggactatacacaaacgcggggtgcgtccagaagaacgacacatcacgtcggaagccaaaaaaacagggcgtagttggtccaaagacccctagcagcggaccaaaacacgcgtcgagacgtcctccccaaggggggtggggacacccaaagaaacatagttgtgcgccgacagaaagacccgtagagaaaatcctcagtcacaggccacaataagtgagccaacagccgcagagaatacgacaccagccaccctagagttagtcgacacacg

SEQ ID NO: 501637 - DNA, 482 bp, Homo sapiens
gttctgtgctccgcagggcgcgcctctctccgccaatgccatggcgcgcgggggagccattaggaggcgatggagagaggagggcgcatgctccctgtcccagcccagccctgcccatgcccttgccctggatggcatgactgctgcctggaacctgtggactgctgaataaatatagcagatgctggatgtgcttctgctgcatgcaagatgccctgtgctgccgccctgcatccagggtttgcgttgaattccagtgcagtggtgtgacactgatgcctatgtgctgcctgcctgcctggatgcccattgctgggatgccctgtgtggcccatgatcgcctgtgaagacagctggtcccggctggttccaaccgctatgcccaggcctgagccgtgggccatggcaaccccatgtgggcccccttgcgatttgccaatgggtccgtttgcgagtgttggcactgcggatgaacattgcac

SEQ ID NO: 501638 - DNA, 396 bp, Homo sapiens
  misc_feature (393)..(393): n is a, c, g, or t
gggactgcgtcagacacacagtgacagtggcagcagaccctctgggacattgagcacgatgatgccgatgaggaagatgacagcctcaagccagggtgtatccgagaaatgaggggagaggattaaagaaggagacacccagtgaagacagccacgccgggtgatgagcttggatgaagtgctcaatctcgaatggcgatggggcgtctttgcccacctcccaagcccctgatgccagggttggcgattacgtgcccatgaccagtgctggtccgcccgttgcccaaccaccaacgcccccgaggcggtgtaccggaggctcgaaatttcggtaattcatggctcataaggcttgtttccttgtggtgaacatttgttatcccgggttaagtncca

SEQ ID NO: 501639 - DNA, 340 bp, Homo sapiens
gatcgagctcggtaccgtgtcgatctgacgacaggcactgcatatcggccttacggtctacgttgccgcagcctgctctaggcagcgcctcggtgaccaccaggaaccccatcgagccctcagccctggatgccggcgtactaccaaggttgtgtattcctagacccgtcctgaaacacttaccatagctcccgtggactggaggggttagtcatggcatagccatgcgtggtagcaagcagagaaaaaatcaacgagcaaacaaaaccactcaaaccaaaccgtcaacagcataataaaatcccaacaactatttttatttcatttttcatgcacaacc

SEQ ID NO: 501640 - DNA, 736 bp, Homo sapiens
  misc_feature (21)..(21): n is a, c, g, or t
  misc_feature (61)..(61): n is a, c, g, or t
  misc_feature (63)..(63): n is a, c, g, or t
  misc_feature (104)..(104): n is a, c, g, or t
  misc_feature (225)..(225): n is a, c, g, or t
  misc_feature (245)..(245): n is a, c, g, or t
  misc_feature (250)..(250): n is a, c, g, or t
  misc_feature (404)..(404): n is a, c, g, or t
  misc_feature (429)..(429): n is a, c, g, or t
  misc_feature (462)..(462): n is a, c, g, or t
  misc_feature (482)..(482): n is a, c, g, or t
  misc_feature (491)..(491): n is a, c, g, or t
  misc_feature (505)..(505): n is a, c, g, or t
  misc_feature (518)..(518): n is a, c, g, or t
  misc_feature (541)..(541): n is a, c, g, or t
  misc_feature (553)..(553): n is a, c, g, or t
  misc_feature (566)..(566): n is a, c, g, or t
  misc_feature (574)..(574): n is a, c, g, or t
  misc_feature (595)..(595): n is a, c, g, or t
  misc_feature (601)..(601): n is a, c, g, or t
  misc_feature (606)..(606): n is a, c, g, or t
  misc_feature (633)..(633): n is a, c, g, or t
  misc_feature (641)..(641): n is a, c, g, or t
  misc_feature (650)..(650): n is a, c, g, or t
  misc_feature (670)..(670): n is a, c, g, or t
  misc_feature (732)..(732): n is a, c, g, or t
cgggatggtggacgggcccanaggaattcagaattaaaccttgaatgcctgcgtccgtgananttcagcatggaatgtctctactatttcctgggaattctgcncctggctgcaagattgccacttgatgccgccaaacgatttcatgatgtgctgggcaatgaaagaccttctgcttacatgagggagcacaatcaattaaatggctggtcttctgatgaaaangactggaatgaaaaaactcnacccnagtgtggaagcggggagacatgaggtggaaaaactcctggaagggaggccgtgtgcaggcggtcctgaaccagtgactcaccagccctcgtgggctcaaaatataacatttgcggtgaacctgatattccctagatgccaaaaggaagatgccnatgagcaacataatctaatgaaaanaactgacaaaaaatgaaggctggttttatctgnctgaatccggtatgtattanaaatggaanaacatgtgtcaaangacagatgacggnggaaaaatggcaccggccaaaanccaatcaataangtcttcccttgangggaaaanctttttcctcaccaccccggnatgganaaganggaatttcatctacgtcttccacacanttggtcantatttccanaaaattgggacgatgttcantgagagtttctgtgaacacagccaatgtgacacttgggcctcaactcatggaagtgactgtntaca

SEQ ID NO: 501641 - DNA, 161 bp, Homo sapiens
gaggatccctgtagcagcccgacagcaggaggaggtacatacctgtcgtgcccgcctctgtcagaactccgacacctgaaccagctgaggtggagactcgcaagggtggtgcttgatgcagtgcacacattgagtcgggtggacggagggagtcaaacacc

SEQ ID NO: 501642 - DNA, 890 bp, Homo sapiens
  misc_feature (72)..(72): n is a, c, g, or t
  misc_feature (285)..(285): n is a, c, g, or t
  misc_feature (299)..(301): n is a, c, g, or t
  misc_feature (303)..(303): n is a, c, g, or t
  misc_feature (308)..(308): n is a, c, g, or t
  misc_feature (312)..(312): n is a, c, g, or t
  misc_feature (324)..(324): n is a, c, g, or t
  misc_feature (329)..(329): n is a, c, g, or t
  misc_feature (336)..(336): n is a, c, g, or t
  misc_feature (338)..(338): n is a, c, g, or t
  misc_feature (341)..(343): n is a, c, g, or t
  misc_feature (367)..(367): n is a, c, g, or t
  misc_feature (384)..(384): n is a, c, g, or t
  misc_feature (387)..(387): n is a, c, g, or t
  misc_feature (396)..(396): n is a, c, g, or t
  misc_feature (403)..(403): n is a, c, g, or t
  misc_feature (410)..(410): n is a, c, g, or t
  misc_feature (412)..(413): n is a, c, g, or t
  misc_feature (417)..(417): n is a, c, g, or t
  misc_feature (419)..(419): n is a, c, g, or t
  misc_feature (423)..(424): n is a, c, g, or t
  misc_feature (429)..(429): n is a, c, g, or t
  misc_feature (431)..(431): n is a, c, g, or t
  misc_feature (433)..(433): n is a, c, g, or t
  misc_feature (435)..(435): n is a, c, g, or t
  misc_feature (439)..(439): n is a, c, g, or t
  misc_feature (446)..(446): n is a, c, g, or t
  misc_feature (448)..(448): n is a, c, g, or t
  misc_feature (454)..(455): n is a, c, g, or t
  misc_feature (467)..(467): n is a, c, g, or t
  misc_feature (889)..(889): n is a, c, g, or t
cgagcttctagactagaggtcttaacaataagagagcaaacaaaagaaagaagctcgaggtagaaccatgtnacttcactttgaggataaaaccagaaaagtgaaagatgcaagcatgcaagactcatatacatttgaaatctatgatcctcggaatccagtgaataaaagaaggagggaagaaagcaaaaagctgatgagagagaaaaaagaaagaagataaaatgagaataatgataaccagaacttgctggaaatgtgcctacaatggccttgtaacagccnttgttcccaacggnnncncttangggngtgaaaagaagnatttntgaaccngntgnnnggttttgaaaaacaattatcttgntttgcaaattgtggaangangtaagcaantgctttngggtacngnnacangngttnnttccnancngncctnttatatngntaaatnngaaataaaatanctttccttcccattagcaaaaaagaaaagaggaattaaatatgctgtgagtgagctaggagggatagcgataatcggagtgcgcctcgtggacctcaataggtgggaacccttgctggcctgtttccttttatggggggggtagttcagagaaccttcgcttcactgaacccgctggcgcttggagacatccatgctcgaggcgatcacgagaaggggttagcaaaaaggggggaagtacagggttatcgaccggaatctggggaaggcggccaggacaacaccctgtgtgcactaaggccacccagagcgtcgggaatcccgcataaagggcgcccgtggtttgcggcctcttccattgggcggcacagcttcgcgagacagttccgcaaaatcgcgccggtgtacctcgacaagcacgcnc

SEQ ID NO: 501643 - DNA, 875 bp, Homo sapiens
  misc_feature (57)..(57): n is a, c, g, or t
  misc_feature (270)..(270): n is a, c, g, or t
  misc_feature (284)..(286): n is a, c, g, or t
  misc_feature (288)..(288): n is a, c, g, or t
  misc_feature (293)..(293): n is a, c, g, or t
  misc_feature (297)..(297): n is a, c, g, or t
  misc_feature (309)..(309): n is a, c, g, or t
  misc_feature (314)..(314): n is a, c, g, or t
  misc_feature (321)..(321): n is a, c, g, or t
  misc_feature (323)..(323): n is a, c, g, or t
  misc_feature (326)..(328): n is a, c, g, or t
  misc_feature (352)..(352): n is a, c, g, or t
  misc_feature (369)..(369): n is a, c, g, or t
  misc_feature (372)..(372): n is a, c, g, or t
  misc_feature (381)..(381): n is a, c, g, or t
  misc_feature (388)..(388): n is a, c, g, or t
  misc_feature (395)..(395): n is a, c, g, or t
  misc_feature (397)..(398): n is a, c, g, or t
  misc_feature (402)..(402): n is a, c, g, or t
  misc_feature (404)..(404): n is a, c, g, or t
  misc_feature (408)..(409): n is a, c, g, or t
  misc_feature (414)..(414): n is a, c, g, or t
  misc_feature (416)..(416): n is a, c, g, or t
  misc_feature (418)..(418): n is a, c, g, or t
  misc_feature (420)..(420): n is a, c, g, or t
  misc_feature (424)..(424): n is a, c, g, or t
  misc_feature (431)..(431): n is a, c, g, or t
  misc_feature (433)..(433): n is a, c, g, or t
  misc_feature (439)..(440): n is a, c, g, or t
  misc_feature (452)..(452): n is a, c, g, or t
  misc_feature (874)..(874): n is a, c, g, or t
tatttcttcttagatgtatttagctccacccgtacgcagagtttaggggaaacaagnacttcactttgaggataaaaccagaaaagtgaaagatgcaagcatgcaagactcatatacatttgaaatctatgatcctcggaatccagtgaataaaagaaggagggaagaaagcaaaaagctgatgagagagaaaaaagaaagaagataaaatgagaataatgataaccagaacttgctggaaatgtgcctacaatggccttgtaacagccnttgttcccaacggnnncncttangggngtgaaaagaagnatttntgaaccngntgnnnggttttgaaaaacaattatcttgntttgcaaattgtggaangangtaagcaantgctttngggtacngnnacangngttnnttccnancngncctnttatatngntaaatnngaaataaaatanctttccttcccattagcaaaaaagaaaagaggaattaaatatgctgtgagtgagctaggagggatagcgataatcggagtgcgcctcgtggacctcaataggtgggaacccttgctggcctgtttccttttatggggggggtagttcagagaaccttcgcttcactgaacccgctggcgcttggagacatccatgctcgaggcgatcacgagaaggggttagcaaaaaggggggaagtacagggttatcgaccggaatctggggaaggcggccaggacaacaccctgtgtgcactaaggccacccagagcgtcgggaatcccgcataaagggcgcccgtggtttgcggcctcttccattgggcggcacagcttcgcgagacagttccgcaaaatcgcgccggtgtacctcgacaagcacgcnc

SEQ ID NO: 501644 - DNA, 639 bp, Homo sapiens
  misc_feature (1)..(2): n is a, c, g, or t
  misc_feature (11)..(11): n is a, c, g, or t
  misc_feature (14)..(14): n is a, c, g, or t
  misc_feature (23)..(23): n is a, c, g, or t
  misc_feature (55)..(55): n is a, c, g, or t
nnaaaaaaaanaanaaaaaaaanaaaaaaaagaagaaggaaaaaaaaaaaaaaanaaaaaaagcccaggtagtaccatgtacttcactttgaggataaaaccagaaaagtgaaagatgcaagcatgcaagactcatatacatttgaaatctatgatcctcggaatccagtgaataaaagaaggagggaagaaagcaaaaagctgatgagagagaaaaaagaatgaggagaaggagataataatgagagagagagcttgtagaaaaagtgaatacagaggatataataataacgtattgttgaaaaaaaaaacacctaccgggcagctacagcgggtgctcccgtccccctgccacccacccccgcactccacgacactccacccctcctaactatgccttcatttgctcctttcgcttccactcatcaattaatcacaccctcctccactccacacctcacccacaccacccaccccccacagagacccgacaggacgttaaccgctatccacccccggacgtggcgcgaccgaccgtaacgcgcgacacgatgcgtcttcgccagccccgcggagtcccccaccacaaaaccccccgcccccctggcacgaaaggtcaatccctacgcaccccccccc

SEQ ID NO: 501645 - DNA, 96 bp, Homo sapiens
  misc_feature (31)..(31): n is a, c, g, or t
ggcctctcttccaaagtaagaaatcacatangcttacgttttactattcaaatcaatcctccctcccattgcacttatctaccttccccaagttgt

SEQ ID NO: 501646 - DNA, 366 bp, Homo sapiens
cacgtccgtcctaacgccactatgctctgaagcagtaacacgagatctatcgaatgttctcagtagtgtgctaagctcccatagatctcacttattaccttttttacttcttatatctttgccacacaagaagccttagcccttaacaatcactctctttcaccttggatcattactatattctttgtaattgatcctaatgtcagatgttagtggataccaccttctttgaactccaaacctaaattatatcttattggtgtgtgtgtgtgtgtattaaagtatactcattgtcatggatttccccatataagtatgtgtacaattattttattattatttgtaatgtctaagatgtctaatagg

SEQ ID NO: 501647 - DNA, 427 bp, Homo sapiens
  misc_feature (240)..(240): n is a, c, g, or t
  misc_feature (243)..(243): n is a, c, g, or t
  misc_feature (318)..(318): n is a, c, g, or t
  misc_feature (330)..(330): n is a, c, g, or t
  misc_feature (357)..(357): n is a, c, g, or t
  misc_feature (367)..(367): n is a, c, g, or t
  misc_feature (390)..(390): n is a, c, g, or t
  misc_feature (405)..(405): n is a, c, g, or t
  misc_feature (422)..(422): n is a, c, g, or t
aaactagaaaagccatagataccatacagtaaacatcactcttttaaaaaatattttttatttcggcataatttcagagttttacaaaagttgcaggaatagtacaaagaattctcttcacttggatacctaaatgttaatattttactacatttgctttatccttttctttctctgtaatttgtatttgaaccatttgaaaggtaagtagcagggccgggtgccaccgcaccccggtantantggtagggggttttctaaaaatcatggtccaataacccaccaaggggggcccatccaaaatcagggggtggttangtggggggtacngggccatttatttataccccgggcttnccctgggggnttttaccttaaaattttaccccnatcgggttaccaccnctttctttgttgggggnggtcc

SEQ ID NO: 501648 - DNA, 148 bp, Homo sapiens
ccagcaaggttcttcggatgatatgcgtccgcccccggaggaaatgttcgttcgtggccccccccggcccctggggggggcccggcccgggtttttaaaccctacccccgagggtttgccccaaaaaaggggggcggccccaaaaaaa

SEQ ID NO: 501649 - DNA, 108 bp, Homo sapiens
tagtgagaacacctgcaaagagcagggcgtaaggagagagagtcctgcagcagatggcctgaggtcacccgcgaagggttccgtctgaagaagatccttattgagtga

SEQ ID NO: 501650 - DNA, 355 bp, Homo sapiens
tagacccttcctgcatgtgttttaacatgaaaatcagtaggaagatgtggtatactcataatggaaagtgtaatgtaacaaaactctctttcgttaccacaaattgttgtgagtttagtactctactagattgccccataagatcagtagcttttgacaactcataacttctctgaaataacactgaaagacatttaattcaaggatcagaaattgtggccatctttgcaaatgactacctatagcctgtgaaaatacatttcataaaatgttatgtgcaatgaacactaaatttaatagcagttacagtgtgactcactcatgtttaaaaaacatcgaagagctaaaaaatacg

SEQ ID NO: 501651 - DNA, 192 bp, Homo sapiens
tcggcacgagctcagagctcccagcccttctcctcctgctaacccttctcactccctcaagaggagttagaaaagaggtccttcatctcactctatggaaaatggaacaagaaataatcatatcttcttcccacccttctcctgtatttaggatttctgacaagtggcttagattggtctctagagcgactg

SEQ ID NO: 501652 - DNA, 809 bp, Homo sapiens
  misc_feature (70)..(70): n is a, c, g, or t
gtcaagtcgtaaaacccggtgtccattccgcaccattcccgtatctcttccaatgttgctttctctcttntatcatcagtactcaagtactatataggtgtaagaaagtaggagaagagcaagacatgatcagacagaaaacaaactattaaaacccacacaaagatatacgcaggtatgttgtgtcagaagcactttacatccagtactgactttaagaggagaggtgcaacaacgaagcttacgtgaaagcagaatgcgtgtgcccaacaagtattctcttgtgtactgaggccacagtgacaaagaagagagggatctttctggacgccaacaggaaccaggcgttcgccccacctccgtttaccgactcctgtttcccaggttgatgctgctattggagttactaatgccggcatcttcagacaccctgttaatctctcagtttccctgtgaccacaactatactgtggaggatacaatgcaccagcggcaaacggattcatcagctagaacagcaagttgaacaaactcagaaagaagctcaagaccgcacagcagcgatgcagaaggcaagaacggcagcttgaaacattcacaggaggtcgtgcacttaccagaaagagaaagacgacgtatcagaaagaggtcatgtgattctaccaacatgacctactttgaaatagttgaagtaccagcattaaaacaatgaaatgtgtattgatttctaatggggcaataccacattatcctcctctagcctgtacaggagttcattctaaacaacatcacatttgataacttatatc

SEQ ID NO: 501653 - DNA, 284 bp, Homo sapiens
ctatcctcctgcgcagggccagagaagccagacccagtagcaacacatcagcttatttcactttaacatacacccaacaccattcccatattacaacatgtggggcatagggcaacccacgtcagtatctttccagcatggtcattcttccagcactcatagcacaggcagcttcccagattgcacattccacccaggtggcaccaaacatgcaggcacaacaccaggtgcaaccacagcttatttctcgtcattctcaccatcaccacacagtccagcatcca

SEQ ID NO: 501654 - DNA, 672 bp, Homo sapiens
  misc_feature (583)..(583): n is a, c, g, or t
  misc_feature (587)..(587): n is a, c, g, or t
  misc_feature (607)..(607): n is a, c, g, or t
  misc_feature (615)..(615): n is a, c, g, or t
  misc_feature (649)..(649): n is a, c, g, or t
agcgtggtcgcggccgaggtacggtgtggacctcatcagatacacccatgcagccaacacagtcgtttacagctctaacaaaatagacgatactattcgttacttgtccttgcatgacaataaatacatcagatactttcctggacacagcaagagggtggtggccttgtccatgtcacctgtggatgacactttcatttctgggtctcttgataagaccattcgactctgggatctccggtctcctaactgccagggcctcatgcatctacagggcaaacctgtctgttcctttgatccagaagggttaatttttgctgcgggcgtcaactcagaaatggtcaaactttatgaccttcgttcttttgataagggaccatttgcaacatttaagatgcagtatgataggacctgtgagtggacaggacttaagttcagcaatgatggcaaattgatactcatctccaccaacggcagctttatccgactgattgacgcattcaagggtgtggtgatgcacacatttgggggttatgctaacagcaaaagctgtgacactcgaagcttcatttactccagactncagntttattatgaaccgggtcanaagacggnaaaaatccacgtctgggaatggagagaagtggtntaaaaagtggctgtatttggatg

SEQ ID NO: 501655 - DNA, 403 bp, Homo sapiens
gctattgacacagcgatcagtaccctagatcaaagccagagtcatctacagggtcaaggatgggcaccgcgcaggtgtacttaaccagttcttaaagggaggcctacgaacgcaaccagggcactaagaaacaaatgtgaaagccgtaaaatcagatacccaggccagactaacatggcttgtcacccgcctaaagagccagccttacctagaaaatgacacgacttcgccatctggaccgtccttggtcttggcaaagctctagagacatattggctctattaaaaactcagctaataaagcactaagcttgattttcgtctatgctacagtctctttcttctaagggaaagaagatctccccaagaataggatgctacctgaggaatcatgccacctctca

SEQ ID NO: 501656 - DNA, 995 bp, Homo sapiens
ctcaatgccgcgcagtgcgcacatgtgacaggcaggtagctggcacagaagagccaaaagctcccgtggttggctggtaagcacaccacctccagctttagccctctggggccagccagtgtagccgggaagcagtggtggccctgccctccacgtgtgagcagttgtgtgcccctgccctggtgccagcctcatgtgagaacgtgagtggctgaaggtggagtgggatgtggaaatggggaggatgtgcctctgcccctttctgctggcttgcctggctgtgccatttgtgccgaaagttccctgtactgtcactggctgatggtgcagttcccctaaagtcctgtgcacataagcgtggcagaactgcactgcgaagcggcttcttcagagcacgggctggaactggcaggcaccgggatgcccctagcaccctgacaagctgatgttgtgcaggacgagtccccaggcagacccacaccacatgccgctgaattgagtgcttccaagtgctgtccgctcgcgggcccgcagaagccccgccgtggtgtcctgctgctgaggcgcccccagccagtgcgccttacctgccagactggcgcgccatggggcaaccggggaaagcgggaggcgccttctttgatggcaccccaaatggaaagccattgcgcctggaccacgacgtcactgcagccaaatgggacgaggttgtggagtggatgggccattgggcatcgtcaatgtctctcaatctgtcctggcccagtcgatgtatggcattgtgctggtcatcacgaggcccattgccaagttcgaagcgtcttgcagacgtgtcacccaactaacttcagtccattcacttggcctgtgcgtgatctgagtcagtgtgcctaagcagtggttgccctttgagggccgcccatattcttatgacaatgtggacgtggggcacttcctgtggagatatgggcattccgctggtgtggagggggacg

SEQ ID NO: 501657 - DNA, 850 bp, Homo sapiens
tccatttgggtttttttaatttaaaaaaaaacagtttcctccaagggcgacaaattaacctgaaggtcaaaaggaacctggttgcgggttctcctgaaagctctgtgccccaaaacctggaattgaggaaagggccccccggagcctcgtgcgggaaggtgggtgcccccagggggtcccgtgggtgtgggggaaaagagccgccagcccacacacggttcacgtggatgggtgtgagtgtggttcccacagcgacgtgccatgtcctatctccacgtgacttgtttgactttaacactctgggggggcctacaatatagggaactgacacgggagccaagagaggtggctacatccggctgggactcctgattcccactcgggaaatagtcttcatcttggtgcacccataagttcacattttccctgggagcggtttcgacggagcggtgagaccgtccggggggtcgatgtcccgccgggtgccccgtgccttcaggatgacgctcgtagcatgaggctggcaacggggggggggggcgggttgcccaaggtcgcctgctggaaatgcacttctgcggggtccaccaccgaagtgaattcccccctgcacatcccctttgtggcctagtggaagacagatcacaaagggttactactacacactcttggccatattccagcaagaaacggattgccccgcagttagcgaaaaccttagggagtcgtgtgccttatctagccctgcagatagtctgttgccccgaaaccttcacctccgagaaaccctaaggcccgagggaagcctcccgtaaacgccagcccaatcccaagcctaacacccccggag

SEQ ID NO: 501658 - DNA, 1384 bp, Homo sapiens
  misc_feature (532)..(532): n is a, c, g, or t
ggccctggtgtgattcttgtcctgcgcggttgttctctgagagcagcgttctttatatctcctgtcctgcccttctctcctacctaatgtgcgtgcctgccaccctgatggcaagattcgatggacatgtgacattgaagcccccttgaggccccaagaactatctatttcgcgttgtgaacctaacagtgccgacaaaagatttatcactttcacgggtgggataatgatggacaccttgaggcaccaagttaatcttttaacagaagcggtcagttcaagggggttgggtgcaaaagtgattgagtttgcacatttgtttgaatgcagcagggcaattgaattacggaaagggcagttccaaatttaacagtaaacacttgggcaactttttgcaacaatgtccttgttcacatggccaaaatcggttttccctttggggggcttttgcaacataacaaccaaccaagtgcgtcctcaaaagtgtctcgacagctcgtagtgttccacggggccaaggttgccattattncagtgggacatgccacttaagataggcttgtgggacggcaaagattgcaagaagtcaagcacgcattgacacaagtgcaggacgggatggttgcaaattcttcaaggtattactcttgggaaaagacggggcttgtccccctgtgaggggtgtgtggtacccccaaaggtgtttccccccaggcgaaaacacaaggggttttaacacactcttggctcgtggtcgcgactgtcagcaacacttgtctgtgaccgcagtcgtatggacattcaaacccagagacgttcacgtcactctaccgaccatcactcgccgtcatcgtgcacagacaccttcgagcgacaccaaagggacaacgacctcgtcgtaacaaacaaaaagcccccgggtgacagagacacacttctccttatacgaggaaaaaatcctccgcgcgcaccactgtgctgtcccgcacacctatcgaccatcaccgctactggctctccgacatctcctcacaacccacactatttaacccccccccgacacaacacggcaaacacgcacaccacccccttcttactagacagacgcacagaccccttatatcaccaacaacgggcagaccttgtgaggcatgcagaacaccaactacaggcctaccatacaacagcaggttctcacacaatgcaagccagacaccacatccacccagctgagagcagccctaactcaaacgtggatggctgcataaccatgcgaaacacacgtacttctcacagcagcctggttgtgcgcttcctgtttgtgtctgctcttttgcttctcactactacttctctgctatggtcagtatagacaaaagtactg

SEQ ID NO: 501659 - DNA, 544 bp, Homo sapiens
gtatattttatctggtcgatttaagatttgatgtgtaggagtcttttcatttgtgactaaaatgatgtgaagcaatggtcttttttttcatttctggtaaattaggattatgaactagagatgggttgaattgtatcatttttatgcgataggcactaaaaatttaatccttagcttccttttgtatctgtatagcctttattcaatcttgagttaaaggatcacctgattatacaaattcatatcatctttcatgttttgccgttgaagttgtttagtctcacaggcctaaaactagtaactgaagagacatagctacatcttgctatagaataggtcctcagcccaggactcgtaacagtgtcaccccactttttctctgaccaccctttacctgacagcctttaagtttcagttaagggaaaaggttagatgcattggcgtagcaagttttctccaagtaccagatcacaagatgctctaataaactttttcagatgtcccaactggttaacatcatggtctctggagtcacaccctatga

SEQ ID NO: 501660 - DNA, 516 bp, Homo sapiens
  misc_feature (218)..(218): n is a, c, g, or t
  misc_feature (220)..(220): n is a, c, g, or t
  misc_feature (223)..(223): n is a, c, g, or t
  misc_feature (233)..(236): n is a, c, g, or t
  misc_feature (244)..(244): n is a, c, g, or t
  misc_feature (277)..(277): n is a, c, g, or t
  misc_feature (279)..(279): n is a, c, g, or t
  misc_feature (284)..(284): n is a, c, g, or t
  misc_feature (295)..(295): n is a, c, g, or t
  misc_feature (309)..(310): n is a, c, g, or t
  misc_feature (312)..(314): n is a, c, g, or t
  misc_feature (320)..(320): n is a, c, g, or t
  misc_feature (329)..(329): n is a, c, g, or t
  misc_feature (342)..(342): n is a, c, g, or t
  misc_feature (366)..(366): n is a, c, g, or t
  misc_feature (375)..(375): n is a, c, g, or t
  misc_feature (413)..(413): n is a, c, g, or t
  misc_feature (415)..(415): n is a, c, g, or t
  misc_feature (420)..(420): n is a, c, g, or t
  misc_feature (428)..(428): n is a, c, g, or t
  misc_feature (434)..(434): n is a, c, g, or t
  misc_feature (439)..(439): n is a, c, g, or t
  misc_feature (444)..(449): n is a, c, g, or t
cctcagctgcaatccaatgaaactaaagccgttccagaattatcaaaaactgacagcaaacctgggggacatgaatcatcaggaattcccccaactggaaggtccttctctggcctcaattgcgtctcaaggccacgccttccacgtacagtggagtcttccgcacccagcgggttgaccttgaccagcaggcctacccaccaaatgccctgggctgnanacntaagccttgnnnncggacagngccgccacctcgagaagggccctcccgacgggnanaggancctgggtcccnaggggacaaggagnngnnnagcccncaccccgcngagggagttcctnttgccccctacccccggggcttgnatatagatnataaatataaagggggaaaggggtgggcggggaggggntntgggnctggggcntcactnccccncctcnnnnnncccctggtcccctgtccctggggctgtttgttaaaaaagagtaataaaaggatttaaaaaaaaaaaa

SEQ ID NO: 501661 - DNA, 382 bp, Homo sapiens
ggcccagttatactatggaaacatcccctggcagtgatcaaatatctgcgaatggaatagagataatataattatctcccaatgtatctttaataggatacatggcatatgaaaatctttagcacagtccgcctataaatgtagaaaaatgagaactatttaaaagaagggggcgcagaaataatccttttctagtattactctgggttgtcagatatctttgcaatataattactgtgttggtttttaaaggttaaaagagctctgacgtttataattctcttttgtgtgtgtgttctacacatataaggggaaaatctaacacatggaaggaaaatactttagttaacataaaggtcctgagcattttatggtttgtcaa

SEQ ID NO: 501662 - DNA, 246 bp, Homo sapiens
agatctatttctcttccacaggcagaaatggagaagcttacaaaggtgagaatccacataccagctcaggagggagctccagatcttcttccacatcccagccacctccttcctcttgtcccttgccaagagcatcatcccccaagccttctgtagcctccacaaacccatctgtaaagaaaatccaggctcaaaatagatttgtggaatgacatgattttgataagaaagcaaaaatgttgagat

SEQ ID NO: 501663 - DNA, 94 bp, Homo sapiens
ttaacaattgttggggcctaaacccaaaatgaatttcaaaaggtactttgttttccaaaaatgtcattcttttgggaataaaaacttttggtga

SEQ ID NO: 501664 - DNA, 521 bp, Homo sapiens
ataaactggaaagtcgagttgtcccacgtttgcttgcggtcgccggccttttccagactgaaccaatgtacatcttacatgtgttgatatgatgtctcatgtctccctaaaacgtatgaccaccttggcacatgtcgtcaggacatcctgaggctgtgtcacgggtgtgcatcttcaaccttggaacaataaactttctaaattaactgagacctgtctcagatatggggggttcaccattttggtaaccatggagggattctgagttgaggtgcccctgacctttgacagatctataggtgcttggtagcagcatgagctaaccttatggctcaaaccaacaggacaatttgctgaggtctgggagcaccccctccagagagtccctgatctctcaaaacttggtcgtgatctaaagtttatttgatgtacaactccccctccccttcttttggagttttatttgcttccaagaaggcaggcaagatttcctgggtccgtgatgatggaaggctgacaac

SEQ ID NO: 501665 - DNA, 131 bp, Homo sapiens
  misc_feature (28)..(28): n is a, c, g, or t
  misc_feature (64)..(64): n is a, c, g, or t
  misc_feature (92)..(92): n is a, c, g, or t
ggggaaggaggatggcggatatcatcgnaagactccgggaggacgggatccacgtgtgatacangaaggccgaggagagctcccggactttnaagatgggaccggccacgttccactaccggacgctgcac

SEQ ID NO: 501666 - DNA, 257 bp, Homo sapiens
  misc_feature (243)..(243): n is a, c, g, or t
aacatgtggacatggaaattattagcagtttctagagcagaaatttatagattagaaagctagtttgggagtaaattccgttttgatagaagagaatttccagactgtgttcattggcttccatgccgtgacctataccagttaagccttaaatcacagatacgtgccttctccgatgcagtaattccttgcccaaccatttgtaccataccatgagggaaccccctatgggataaccatttngattccacctggaa

SEQ ID NO: 501667 - DNA, 145 bp, Homo sapiens
ccgatgcgctggcacctgcctgcagatcgacgccgtgttgctacaacgccttcatccaggaacagagcctgggctatcactacaacgccgtcaacgacctgctggactacgtcagcaaccgcgaggtgttcgcctacgagaacgg

SEQ ID NO: 501668 - DNA, 152 bp, Homo sapiens
cgtacgtctaggtactcagtccagttcgcactgtcatatactagtaggcaatctatgtacggatagccacaaactggacagagccaaagttacgggccccctgggtgatagatagcctagtcacctaccttacgaggagcccaggtaccacc

SEQ ID NO: 501669 - DNA, 595 bp, Homo sapiens
tacatttatgctagggaaaaaccagctgggaaatgtccaggggaaagctatgcacaggcccgcgccctagggaggggggatgtgttgggggagggtgcttgtttcccgggtctccatctcccacagcgttgtgtctccagttgggatctccttatgtggcgggcgtggcgtggtggcttttcttcttctctccgtggctttcttcttctccctcctctccagaaataggggctcgtgcggagactctctcgtgcttatagcacagagtgtgggtggccagaggaacgtgggtggaagtgggtgtgggcgtggaaaacccgaggcgccacatgtgtgctctccaccgaggggaaaccgtggtcgtgctcctccagcgggaccttcacagtgttatttgtgttctcaggaagtggccaaaaaccctcagtgtggttcaagaactcgtgaatacctcccggaactcgcggcgcggccatttttcttccgagggggccacatttttataagtgatttccactcctttcccgatccgtgccttctgcacttttatagcgagggggttaacagaaagttcgaaccgggtcaaagcgacggt

SEQ ID NO: 501670 - DNA, 184 bp, Homo sapiens
tttttttttttaggggggggaaatttttccgaaaaaaggtctttggggaaaaggaaaggcccttaaaatcccttaaaaatttattttggccccttttttcctaaaagggagggcccaaagaggttaatttttttttttttcccttccctgggaggcccccgccaataaaagggtttcccattga

SEQ ID NO: 501671 - DNA, 271 bp, Homo sapiens
ggtttaaaaaattttttttttaaaatttttaaaaaggaaaaggttcccaaggttttttgggaaaattccttgttccccccaggaaaaaaaaaaaaagggttcccggtttttaaaaaaaaaaaaaatttttttttttttaagggaaggggccagggtttaattttggggccctccccaaagggggaaaatgggaaaatttttttttaaaaggaaaaggtaagggggtggttttaaaaaactaaaaaaaaaaatttttttccgggggaaagga

SEQ ID NO: 501672 - DNA, 543 bp, Homo sapiens
  misc_feature (22)..(22): n is a, c, g, or t
  misc_feature (81)..(81): n is a, c, g, or t
  misc_feature (311)..(311): n is a, c, g, or t
  misc_feature (348)..(348): n is a, c, g, or t
  misc_feature (371)..(371): n is a, c, g, or t
  misc_feature (491)..(491): n is a, c, g, or t
  misc_feature (493)..(493): n is a, c, g, or t
  misc_feature (495)..(495): n is a, c, g, or t
  misc_feature (506)..(506): n is a, c, g, or t
ccatcacagggaaaaaaaaagncctaagaatggaacaactgggcacctaggaaacaaaatgaaaagaacagtgttgttgancacctctggcctaaatcttaaaaacacatcctacctcctatgcccacagtatttgtcaataatctggggacagagaaaaagacattctgaaataaggggtcagagctgtagcagaaaatgtacatccttatttttcaggaatttatagagaaaggctactgttatgtgtgatgatacaaaccccagtaagagaggccagctcttgcctataatcccagcactttgggaanctgaggcgggagaattatttgagcccaggagctcaanaccagcccgggcaacatgggganaccctgtctctacaaaaagttagccaggtgtggtaagccatgctgcggtcccagccactcggaggctgaggcgggaggattgcttgaagcacctcaaggtgggtgcagtgagccatgaantncnatgcactcccncctgagcaatgaaggaagccctgtctcaaaaaaaaaa

SEQ ID NO: 501673 - DNA, 331 bp, Homo sapiens
cgggcatctcaccacgagttctgctggggtccgcacacggtcactgacaacgacagtcagttgtaggaactagagtgcggtgtcatcagacttaccctgtcctgccgcaccttccgtgctaacatcgaggtgtgtgcagttaccttctgagcggggaacaagcggactggaattttcctctgctacctctgtgtgtataaaatgttgttggtaaaatttcgaagggaagtgggtacactaggggggaaccttaattgtaaatttggttcatgtgtggcaaagttcttagcggcgaagagtataaaataaatttgtcgaaaagagaaagaaa

SEQ ID NO: 501674 - DNA, 257 bp, Homo sapiens
gttggtggggacagtgggacctggggctgaaaggagacggcctctgggttaagcagaagccctaatttagcccgtggcacctgaaccatataagagaaggaaacgcttcacatttctgcatctgagattggactctggcgggcctggagccttggggagcagcaagcccagtccccaagcctactcgaggcctgagcctgattacctgccggaagtcgtctcccaccttgacgctgggctgcctgccaggagatctt

SEQ ID NO: 501675 - DNA, 177 bp, Homo sapiens
  misc_feature (47)..(47): n is a, c, g, or t
  misc_feature (86)..(86): n is a, c, g, or t
  misc_feature (101)..(101): n is a, c, g, or t
  misc_feature (122)..(122): n is a, c, g, or t
ggtgctccaccccagcttccctgcctcccaaccatcgtccctgcagnctgcacaggcccggcagcagccaccgcagtactacctgnaggtacaggcaccancctctttgaacagtgagcagnaggactcgctacttctctccacctactcacaacaggcaggggccctgggctaccc

SEQ ID NO: 501676 - DNA, 291 bp, Homo sapiens
ctgggcgtgctggctcacgcctgtggtcccagcactttgggaggccgaggtcggaagtttgtagaccagcccggccggtatggtgagaccctgtcccttctaaaaatgcaaaaatttagctgagtgtggtggtgcatgcttgtggtcccggctgctcgagaggctgagacacgagagtcgcttgaacccgggaggcggaggttgcggtgagccgagatcgtgccgctgcactccagcctgggcaacagagtgtgactgtcttattaataaataaataaatacgaaaagtga

SEQ ID NO: 501677 - DNA, 278 bp, Homo sapiens
ctctacgataacaataacaaaacatttgctgagaggctacctagcaggttctcagtcctggctgcaccctacaatctcttaggttgcttttaggtagatttcctctcattcaggtgaaattcacttaacataaaactcaccattttaaaatgtacaattcagtggccttaagtatattcacagtgttgtgtagtcctcaccactatgtaattccagaacatttccatcatccccaaaagaaaccctgtattgattagtagttactctccactcctaat

SEQ ID NO: 501678 - DNA, 428 bp, Homo sapiens
  misc_feature (113)..(113): n is a, c, g, or t
  misc_feature (117)..(117): n is a, c, g, or t
  misc_feature (167)..(167): n is a, c, g, or t
  misc_feature (195)..(195): n is a, c, g, or t
  misc_feature (200)..(200): n is a, c, g, or t
  misc_feature (224)..(224): n is a, c, g, or t
  misc_feature (257)..(257): n is a, c, g, or t
  misc_feature (273)..(273): n is a, c, g, or t
  misc_feature (289)..(289): n is a, c, g, or t
  misc_feature (353)..(353): n is a, c, g, or t
  misc_feature (378)..(378): n is a, c, g, or t
  misc_feature (409)..(409): n is a, c, g, or t
gcgccccgaaccgtcctcctgctgctctcggcggccctggccttgaccgagacctgggccggctccactccatgaggtatttcacacctccgtgtccggcctggcgcggggancccnttcatcaccgtgggctacgtggacgacacccagttcgtgaggttcgacancgacgccgcgagtccgagagaggagccngcggngcccgtggatagagcaggaggggncccggagtattgggaccggaacacacagatctncaaggcaaggacagantgaccgagtgggcttncggaacctgcgcgctactacaaccagagcgaggacgggtctcacacttggcagacgatgtatgnttcgacatggggcggacgggggctnctccgcgggtataacagttcgcctacgacgnaaggattacatcgcctgaa

SEQ ID NO: 501679 - DNA, 782 bp, Homo sapiens
  misc_feature (65)..(65): n is a, c, g, or t
  misc_feature (206)..(206): n is a, c, g, or t
  misc_feature (242)..(242): n is a, c, g, or t
ggccggttgttgcgtgggatggatcaggcggaattccagaagagaaaataatccctgtctagatncagaggactggttcctattccagtgctcctccggtagcagggaggcgacagaaggtgtccaactatccattaccaagaagaaatctattcgtttgagcctgagacactctttgaggtaaaaaattagaatgaaagaacctntggatggtgaatgtggcaaagcagtggtaccacagnaggagcttctggacaaaattaaagaagaaccagacaatgctcaagtaagcatttcatcttcatttaaaaatttaaaaaaattccttcttttccatctggtcaactgaaaaattttagttaaacggcttctggtttgtaagtttaaaataacccaaactgagacaggctctcgctgtcgctgagggtgtggtgcagtggtgcgatctccttagctcactgcagcctccaactcccaggctcaagtgatcttcccacctcagacctcctgtgtagctgggaccacagggcacacaccaacatgctcaactattttaaagtatatacaggtagagacggggtttggccatgtttcccaggctggtctcaaactcttgacctcaggtgatccactcacctcagcctcccaaagcgctgggcattacaggcgtgagccagcacgctggccgataattctggatcggtatatctgccctcctctaccatagggtgaaagtccaatgagagtcactatatgactgtgacatatgaagcctgcgtcca

SEQ ID NO: 501680 - DNA, 234 bp, Homo sapiens
aggatccccttgaaatgggcacagaaattaccacaaactgtctctcagaccacagtgcacacaattagaactgaggattaagaaactcactcaaaacctgtcgagtacattgaaagtgatctacctgatcactattcgttactgaccacattatctaagatttggtcatcttcagatagcttttgtaacccttaagatctccgacactatctgtgcccatttctgggcctcctt

SEQ ID NO: 501681 - DNA, 681 bp, Homo sapiens
  misc_feature (65)..(65): n is a, c, g, or t
  misc_feature (206)..(206): n is a, c, g, or t
  misc_feature (242)..(242): n is a, c, g, or t
ggccggttgttgcgtgggatggatcaggcggaattccagaagagaaaataatccctgtctagatncagaggactggttcctattccagtgctcctccggtagcagggaggcgacagaaggtgtccaactatccattaccaagaagaaatctattcgtttgagcctgagacactctttgaggtaaaaaattagaatgaaagaacctntggatggtgaatgtggcaaagcagtggtaccacagnaggagcttctggacaaaattaaagaagaaccagacaatgctcaagagtatggatgtgtccaacagccaaaaactcaagaaagtaaatcgaaaatggtggtgtgtcttcagctaatgagagacctatgcccagcagttgaacccaggctttcagctttctttcgcatcatctggcccaagtgtgtcgcttccttcagttccagctgtgctatcaaggtccccgtcacgctcgtaaccaaaagcccctcaacgggccaaacgcatatcataagaccaggatctacccacgctctcctgcaccacacgatgcatcaaccagacatcctccacactgcagcctgcaactcctccaagaaccctgcacaacgcccgaagcatcaaccccaccaccccttaacccacctcccacaccgccccccggccccccacacccgccccca

SEQ ID NO: 501682 - DNA, 1225 bp, Homo sapiens
  misc_feature (122)..(122): n is a, c, g, or t
  misc_feature (146)..(146): n is a, c, g, or t
  misc_feature (185)..(185): n is a, c, g, or t
  misc_feature (204)..(204): n is a, c, g, or t
  misc_feature (649)..(649): n is a, c, g, or t
  misc_feature (685)..(685): n is a, c, g, or t
ttgaaagaggcaggtgactcactttcagtaagggcgttcctgttgttcgcctgcgatggatggcatcttgagctcacatctagcgttaggccgagaaatggggcccttagggaggcttccantgaaggttgagttataggtcaggnccgggaggttgttgtgcccctctttgagaaataaaagcngacgtgggcctctaagtantgattcttatggggtcagaaactatttcttgagtccgttcttctcagagtttattacttcctcccacgtcttggtctgctggtctaattcccttcaataaccttcaacataggaaaaaaccagagtgtgttgtgtgtctttaaagatattagagaagtgggagctgttgccccaaaactgttttcttatgtagctactgaaggaacagaaagcaggaagaaagaaaaaagttagttgtggccccagaagagttgtttttcaaatgccgagccgtgaagcctcatgcactcaacacaaagtttttctttcatatagataagcctgaagaaaaaagaataagcctgagtatgtattttaggtgtccaactatccattaccaagaagaaatctattcgtttgagcctgagacactctttgaggtaaaaaattagaatgaaagaacctntggatggtgaatgtggcaaagcagtggtaccacagnaggagcttctggacaaaattaaagaagaaccagacaatgctcaagtaagcatttcatcttcatttaaaaatttaaaaaaattccttcttttccatctggtcaactgaaaaattttagttaaacggcttctggtttgtaagtttaaaataacccaaactgagacaggctctcgctgtcgctgagggtgtggtgcagtggtgcgatctccttagctcactgcagcctccaactcccaggctcaagtgatcttcccacctcagacctcctgtgtagctgggaccacagggcacacaccaacatgctcaactattttaaagtatatacaggtagagacggggtttggccatgtttcccaggctggtctcaaactcttgacctcaggtgatccactcacctcagcctcccaaagcgctgggcattacaggcgtgagccagcacgctggccgataattctggatcggtatatctgccctcctctaccatagggtgaaagtccaatgagagtcactatatgactgtgacatatgaagcctgcgtcca

SEQ ID NO: 501683 - DNA, 826 bp, Homo sapiens
caatgtacgtcacctaaagatgcatctgagaaagctagcaaagcaagagctaaatctaaccctaagaattagtatagaagaaataatgtaacgaaggaacgagaactagaaagtaacgtgaattcgcaaatgaacaaagcaatacaagaagtcgagaggcaggaagaaaagacatgtgatctcttttgagagagatcatgcaatgttcaatcaaggtccttaggcatgagttaatagcattcgaaagacagacggaaaagagacaaataagtaaaatcagatggagcaggaaacagtattacaactgggcatgctagaatatcaccaggatcatcatggtagctactgatgacctagactacgtgcgcagataacacttggtagaaatctaggggagatggataagttcctagttgagatatcatagctaccagcagttacactcacatggaacgcaagatatcaagaatgattgcactcagagcaataatgactaaacaaagattgaagctgtaatatgaagtctcccagtaagagaaaagtccacaggagcctgcatggcttcgagctgcttgaagtcgtgccacagcagtttaaagaacataagagcagtgtctacgtcaaaccaatttccgaacaagatacaggaacgagggaagtcttctcccaaaactcattgttacacatgacccggtattacccgtgatactccataaccgaaaggacaggatgcttaaggacagtaaaaccacaggccagtatctctgaatgttgatttcaaaaaattcggtggaagaataagcagtcagcggaattccaaaattag

SEQ ID NO: 501684 - DNA, 201 bp, Homo sapiens
aaacataacgattatagctaaaggctaatcactgctgtataccgtgaagagaatgtggctaggctaagcgtatagagctgcattgctgcatgcttaatgcttgtccctttagatcgtggtgatttagagagtgaactcactggaacggggatgcttgcctgtgtcatcttactaagcgctcctagaacggctaggacccca

SEQ ID NO: 501685 - DNA, 617 bp, Homo sapiens
gtctgcgagacattgaactgtgtacactatatgcccatgatttctctctgcacttcgtcttattctactggtatggcaagtcgagatgcacataacccagcggacgctgatagattaaatgattagtccgacctatatcacacaggctcggggatctctgtctaggcacagtaagttaagcagtacacatgtccagatcctgtacgagaagagatagctgtaagatgttgatgagaaacttagggacttgtacgagaaaggtacgcgactgtacatgagacctatgcagaccacgcattctgctgcgcataacgagatcccgactgacctgactgcttattgtcacactgagatgacagttcacagatctacctgagccgagtccaactgtagcgtgaagtgtactgattatcatgacaatgcagcgtcgatgtcgaaaggacacttatacggaattgtagatgacatacttacttctatgccacggacatcttgtctttgataaccggactcagctgctttacagaatgttgcaagctgctgataaagtgcctgctggtgcaaagctcgagaacttctggatgaggggttaggctgtggccgagctcgtgtgccct

SEQ ID NO: 501686 - DNA, 102 bp, Homo sapiens
gaaggcctgggtcaggaccctgctttcccagcgcagttcccaactgtttccctgctcctttactggtgatgggctaataaaactgactttttggtttatgca

SEQ ID NO: 501687 - DNA, 362 bp, Homo sapiens
  misc_feature (202)..(202): n is a, c, g, or t
  misc_feature (207)..(207): n is a, c, g, or t
  misc_feature (220)..(220): n is a, c, g, or t
  misc_feature (228)..(229): n is a, c, g, or t
  misc_feature (236)..(236): n is a, c, g, or t
  misc_feature (238)..(238): n is a, c, g, or t
  misc_feature (273)..(273): n is a, c, g, or t
tccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaagggccggccnttccntagtaatcccccntcctgganncctgggntngaaaaacagctctgttgaatcacagtatcaggtanttttcacacgtaagcacatttcggggccattttccgtgggtttctcatgaagctggtgttcacagacctcaagcaaggggcatcggcat

SEQ ID NO: 501688 - DNA, 302 bp, Homo sapiens
agccaattctgttctcatgaggcccaatccagttgtgcctcacaatatggaaggagaggagtgagccctgctgtaaaggcactaggtagagggttccagcctcatgacctaattacctctcaaagcccagctcgaaataccatcaccattgcgtgtgaggtacaacatgagctttgggaggcataaacattgagccgtagcagaggattatttgggccatgctataatctagcaaaagctatgaataaaacagcgagagacaggaccaaaataagatttggcattaaaggcccagcaatact

SEQ ID NO: 501689 - DNA, 171 bp, Homo sapiens
gaaaaatttgggatttttcctttgttttaaaaaaaaggctttctgtaatgtcccaggaaaccttttaaaagggggtttgtaaaagcatattgtaaatgccctttgcaccagttggaaaaaaaagtgttgggtgatttgatttaaataaaactaaatgggttgtcctcctta

SEQ ID NO: 501690 - DNA, 399 bp, Homo sapiens
agaaagaaaggaaaagccagactcctttagggctttgaactgtgcctacagaaaatcagagtgcaggggacataatgttcaggcctacagtcaggaagcagttgctccttcccattccacaagatactgcaccttttcatcaagtgtcacccgacgtgccaaaactcggcatttttgggcacatgctattttacctggagcaccaaaataactggtaatggagttctttagatgattgaggtgtaactcctgatctgctaagttattcacaatctctgtgttggggtcatgaaactgatgatgttctttggcttcatcatcttttacaaaatctgagttctgagtctggagagctcttcttggaagacgacctcttcttctccgcaaatgtggtattgc

SEQ ID NO: 501691 - DNA, 458 bp, Homo sapiens
ccgggggtatataggcggaaaattgggaccacgaccgtcttttttcctcacccccgctgcggggcgtctcccccttcgctccagggcgccactgttctccacagtttctcccaccaacagcacgcatccacatatatgtgtgcacaatctctttcacagcggggttggggtctcttggagagccccgccacaccctgagcacttctccccacacggcgtctcttctccccaccccgtgaaactttctgttatcaaccacgccacacgaagggtgggcaccggcaaccctcccccggcacagggttgtggccacccacctttggccacccacgaggggaaaaaaaattttttggaaccccttaggggatgggggaaaaaaaatgggaatttttgtgcttttaattttttttaaacttccattattattttttaaccaaaaaaaattttccccccgttga

SEQ ID NO: 501692 - DNA, 749 bp, Homo sapiens
ggcgcagttcagtcctattatgccgaaggccgacccggaggagccccctgccggtgccacctcaaggaagagctcccctccagagaaaaaccgagagtcatcatttgcctgctcaactatgaataaagttccacgtaccttctctctgctcacttctttcagaggcacttccggctcacgaaactcttcagctaagttcctggggaatttgctgagtgtcaaaacatgaattaaaccagaagagatatgatagtgggttttgtctgagagggatgcccagccttgtgaataagtcatcttccagtgtggaggattgcttgctccctgacctgtatccactggggacccacatataccaggcattctgctcaccagagacacacacaagactcatgggtcaatcaccaaaacctggggccacagctcagacctgatctgtcatgtcagacaaggctgaaatattgttcttctgtgttgtgagttttctcaaatacaatacaaaactttctccttgcagctcaatcaaggcaatctgcatagtaagaagagtgtgggatttggaggcaagagacttgggtgtgagtttcaggcccctgattttgtgtaaatcacaattcttcctacctcttgattttcctaaactgtaaactgagctgcatgccacccgccctatttcttcaaaaggttcttataaagactgaatgaaatactgtatgcaaaaataacacattaaaaccactttatgaatg

SEQ ID NO: 501693 - DNA, 815 bp, Homo sapiens
ggcgcagttcagtcctattatgccgaaggccgacccggaggagccccctgccggtgccacctcaaggaagagctcccctccagagaaaaaccgagagtcatcatttgcctgctcaactatgaataaagttccacgtaccttctctctgctcacttctttcagaggcacttccggctcacgaaactcttcagctaagttcctggggaatttgctgagtgtcaaaacatgaattaaaccagaagagatatgatagtgggttttgtctgagagggatgcccagccttgtgaataagtcatcttccagtgtggaggattgcttgctccctgacctgtatccactggggacccacatataccaggcattctgctcaccagagacacacacaagactcatgggtcaatcaccaaaacctggggccacagctcagacctgatctgtcatgtcagacaaggctgaaatattgttcttctgtgttgtgagttttctcaaatacaatacaaaactttctccttgcagctcaatcaaggcaatctgcatagtaagaagagtgtgggatttggaggcaagagacttgggtgtgagtttcaggcccctgattttgtgtaaatcacaattcttcctacctcttgattttcctaaactgtaaactgagctgcatgccacccgccctatttcttcaaaaggttcttataaagactgaatgaaatactgtatgcaaaaataacacattaaaaccactttatgaatgggtaaaaaagaatactaattggttttgttgttctgaggtgaggaatatttgttggcgctttcgtgt

SEQ ID NO: 501694 - DNA, 758 bp, Homo sapiens
  misc_feature (75)..(75): n is a, c, g, or t
gtaccacccgtccccccctcacccgcaataaactccgcgccgagagggaaagcgcttacagggtgactacctcanggattgctcccctccagagaaaaaccgagagtcatcatttgcctgctcaactatgaataaagttccacgtaccttctctctgctcacttctttcagaggcacttccggctcacgaaactcttcagctaagttcctggggaatttgctgagtgtcaaaacatgaattaaaccagaagagatatgatagtgggttttgtctgagagggatgcccagccttgtgaataagtcatcttccagtgtggaggattgcttgctccctgacctgtatccactggggacccacatataccaggcattctgctcaccagagacacacacaagactcatgggtcaatcaccaaaacctggggccacagctcagacctgatctgtcatgtcagacaaggctgaaatattgttcttctgtgttgtgagttttctcaaatacaatacaaaactttctccttgcagctcaatcaaggcaatctgcatagtaagaagagtgtgggatttggaggcaagagacttgggtgtgagtttcaggcccctgattttgtgtaaatcacaattcttcctacctcttgattttcctaaactgtaaactgagctgcatgccacccgccctatttcttcaaaaggttcttataaagactgaatgaaatactgtatgcaaaaataacacattaaaaccactttatgaatg

SEQ ID NO: 501695 - DNA, 232 bp, Homo sapiens
cgtggcactccccatgattacccgatactagtatacgagatcaggttcgtccttcagtgttgcgtctggtccttatacgtttcgcggttacgcctgattagcacattgtagggtggtgattagtcggttgttgatgagatatttggaggtggggcatcactagagggggaaatagaatgatcagtactgcggcgggtaggcctaggattgtgggggcaatgaatgaagcgaa

SEQ ID NO: 501696 - DNA, 759 bp, Homo sapiens
agaaggggggaagagaaaagaggaaaaaaaaagaaaaaaagtgataaaagtagaaattcctagcgtgtaccctcaggcagagctcccctccagagaaaaaccgagagtcatcatttgcctgctcaactatgaataaagttccacgtaccttctctctgctcacttctttcagaggcacttccggctcacgaaactcttcagctaagttcctggggaatttgctgagtgtcaaaacatgaattaaaccagaagagatatgatagtgggttttgtctgagagggatgcccagccttgtgaataagtcatcttccagtgtggaggattgcttgctccctgacctgtatccactggggacccacatataccaggcattctgctcaccagagacacacacaagactcatgggtcaatcaccaaaacctggggccacagctcagacctgatctgtcatgtcagacaaggctgaaatattgttcttctgtgttgtgagttttctcaaatacaatacaaaactttctccttgcagctcaatcaaggcaatctgcatagtaagaagagtgtgggatttggaggcaagagacttgggtgtgagtttcaggcccctgattttgtgtaaatcacaattcttcctacctcttgattttcctaaactgtaaactgagctgcatgccacccgccctatttcttcaaaaggttcttataaagactgaatgaaatactgtatgcaaaaataacacattaaaaccactttatgaatg

SEQ ID NO: 501697 - DNA, 995 bp, Homo sapiens
  misc_feature (728)..(728): n is a, c, g, or t
ggtttctaaaagtgctagtcaccagactgcagccttgctagtgcttcgcagctctcgaagtaaattgtcgcgggaatggaggcctctctaccctagagtagtaaccaggtacggcaggctggcgcgtaagtaactgatcgggaattgacattttcactcatgggccaatacatgaagtcaccagttcgaacatttctatttcacatgtattaaaagccttgaaagaagctatttgtgacgctaccgatcacatacgtcctttggacgtgaattctcagggataaaaccaagagtaatctgtaggtagttgtccagggctaagaataggagagccacctagataaattatagctcgcatggacacagtggatgcaaactgtgactgacagtctagagtattagtaacgccgtcctattgtgatatcgacatcaaaggattgacgcataggcaatcgagacggaacactgctatgtcgctaacttgtgtagaaggtagagcattgtccgaggaagatggacccggctttgcgtagatgaggaaatacctagaggcttccaggaatagatcgcatttgcgaagggtatcaaaagaatatttgtgtcagtccagtactttatgaggtgagagataggaggacaactatgcgtcactcgactgtttcttccctaataaagggacgaatatttaagtgcaatcgagttgccgtgtgagaggtaggattctcagncgtgtacatgcttgatgttgggtaagccattggttatagtgaacgttaaatagtgttgctcgaagctgtggagattagtgcgagctcctgaaaggttgtgtctagtgtttcacgaagtggtgtgttcctttgttctgctttataaatgtaagccttgttagctggagttgaattaccaaggagatatgcgaattccttagatattgtccagcgttgggtaaacatattggatttgagtggttctgggagatacaggtgcaaggggaa

SEQ ID NO: 501698 - DNA, 278 bp, Homo sapiens
ggggaagggagacctttacgcaagggaaaagcggggggagggtcagagcccagtcgagacctcacacagggctgtccctcagggagacctcaggccagggtcttggctaggcctctggctgaaagccagggcagctcttcgggagtttctctaaagtcactagtgaacaatgcgggggtaaaagtaccacacaaggtatgggatccagggggcagtctggcaacagtgccaggtaagggttatgtctataggattccccgtcaaggcaagccaaaggg

SEQ ID NO: 501699 - DNA, 274 bp, Homo sapiens
gctcggtccactcatgtcatacactcataaaatgaagtagtcttaagtttctttctccttttttttttggaaacaggctctggcacggtcacccaggcggtaaggcagtggcacgatctaggcttatagcaactttcgcctcccaggctcaagggacactcaacctcagcgctggaggagctgggaccacagacatgtaccaccacgtccagctaattttggtgttcttttttttctagagatgggatctcgctatgttgcccaggctagtctt

SEQ ID NO: 501700 - DNA, 670 bp, Homo sapiens
  misc_feature (460)..(460): n is a, c, g, or t
cacgaggggagctccaagtctactctttactgctctaagtattctgctcctataggcccagcctctgaggctccattatctacaggtattgggagatgcacagctaacatgccaagaccacctgtaaacctataaatgggaccactgacatttaaggatgtggccatacaattctctctggaggagtggcaatgcctggacactgcacaacggaatttatatacgaaagtgatatttgaaaactacacaaacctaatcttcctgggtattgctatctctaaacctcacctaataacctgtttggagcaaggaaaataaccctggaataagaagagacaggacatggtaaccaaacccccatacttggaacatccctactatccactcttataattaaaaccacttttaccccttcatgaagtgttttctaaaacatactaacatttccagggcactacancctaaccaataggaggatgatgattaaaatattctgtgccaacttatcatcctttcacaataatcccattaaaaatcataattccaattacagtaacttgattgaaacgattttagaacaagagttctacgtccttaccccatacattcctttctagataatttcacaccctacgttttcctccccctgcactttttagcttttgccccg

SEQ ID NO: 501701 - DNA, 210 bp, Homo sapiens
  misc_feature (85)..(85): n is a, c, g, or t
  misc_feature (95)..(95): n is a, c, g, or t
tcccatgggaaggaggggaagacgcagcccctgtggccccctccgtgcctgcctatggggaccctgagctgcccacaccgggganagaggtccantctgaaagtgcccaggagccaggagccagggatgtggaggcgcagctgcggcggctgcgggaggagaggacgtgcaaggtgtgccaggaccgcgccgtgtccatcgtctttgtgc

SEQ ID NO: 501702 - DNA, 609 bp, Homo sapiens
gagtctcccagcaggtggcacaatggatgcgatctccagtgagagggccccagtcccagccccgatggtaccataccctctgctccctccgaccccactgaccagccccccgctgctcactgcaatatgccagacctcaggttcttggtggtgccagacctgctggccctgtgctgctggcgggtgatgtgccctgtgcggtgctgacttcattctgtggaggctggttctgtgtgcgtgataccctgtgtacttttgtgccgtgggcactgtggtgactccagcgtagggtttcggtgcctctatcggcctccgcccgtctaccttgtggctggctgcctggtgtcctgctgactgaggaaacgaaccggagcccttccgagcaggcagaagggcgagctacttggactgaccgacggagcaagcatcaacttgctgaaaaacctcgtcctaattagttgagggtccattcagaaggagagctaacccattggccatgggagatcaacggcgtttccccaaggaacagttgggaaaaattgggccttgcacatgggcgtccaaatgtaaggaattcggtgggcaccaagggtcctggccacccttcgt

SEQ ID NO: 501703 - DNA, 245 bp, Homo sapiens
ttaaatgtcaaaatctgaatatatctgggatatggtactaatcaaataataatcaatcaatcagcatatacatttcagccaagccatagagaaaagcatagttgcttgattatgtcatctccaccactctgctcagcctgtacaggtaggggaggtatacaggaggcttgcttgtcctgctatcatctctgtacctttgggtactctgcagtttcagtgtcgacctgcagtgactgatttctgtg

SEQ ID NO: 501704 - DNA, 105 bp, Homo sapiens
gcgtagggactctacatcagatacagcacattcgcagtagttctgagtaatacagagcttgcttgttcatgggattagggaaaactcttgtgttgcagtgtgctt

SEQ ID NO: 501705 - DNA, 175 bp, Homo sapiens
tcccgatttgacggaagcactctgacatactccaagatggacaaccttgaggacattatgctaagggaaataaggcagttacctaaggacaaatattgtatgattctacttatatgtggtaattacggtagtcaaattcaaagacagaaagtagaatagtggtttcgctaggggc

SEQ ID NO: 501706 - DNA, 121 bp, Homo sapiens
ggaaaatgggaggggaaagggttatatgaaaattttttaaactttttgctcaactttctgtaaccctaaagctactttaaaaaatgaagggtttcaagtaaataaataaccccccccccca

SEQ ID NO: 501707 - DNA, 259 bp, Homo sapiens
tcctccatgccgatgcaccagcgggtgaaatctccaggcagcatctgtgggtctctgtgttctgcccggcgctggtttgctctctcttgtgtgtctcagacggccagcttcctcacccacccggcactctgctttgctctgtctcctgaggtgggcctgaccaacctccccttctctgcctcagtccctgggctccagggctcagctccacagccctctgcctagcaggctggttctccctgccaagccccagctgcgg

SEQ ID NO: 501708 - DNA, 757 bp, Homo sapiens
tagcggattgtgatcggaagcgcgcgtaagcatgtacagaagcttcactgacgttcagaccacggtagaaaacaaaatcgagcgggcgaccaaacgcccgacgggctgatcatcggtaaaacgcacctggcgcagcgacatttcccgcgcaaagcgatataacgcgttcatccttctacggatccaggcattgaaatctcccgccataatgaccgggccgctgtgtgtgagctatctgatcgccaatcaggaagtaactgcttactatagacatccacgcccagcactgaagttgacggcgtgtatattaaccaccatcaacaggcgggtgtcaggtaaatggatagaccgtgcaccagtgcacgaacttctgacaggacacggcaaaaatgggttctcgttacacgtaacggggcagcaatacacatggattgtgccgccgaacaggggtcaattaacgccaggaacggatgtacggtgaacagcacataaaaaagccgggagactaccccattgacaatccggtgcagggacaacaaggaataatacactataaggcagcggtcgggccgataaaaccgttgggtaaccttaaaacgtccttgaggacagagtctagagccattgtcggcactttcccctttggccaacatacaaacaaacccacaagacactggatttggcactacacctttatatggcgcccggaacagggttccctctgtgacaattagcccggaacacaaagacagagtta

SEQ ID NO: 501709 - DNA, 295 bp, Homo sapiens
gccttttcccccccaggggggtttttccccaagttttacaaaaaaaatggtggcccggccccgggcccgggccccttccttttatttttttaaggtgggggggtttcgggccacaaagtcccccggggggggttttaaaaattttcccgatttcaaaattaattttccgttgccccccggggttttgggcggttggcccaaacccggttttccccccaaagggcccccccctttttttttgggggggggccttttttggggggggccccaaataaatttgggaaggcccgggtta

SEQ ID NO: 501710 - DNA, 904 bp, Homo sapiens
ggtgtacggtccgcagcggcaggtgaagcctagcagaggacgcggccaggcgatgcggtgaagcgattcctgcaggcgtatggttcccctcttatgacctggattgaattcgttgaaatgagcagtcgtaaatcaaagagtaacagcttaattcacacagagggcctttcacaggtacaaaagaattttacgtgaaagatcttgtcgtcaggagtccacatagtaaccctatttggagtgcaagtacaattaccaaacacttaagtgagctgctgaaaggaatgttctccatggagagagtaactctgtccttaattatcggaccccgaggatcaggaaaaactatgtatctctcagaagatacgagggtgtgcctcgaagttcctacagaagccttcaatatcagcaaaaacctgcggtcataacacatgctatggatgctgggttaaaaatcgagtaacaggcatcgacccattatgacttgccgtagatctaatggaagcaagcaactgtgtaggcatggactcgaaagcgaatattggtaccattggtctatcatgctgtggaaactctgtcttataatagcaatggacatttaatgacatctatgaggacgagccatttaattttcaaagtggctattaatgagtttccggaagtttgctcacggaccagcacattccgttatgattcgaaacaccgtgtcttgaaggtttgaccacctgcgcactgagttatacagcccggagaattcgggattcacgcagaagaccactggtacactggttggtgtatccaccttgggtggcgcgcatacccacggctacaatgggggggggcgcccccaaacggagatacagcgaacgcggttcatctggagagaagggatctttactcaattgtg

SEQ ID NO: 501711 - DNA, 123 bp, Homo sapiens
aaattcgcggccgcgtcgactcatcttaagttataactgccacaaataatacccaaggggcttcccagatgatgcagtggtaaagactctgtctgtcaatgcagagatgcaagcaacatggat

SEQ ID NO: 501712 - DNA, 602 bp, Homo sapiens
tgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaataacagatactggagaggatgtggagaaataggaatgcttttacactgttggtgggagggtaaattagttcaaccattgtggaagacagtggtatgtacccaaaggattataaatcattctactataaagatacatacacacgtatgtttattacagcactgttcacaatagcaaagacttggaaccaacccaaatgctcatcaatgatagactgttagcaagactaataaagaagaaaagagagaagaatcaaatcgatggtataaaaagtgataaaggggaatgtaccaccaatcctacagaaatacaaactaccatcggagaatactataaacaccttttcacaaataaacttgaaaatttggaagaaatggttaatttctggacacatacaggctcccagattaatccgtgagaattgtatctttgtttag

SEQ ID NO: 501713 - DNA, 411 bp, Homo sapiens
  misc_feature (253)..(253): n is a, c, g, or t
  misc_feature (269)..(269): n is a, c, g, or t
  misc_feature (275)..(275): n is a, c, g, or t
  misc_feature (278)..(278): n is a, c, g, or t
  misc_feature (294)..(294): n is a, c, g, or t
  misc_feature (307)..(307): n is a, c, g, or t
  misc_feature (334)..(334): n is a, c, g, or t
taagggaatttacaaactaaagattttagtcatctggtggaaaaggagactttaagattgtttagggctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaanaaatttaaattcaagntacttntanaattcagttagaaaantaggctttaaaanttattagagacaagagtaccaaagcgntgtgtgtacgtgtgtgtgcgaatgcatgcttgtgggtatggacaacatttgcgagactgattacttttaaataaata

SEQ ID NO: 501714 - DNA, 748 bp, Homo sapiens
  misc_feature (255)..(255): n is a, c, g, or t
  misc_feature (361)..(361): n is a, c, g, or t
  misc_feature (399)..(399): n is a, c, g, or t
  misc_feature (409)..(410): n is a, c, g, or t
  misc_feature (485)..(485): n is a, c, g, or t
  misc_feature (493)..(494): n is a, c, g, or t
agttaaaacctacagccttatcgagggctacgctaaggactttgaccctgccgtcactgagtgcatccagaggaagaagttccccccagataattcagctccttatggggcccggtatgtgggctccatgggggctgatgttcatcgcactctgaactactgtttgtggggagttgctcgaccccgctaccaagaagagccccagtggaaagcagagactgctgtacgaaggcaaccccatggcctacgtcatgnatacggctgcgcgaatgaccaccactggtaaggtggccgtgtcagacgccattcccacacacattcaccagaggccgccgctgacctcagggacccccgacgacgngctttagttcccgcaggcaaatgaaaacccctctcccnaggaagaaanngccactaaatgaataagaaaaattgccccctacctccacctttacgttcacccccgcaaacccagatctcttatncaccctannactctcgaaagcccaaaatctcgcacagctctttactcaccgagcgccgcccaccgatcgccccccctaaccagatcatgttaacatacacctacttatcctaaactataccgggggccgtagggcgtcaccccactcccaccccctcccacccacatacctaaaaaaccccacgccccaccaccccttcccaccccactccccccccttcctctccgccccaccccccgcactacttcgttcacaaaaaacaa

SEQ ID NO: 501715 - DNA, 1205 bp, Homo sapiens
  misc_feature (424)..(424): n is a, c, g, or t
  misc_feature (440)..(440): n is a, c, g, or t
  misc_feature (446)..(446): n is a, c, g, or t
  misc_feature (449)..(449): n is a, c, g, or t
  misc_feature (465)..(465): n is a, c, g, or t
  misc_feature (478)..(478): n is a, c, g, or t
  misc_feature (505)..(505): n is a, c, g, or t
tcttgctctgttgcccaggctggagtgcagtggcgcgaccggagctcactgcaacctccacttcccgggttcaggggattgtcccacctcagcctcctgaatagctgggatacaggtgcatgctaccatgcctggctactttttgtatttttagcacagacagggtttcaccatgttggccagggtggactcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaanaaatttaaattcaagntacttntanaattcagttagaaaantaggctttaaaanttattagagacaagagtaccaaagcgntgtgtgttttttgtgtgtgtggtttggctgtcgtttgtggtgataggggaaactttggggagagtgattacttcttcatattttatgtgtcgacggtgaagacagcttgtagtgtgtcatgtaagatgactgctgcctctctaaggaaggtcgtgactgtttaaatagacgggcaaggttggaaccttttgaaagatgagcttttgaatataagtgtctgctagatcatggttgtatgaactaacaaggtttgcagatctgctgacttatataaagcttttgattcctactaagctttaagatttaaaaaatgttcaatgttgaaatttctgtggggctctattttgtttggctttctggtgagagagtgaggaagcattctttccttcactaaagtggtcttcttgtcttctggatagaatcgatttaaagagactagggattacaaactaaagatttagtcatctggtggaaagggactttaagattgttaggctggggggtgactcaatttgtatccagtatttgggaggcaaggggacattgagtggttcgaccagtggcacggggaactgttttaaataaaatgtggtgtttataaaaagaggacatgttttaaaaaatgccaacgggtgtggaagtgcgattttcaacacgtatagtgaaaaaatttattttttattaaaattgcgttgtacta

SEQ ID NO: 501716 - DNA, 768 bp, Homo sapiens
tctataattgtgggttgaaaaactttttttaaaaaagggttaaaccctgaaaaaaaaacaaccaaaaggccagcccttgtgggcatataacaactccgaacaacaacaagggaagaagaaaaaaagaaagaaagattatgcgtgcctcctcacatttttctccacaaaaatctggcggggggggggaaaaatcacccgggtgcccgtgaggggccgtgaagcccgtagcacgggggtacaaacccgtggggcgcggagttcgctcgcggtgtcacgcggggctccagacgggggctctatatagaaaacaagtatagagttctccccacacagagagacgagagaggcgccagagagagtgtccagaaattcacctctacgccatacaacacaagaaaatatataccgcgagagagcggcgatataatacacacccgcggaggaaagttgtgaacccgcggggaaacaaaggagaatgtggtgggagacaccacacaacaatattgtctcggaacacacgccggcggaagaacccctggaaaagaaggcggggggggccatgtgcccaaggagacgcctctcacaagagggcctctctggggggtggccccaacaaatctcgtcggggggaaacaatacgtgtggcaacacactgtgggggtggaggcacccggtggaagagagggggggggagagtgcaaaacaaagtttcacctcttggggagaaaagagtctgtccgggcccccccaccagtggggcccccccca

SEQ ID NO: 501717 - DNA, 111 bp, Homo sapiens
tctcagttactgcttggctgaagtctcagattgatggcagtgctcatcttcaacttatgtgctcccctttgcctaaagcctatggcctcctgtgcagatgtacctcatgcg

SEQ ID NO: 501718 - DNA, 334 bp, Homo sapiens
ctcttacaccacgagatgagtttacctatataccaaaccagcacatataaaacaaagtagaagactggggcgggggctcatgcctgtaatcccagcactttgggaggccgaggcaagcggatcacctgaggtcagaagtttgaggccagcctggccaacatggtgaaacccgtctccactgaaaagatacaaaaattagccaggcgtggtggtgggcacctgtaatcccagccactcaagaggctgacgcaggaaaatcgcttgaacctagaaggtggaggctgcagtaggctgagaccatgccactgccctccagcctgggcgacagggcgag

SEQ ID NO: 501719 - DNA, 147 bp, Homo sapiens
gattggcaacaccacaattttccatcattcatcactggccacatgcacaaccccatcaaaccagtcaagcacgcgtttcaacaggcagttccctgcatgcaggcatgcacttttcatatcatgtccagcaacaacatgggagcatcc

SEQ ID NO: 501720 - DNA, 282 bp, Homo sapiens
  misc_feature (204)..(204): n is a, c, g, or t
cactaatgtgcatggcatacccttcttggagatggtgctaccttattagcatgagagaatcaaaagacagtaaagatcattccaaagcattcttccaggtgagtaaccatagaataacaccactcatctgagaattaaaacagagttgacaaggtcttacagggatatttcaaccaggattttaatcactgatacgtgccagcnagattagccttaggaatagtggggagtagatatcctcggtgtgagatccaaaatatcattcattagcttgttccgctg

SEQ ID NO: 501721 - DNA, 180 bp, Homo sapiens
taatctcagcattatgggcggccaagatgcggacatcacttgacacacagagagattccaaaccagccctggcaacaattgtgagacccagtctctagtaaaacaaaaaacagtccactaaatcagaccacattaattggagaatcatatgtcacagccataagggagacaatatatatt

SEQ ID NO: 501722 - DNA, 422 bp, Homo sapiens
tgccaggggcatatgagcccttgcttcaggatcatcggaatttctgacagccctgtgaataatataaatccctaccaataccacttcaccttggccatttcctacagaataagaacctcccttagggaaagatatggtgaaaaaaaaagaattgctactcggtaggaagaaaattcggccaagttatctcaaaccacgccttgtcttctaaatgaaacctgaaggaacctatatttctcatcacctgtttcagcaaaggcataataaatccgcgtgtcagcggctcatgtaatgtaaaagcgccgggagagccaacgcggtggtcttgatatggcaagggccactccaaaaaggtgctctgagactcactcctcctcctcatgtgacagtgctgttcgcgctcgtgccgtattcggcgcgag

SEQ ID NO: 501723 - DNA, 329 bp, Homo sapiens
ccccttttggatttttggtttttaaaaaagggggcggggggaagtaaaaattttaaaataaggcccggggggggggccccccccctttttcccccctttttggggggggtggggggggcccccccccccccccccaaaggttggggtttccggctttacccccccagtttggcccagggggctttttagggggggggaaagggttccccttttttttttgggggggggggccccaaattgcccgcctttttcccccccttaaaaccccccccttaaaaagggggtttgggcgggttggcctttttccccaaattatttttgctttccca

SEQ ID NO: 501724 - DNA, 179 bp, Homo sapiens
tctttttttcttttccattccttccttccttccttccttccatccttcctttcttttcttattcttttttttgagacagggtttctctgtcttggaactcactctgtagaccagggtgacctcaaactcagaaatctgcctgcctctgcctcccaagtgctgggattaaaagtgtgtgc

SEQ ID NO: 501725 - DNA, 261 bp, Homo sapiens
tatgcatgggatactgcccagcatcctggtcatgcatacaggaggcagtagctgaagcaggtgcctggactgccccagtgaggcagtgcatgtcttgcttgtctctatggtcaattggcactcttgtgtggcctccctactgctcagacctccgagtgcagtgatgcgtggagttaatgcagcagtggtggtccttgattctggtatgagctttggccagtggtcacgcttacctgtctggtcccagacttacacatgaat

SEQ ID NO: 501726 - DNA, 804 bp, Homo sapiens
atccatccggaagcagacactcatcttgcttaccaatctcttgcaggaggaattgtgaaatggaaggctcctgttcttccgatttgtcagcactctgatcgattcacacccagacattgccagcttcggggagttttgcctggctcacctgttactgaagaggaaccctgtcatgttcttccaacacttcattgaatgtatttctcactttaataactatgagaagcatgacgaagtacaacaagttcccccagtcagagagagagaagcggctgttttcattgaacgggaaagtcaaacacaagagagacgacatgacccatctacaaatctcttctagaagccactccaccggattgaaccagcggaattccaccattcaacttccaaaatctggccttcagtactctgggccgtgcttggctgactggcatcctaccccgtggacctggacgccagtgagttactctcagacacgtcttgaggtcctcagctcaaaggagatcacgctttcggcaatgagatctaaaccagacaaagacctccttatggcacacgaacgatgacatggccttggcaaactgtagtcatgcacggaagctcacgaagaagctccatctcacaagtccagaagaggaatctccatagacacatatttacttccaaattattcatctcccctgcaataactgtgctgggagaacaattacgatccccaggcttagcgggaactcattgcctattctcagggaggtgactgccggattaccgcagatgcgctccaggactcatttgcagtggccg

SEQ ID NO: 501727 - DNA, 667 bp, Homo sapiens
  misc_feature (27)..(27): n is a, c, g, or t
  misc_feature (99)..(99): n is a, c, g, or t
  misc_feature (105)..(105): n is a, c, g, or t
  misc_feature (129)..(129): n is a, c, g, or t
  misc_feature (159)..(159): n is a, c, g, or t
  misc_feature (165)..(165): n is a, c, g, or t
  misc_feature (168)..(168): n is a, c, g, or t
  misc_feature (174)..(174): n is a, c, g, or t
  misc_feature (220)..(220): n is a, c, g, or t
  misc_feature (226)..(227): n is a, c, g, or t
  misc_feature (231)..(231): n is a, c, g, or t
  misc_feature (235)..(235): n is a, c, g, or t
  misc_feature (237)..(237): n is a, c, g, or t
  misc_feature (243)..(243): n is a, c, g, or t
  misc_feature (257)..(257): n is a, c, g, or t
  misc_feature (261)..(261): n is a, c, g, or t
  misc_feature (269)..(269): n is a, c, g, or t
  misc_feature (304)..(304): n is a, c, g, or t
  misc_feature (310)..(310): n is a, c, g, or t
  misc_feature (335)..(335): n is a, c, g, or t
  misc_feature (382)..(382): n is a, c, g, or t
  misc_feature (420)..(420): n is a, c, g, or t
  misc_feature (425)..(425): n is a, c, g, or t
  misc_feature (484)..(484): n is a, c, g, or t
  misc_feature (489)..(490): n is a, c, g, or t
  misc_feature (492)..(492): n is a, c, g, or t
  misc_feature (507)..(507): n is a, c, g, or t
  misc_feature (526)..(526): n is a, c, g, or t
  misc_feature (538)..(538): n is a, c, g, or t
  misc_feature (581)..(581): n is a, c, g, or t
  misc_feature (632)..(632): n is a, c, g, or t
acttttcctccctgtcccacccgcccnaagtgttacggtgaccacaaagcaaggtgtgcacaataattacagggggggcattttgtgtaaaccaccggnaataangataaataaaatccgctcgctctngctgctgtttcaaaattgcaatgttgagtntgtgcncgnccttcncccccccaaccctgtgtgtgagggactaagagatgacatctggtgnacggcnnggangtcncnacaccncggatgcagaaggncgangaggcagngggatgttggcttgttaaacagcagcagataaaanaaggangcatgcaggactccttcagttcttnactagtcttagaaaaactttccagaatactgcttcacactataaaanagaaaaaatatcttgcattagaatccttcaacatctgnatacngcttcacactgttctgcagcaaatactgtgcattctgtatctggtcctgtgttcctgtnatggnnangatccgatcttcggntccttctaaaggctcatcnattttgatcgangctcccgactcatgacggatttgtttaatccgctgaccacctntgccaataatagatccagccaaatctttgggaatagttacttgtgtagtantaataggtccaccaagatcaccatatgagccacga

SEQ ID NO: 501728 - DNA, 188 bp, Homo sapiens
gggtatcactaagatagtaaatattattatttttttatatttgcgaaggagatcatatcttttccttcctatagtatgaacagtattgctgtgtttccttttcttttcttcctcatttcctctgcccctttacagatttctgaaggagaaacttgtcaactcatatccacgttatctagcatagcaat

SEQ ID NO: 501729 - DNA, 957 bp, Homo sapiens
tgcggtggtcgtgctgtaatcccagctctttgggaggccaaggcaggtagatcacaaggtcaggaaattgagaccatcctggctaatacagtgaaaccccatgtctgctaaaattacaaaaaattagctgggcgtggtggtgcacgcctgtagtctcagctactcaggaggctgaggcaggagaatcgcttgaacccgggaggcagaggtagtagtgagctgacgtcccgccactgcactccagcctgggcaacagagcgagactcagtctcaaaaaagaaaaaagaacatttattgctgcatcaccacaggacagacagtttttataccgaccatactcatcaaagatttacgttggtatcattagtaactagtgcattactagagccaggtgcaggtggaggtctttaacagtttcaatgcaaagttcttctggatctaccgaaacaaacatttgctgactagccaatctaaaaaacatggacattctagggtactcaggtaccatcacgggatgcacatgggaatacattagcacacaaactcattctttgcacctcaaaattcagaagggactctaccatatcttagctcaagagcacagaggagtgccttatccccacacttgactgggctgtgacggtgggcatgtgggcccctgggcccagggctggggcccagcagccatgtggggagacaggagagggaggtggtaaccagttacacacacaacgccagacgcgcagcaccggcgaggaggcacaggaagcaagccaagatctgcaaatgcacaagcaatatccggcggtcgcacacggcggaataaatgggacgccaggactgacaaaacgatggaacgacgcacacgacatcggagagaccataccccacacaaaggacgagataggacgaccacacacacgctccacgggacaccgaggctggaggaacatccac

SEQ ID NO: 501730 - DNA, 363 bp, Homo sapiens
cttcctgagaacagggccaaatgtgtcagtatatcggattccctgggattcctcaaatcgtagaataccaggaaaccagcttaagggcaggcagagaaacttcagtggaaggaaaagttcactgaaaattctgaaaccaaatgttttttttttcagaagaaatggaagtcagttttacttttttttccttattttaattccaagccagatctttttctgatcatcttctatatacaaaacataaggtcctatcttcatctcccattctgcaacccagcaatgtggagaaatatttttttcttctctaaacaaacttctttgttagttgaacttactttaatccctaaattccttttcattttt

SEQ ID NO: 501731 - DNA, 443 bp, Homo sapiens
gttgccctccgctgaaagatctcaccttatctggtgagttgtgatcggggatgcctttgtcccagatgcgtgtaggtctggggtgctcaggctctccctaatgggagagatatacaagggtggtagggtgctggcaccactccgtgcagtggctagaaggctcacgcctgtcatcccaacattttgggaggccaaggcgggcagatcactggagatcaggaatttaagaccagcctggacaacatggcgaaaccctgtctctactaaaaatacaaaaattagccaggagtggtggtacacacctgtatgtcctagctatctgccgagttagaagtgcaaaaatcgcttgagcctagaggttcaaggttacagtgagctatgattatgccactgcaccccagcctcggtgacagagtaagacctggtgtctttaaaaaaaaaaa

SEQ ID NO: 501732 - DNA, 313 bp, Homo sapiens
tgcacaacctagggtcagttttgcaggtggtaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgtagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 501733 - DNA, 860 bp, Homo sapiens
tcaggcccaatcatctaccgtaccggtcataaacctgttctcaatcgcgtctcccacaaagctccggccctttaaaattacggccccccggttagcccccccttttggaattgtccaccctgtcttcgaattaaacttaagccccccttgttcacgcaaactagtctttgtaccgcgcccccaataacgaaggtcaaatactctgcgggaaccccttcctttttaacccgctgctcccacaaatttttgacctttctggaatgcaaaatatttattgggccccaccaacttcgacaaattataaacaatcggagacaccctaaattctcatcctcccccgttacccacagcccctccatcttgccacgtctaaacccaggcgcccttgcttgtaatattccaaaagaacgttcttcgcgccaccggataattatggagcccctcatcaagaagctttttcgcccaccagcgattttgctaacaccctgagtgcgccacaaatgttatccacaggacaacgagaatacttcttagagacgcacctatggttggtgcgacagatatcaatctttacttcacgtcgtagatttcctctcttctagccgtatctatgcacagcaccgcctcatatggatgcattcaagcggcaaccctctcgatgcgagacatgttgatggggatatacccggaacaggtcgctagagaacaagctggacacgtccctcctcattatggggaatcaaaggatggaggaggtactacttcagcacccgcttaacgatcctgatggattccctagcgccctcgggggacgccgcggggccgcccccccccgggggccaaagaccccgcccacatac

SEQ ID NO: 501734 - DNA, 297 bp, Homo sapiens
gtttcaaaaaaaaagaaaaagaaaaaggaaaaaaaaccaagcccttgggtgaaagcgactcccaattgggttggggaaagtggagaaaacggacatgttttaagcatttgaagggcaggtagaatcaggtaagttttttggcacaaataatttttaaatgtagggcggctgcgagggttaattttgtttgtcaacttgggggcatcatggggggctcaaaaacagggttaagcattattttggggggggtttgtaagggggtttttggatgagattagcaattgaccctttaaccca

SEQ ID NO: 501735 - DNA, 1424 bp, Homo sapiens
gcacaggtgtcgtgaagaactacccctagaagccaaaatgggaaagcgaaaagactcactatcaacattgtcgtcattggacacgtacgatttcgggcaagtccaccactactgtgccactctgatctataaatgcgggtggcatcgacataaagaaccattgaacaatatgtgatgaacggacggtctgctgacgcatggtgaaagaggctcgcttcaaggtatgcctgaggtcttgcgataaaagctgaacagtctgagacagtgaagccgtagggtgattcgaaccaatgtcgattcattctgcctgtgttgcgcaacattctggaggaccagggcgaaagttacgtatgctggaacttagtcatcttgagttagcccctatggcattaccgatggaggaccttttaattcgacatagagaccgatcgaattaacaaggtgaacaattcatctaaggaccttgcatctgtggtgactgtggtcaccgtgaactatggtagtgacgatgcagtggcctggtccgcggtggacacctgtctgggaaaaggctgtgtgttaattcaatccctacacttgacaatggtgagacctagtgtacctcccaggaaggaaatgaccagtaggccccccaatatcagttgagacgattataaacaaacagaaccgtggggcgagatgtatcgtacagaacaaaatgccgttagacagtttgggtgcgggcgagttgactgtaaaaacccatagaaaaacctcggtgtaaattatcgcggagcagtggtaaggaaacgccgatacgccccatgttaaccgagaggacgaccaacagggaaacacggaacaggcaagttcacatttggcgaaacgggcgcaaaaacacatttcaccgcttaccccaaaaccagtgggggaacaactgagattaccatacaggaatacacacgttctgtaacgcaaaggttttgcgcgataggtaaaaacggaacaaagttacttggcgggcacatttatgcagcaggaaagtcgcgccacccggaggaaatccacgcgaaacgggtctaaaatgggcacaaacttctgagtgtggattaggcgcgcccgagacattgtatctattactacttgatcgaggaggatatctatagaggggggcaaaacaattctatcggcggtttgtgaaaaacgctaagatacaacccaaattatagaggcctttacgtgcggtcaattggacgcccaaaacagggtgttgggcccttgaagcagaacacgaacttgcagggcccccgttatcaggcaagtagatagaccaagagacagagagcagaaactgcggggcaggaacgaacacagtgatttgacataacaacgcgcaccctagggtgcaagaacgccggtgcgggactttctggcgcacgacaaac

SEQ ID NO: 501736 - DNA, 488 bp, Homo sapiens
gaggcggtagaggctacctcccaatgagcggtctcggcaggctcttcgggaaggggaagaaggaaaaagggccaacccctgaagaagcaatacagaaactgaaggacacagataacatactgatcaagaaacaggaatttttggtgcaaatgattcaacccgagctacaaacaggcaagaagtttgggaccaagaataagaaagctgccttacaggctttgcggaggaaaaaaagattctaacaacatctggcacaaactgacgggacattatccaccttggagttttagcgcgaggccattgtgccactaccaatgcagaagtccttcgtaccatggaccttgctgcccaaagcatgaagaaagtttaccaggacattgacattgacaaggtagatgaactgatgactgacattaccggaccaacaggaggtgggcccaaccaagatcctgtttggggggcctacaagagcctggcaccaggatgtt

SEQ ID NO: 501737 - DNA, 265 bp, Homo sapiens
gccacattcttccagagccttgcagctcttcgaaggccgggacccgtttcccggccccacagtggggtgtgtcaaacccgagagaactgtggttgcaaatttcgtgaagcatcagcatcatgttttggcagctgagtatttgagccaggagcctgccatgaggttttgagaacagagtcctgttttagagctggcagcagcatcttagcccaagagaaggttatatttccagagatgtcagtccaaggaccatagctgccatcag

SEQ ID NO: 501738 - DNA, 197 bp, Homo sapiens
actgaccacatgctcatcaccatccaggaacccagtgcccctcctgtgacactactctacggaggtatggcactcgtgtagttccatgaactgccttgaatcaccttttgcaccgtgcctgttcccgatctctttccctcagatggtgctctcttttagaaacgttatctaggaaaactgacgtgttaatggttgtt

SEQ ID NO: 501739 - DNA, 120 bp, Homo sapiens
ggccaggaccccccttcaggcttcacatagtcagggcaaaccttatgtccaaacccactttaaccaaagaataaaaggtataggtgcgttatgaacacttgaagagcccttgacggagat

SEQ ID NO: 501740 - DNA, 107 bp, Homo sapiens
gtgctctagagatccttcgcgtatctaatattataatcccgacgattcgctacgcgataaatacagcaatcctaaccagcacaggtttagtgaccaacgagccgttc

SEQ ID NO: 501741 - DNA, 574 bp, Homo sapiens
  misc_feature (4)..(4): n is a, c, g, or t
  misc_feature (6)..(6): n is a, c, g, or t
  misc_feature (9)..(9): n is a, c, g, or t
  misc_feature (14)..(14): n is a, c, g, or t
  misc_feature (28)..(28): n is a, c, g, or t
  misc_feature (61)..(61): n is a, c, g, or t
  misc_feature (70)..(70): n is a, c, g, or t
  misc_feature (72)..(72): n is a, c, g, or t
  misc_feature (74)..(74): n is a, c, g, or t
  misc_feature (83)..(83): n is a, c, g, or t
  misc_feature (105)..(105): n is a, c, g, or t
  misc_feature (111)..(111): n is a, c, g, or t
  misc_feature (115)..(115): n is a, c, g, or t
  misc_feature (135)..(136): n is a, c, g, or t
  misc_feature (180)..(180): n is a, c, g, or t
  misc_feature (203)..(203): n is a, c, g, or t
  misc_feature (232)..(232): n is a, c, g, or t
  misc_feature (236)..(236): n is a, c, g, or t
  misc_feature (242)..(242): n is a, c, g, or t
  misc_feature (259)..(259): n is a, c, g, or t
  misc_feature (335)..(335): n is a, c, g, or t
  misc_feature (347)..(347): n is a, c, g, or t
  misc_feature (361)..(361): n is a, c, g, or t
  misc_feature (392)..(392): n is a, c, g, or t
  misc_feature (397)..(397): n is a, c, g, or t
  misc_feature (420)..(420): n is a, c, g, or t
  misc_feature (446)..(446): n is a, c, g, or t
  misc_feature (495)..(495): n is a, c, g, or t
  misc_feature (573)..(573): n is a, c, g, or t
tcancncanaaaanagttttattgaatnagttgcatgcaggagcaattctgttcttcccangagcagcanantngagtgtaanagtgcaggatccagagcggggngaggcngggnggagttgggggcctggaggnnggggcctggttacttggggacgtgcagagctctctctggggggntgcagcccatcttggggggagcnggactcaaaagcccccgtaggtgcaaaancaanaaccanatctcactcctcccggngctttttgcggtattcctgcagcgctttctccgccacggtctccaaaaatttagggttcttcctggagacttctanagggaccgtcanagtaatgggatcanagtaaaaaagcttcacgaccacctcagtaanaccgnaaggaacgtccgagtaaaaagtntgggaagccaccgtggtgacccgcanaaagtactggtcttcgccttgcgtgaggtttgccagccgggacacccantaaaactgctcgttcagctgccccagcaaggaggaggtgttgagcatcttccactggtaggactttagcagcccgttnt

SEQ ID NO: 501742 - DNA, 843 bp, Homo sapiens
cagtgatgaacatggcatcgaccccaccggcacctaccacggggacagcgacctgcagctggaccagcatctctgttgtactacaatgaagccactaggtggcaacactatgtagcctcgtgccatcctggtggagtctagaacctgggaccatggactactgttcgcatcaggtcctttggccagatctttaggacgcatgacaactttgtatttggtcagtctggggcatggtaacaatcgtgggccaaaggccacttacatcagagggcgccgagctggttgattctgtcctggatgtggtacggaaggaggcagagagctgtgactgcctgctgggcttccagtctgactgcactcactgggtcgggggcacaggctctggaatgggcattctgccttagtcagcacagatccggagaagagataccctgagtcgcactcctgaattaccttcagatgtggtgccgtcagtccaaagtgtctagacaccgtggtcgaagccctacaatagccacaccttctccggtcgcatcagataggtagagaatactgatgagagctattgcatggacaaacgagggcctctatgatgtcgtgctatccgcactctgaggctgactagaccgaacgtacggggatctgaatctactgggcttaggaccatgagtgggtgttacagcaactggcctcggtttcccatggcagctcaatgttgacatccgcaaggtggcagtccacaatggtccccttcccaaggttccattgctttatgcctgggttggcccgtttaacaaccgttgaagccagcaatattgagcttttaacattgcgggaattacc

SEQ ID NO: 501743 - DNA, 628 bp, Homo sapiens
  misc_feature (154)..(154): n is a, c, g, or t
  misc_feature (160)..(160): n is a, c, g, or t
  misc_feature (178)..(178): n is a, c, g, or t
  misc_feature (192)..(192): n is a, c, g, or t
  misc_feature (210)..(210): n is a, c, g, or t
  misc_feature (229)..(229): n is a, c, g, or t
  misc_feature (244)..(244): n is a, c, g, or t
  misc_feature (279)..(279): n is a, c, g, or t
  misc_feature (366)..(366): n is a, c, g, or t
  misc_feature (369)..(370): n is a, c, g, or t
  misc_feature (380)..(380): n is a, c, g, or t
gagcctgaggaagagggcggcgacggtggtggtgactgagcggagccggtgacaggatggctgggcacagaaaggaatccccctctaaaatgaagatggtctatatccagtgtggtgtggtattaggagatctgcacatcccacaccggtgcancagttntgccagctaaattcaaanaactcctggtgccnggaaaaattcagcacatnctctgcacaggaaaccttngcaccaaagagagtnatgactatctcaagactctggctggtgatgtcatntgtgagaggagacttcgatgagaatctgaattatccagaacagaaagttgtgactgtggcacagttcaaaattggtctgatccatgnacnntcaagttatnccatggggagatatggcagcttagccctgttgcagagcgcaatttgatgtggacattcttatctcgggacacacacacaattttgtagcatttgagcatgaaaatacattctacattaatccaggttctgccactggggcatataatgccttgggaacccaaacattattccatcattgtgtcgatggatatccaggcttctaccaggtggtcacctatgtgtctcagctaatggagatgatgtgaca

SEQ ID NO: 501744 - DNA, 842 bp, Homo sapiens
  misc_feature (264)..(264): n is a, c, g, or t
gaatcatactgtcaaagacagtggtgttccacctgaattcactcaggtgtctctttgagggtcagagacattgctgataatcatactccaaaaggaactgggaaagtggagcgaaagtaagatgtgattgatagtttaatcgaggcaagacaacgggggggtcacttcataccagttttagcagtattcttctagtattttgttttcttttcccttcaaatcgcttgttttgatcttgtgtaagacaaaatagcttctgtgtgntaaatgtgggtgttccaaagacggtaatgggaaaaagctggtgaacctccgagtcttctttggaaaagcattcttgggtcaaattctgaactgcctatgtgcatcatttaattcacttaatagggtctcggtatgttcaaatcgggtgctcgaattatatggggggaatcaatgccctcagtcccctttcagtacttaccctctgccattttttaagaaaacttactgtgttgcagcaagaagaaggtcacctttttttcatggacattttgccattctttcaaggcttgtgttggttggataaacactaaagatcgagcaagggcaagtgttcattaaaatgagtttgtccagattggggccgtgatttgttactacggccatggtgatgtacgttacaacttcccgggaatggtgacaatttcaaagtggggggagactgggacaggtttgtaggaagaaaagtggacattgtgggaaagtatggactttccttgagtttgaggctactttttaaagaattgggagggtctgaccaatagaaaggaaatacgggtgaaagtaagatgacagatagt

SEQ ID NO: 501745 - DNA, 586 bp, Homo sapiens
  misc_feature (112)..(112): n is a, c, g, or t
  misc_feature (118)..(118): n is a, c, g, or t
  misc_feature (136)..(136): n is a, c, g, or t
  misc_feature (150)..(150): n is a, c, g, or t
  misc_feature (168)..(168): n is a, c, g, or t
  misc_feature (187)..(187): n is a, c, g, or t
  misc_feature (202)..(202): n is a, c, g, or t
  misc_feature (237)..(237): n is a, c, g, or t
  misc_feature (324)..(324): n is a, c, g, or t
  misc_feature (327)..(328): n is a, c, g, or t
  misc_feature (338)..(338): n is a, c, g, or t
gagcctgaggaagagggcggcgacggtggtggtgactgagcggagccggtgacaggatggctgggcacagaggtgtggtattaggagatctgcacatcccacaccggtgcancagttntgccagctaaattcaaanaactcctggtgccnggaaaaattcagcacatnctctgcacaggaaaccttngcaccaaagagagtnatgactatctcaagactctggctggtgatgtcatntgtgagaggagacttcgatgagaatctgaattatccagaacagaaagttgtgactgtggcacagttcaaaattggtctgatccatgnacnntcaagttatnccatggggagatatggcagcttagccctgttgcagagcgcaatttgatgtggacattcttatctcgggacacacacacaattttgtagcatttgagcatgaaaatacattctacattaatccaggttctgccactggggcatataatgccttgggaacccaaacattattccatcattgtgtcgatggatatccaggcttctaccaggtggtcacctatgtgtctcagctaatggagatgatgtgaca

SEQ ID NO: 501746 - DNA, 446 bp, Homo sapiens
ggctcgcggtcactggtccctggctcggttccccgcaccccggggctcacacttacccgcgcggaggagcagcggccgggtgtccacccccatcctgcggccagtctcctcgattcccctcgctctgagccgggagagccgaacagctgaagagagtcactgactcccagcccaggtgggcctgtgcacatcatgacagttttgagatgctgacacagagagacagtaactcgtctccagatgacggtttaccatcctggccagttgcagtgtggaatatttcagtcaataggtttaacagagagaactcccttccagcgagtggtgaaatttggcgaattcacatctgtcatatactttcaggcaacaggttccgagtcagtttctctgcagctgttaaaaatcacagctcagtctctctttgaataaaatatgggtaaaggcca

SEQ ID NO: 501747 - DNA, 939 bp, Homo sapiens
ctcctcctactacacgtcacgggctgtccgatggtatgtgaggtgtgcgtcgctgaggattggctcttcgcagttggaatgatcgaggacagatagtgatgagagatggggagggacgagactagggcttccctctgactctgcttggacatggagtgggacagaagatgatacgtggacctggaagatagagatggattctaatacgttccctacaacatctctccatggaaagggcgttgcaaaccgtgttcatttaagcttcgatgaaaagcatgatgttataagcttgcaagtaacagacaagatgttccaggccgatgaggaaaaatcgcttccgtctctgcctctaccttgctggcctctctggcttagcagcattggatgttgaattggtttggtcatttctcgaagtcggactgtcaggaggagccagaggggctttctgggatgtgaaggggacagtgtcagcctaagcctctggagatgcttaggatgctgaatttaaccccttctgaggcaacgtgcatgcgccccttgcaaaaaccaagggggaattgggtcacgggcctcccgcggaggtttacaagagtgggtgagtcttggagagaaccaacgactaaggtagcttagctctctgctttgttcttgggagccaagagaatgcaagatcctggtgggtgagcagtggtatgaagaggggacactggtgggtgaacagtggcatggaagtcactgatgcagcctctggccctcagtctccctatcggcaaagtggggggctcttcctatctctaaagagtttcatccctgacaggtggatgggtgaaagatccagagagtgggggtgaggggtgggccctgaagactttttgtctgtagaatctgcatattgagtgtataacccagcattaagccgggccaagatgatactggcaa

SEQ ID NO: 501748 - DNA, 433 bp, Homo sapiens
tccggaaaaggatgctgccaagaaaccgaagcaggccagtggcaggatcattcaacaaagtatccgataattttgaaatgctcgtttttaatgcctccagcaaacagcagttggatgtttcttttgaacacctccaaatgttcattagaagctcccgtttgggttttcaagaacttgttcatgtatgctgtgccgtcaagctctacactagattttattggacacctttcttgtttgcgttttcggaggcgtaatgtttttaaagggataagcacggctgctaaatgggattactagaagaccatgtcctttgaaagttaacttttcagtgactttcatactgacatttttgcatatttaaccatcaatgatctttaagttatgtacagtaatgtaagttttgcaaataaagtttaagagtaaaaaaaaaaaa

SEQ ID NO: 501749 - DNA, 285 bp, Homo sapiens
accatgttaccaataattcttgtaggtaagaacgggcagatttattagagaaagttgtgaagatatgttgcagtgggcagctcagcagagaaggggctacctgcaaagaggcaaggtgctggaggaaagtcttatagggtcctgcgtaagggtgctatgtgctgaaatgaggtcattgtgcccgcaggttgtttgtgattagctgtttctaacaattgttcatacaataattgttcattattgttctcaacttggggctctccccaacctggggacccttcctta

SEQ ID NO: 501750 - DNA, 130 bp, Homo sapiens
gtttcgtgatatgcttgatttcttgaggtatcacttattaatgatggctgtctatgtgatcatttaattgcatactctatgaccacgcacatgtaaatgccccttctgcaaggaacccagtggtacctga

SEQ ID NO: 501751 - DNA, 223 bp, Homo sapiens
tgcctccttccaacatctaatccccccttccaacttctcatacccccttccaacatctcatccccattgatgatcgttcttctctccgtattggggagtgagagggagagaacgcgatgagatgttgcaaggaggcatgagatgttggaaggcgtcatgagatgttggaaggaggcatgagatgttggaccttccaacatctcatctcggcatgagatgttgg

SEQ ID NO: 501752 - DNA, 111 bp, Homo sapiens
gctcatggcggccacaatggtatcactcgcctctttcaggttgtttttgatgtcctgcgactgtgaagctctcaccaaccccgtattttgtgtctgcaggtattgtccacc

SEQ ID NO: 501753 - DNA, 780 bp, Homo sapiens
agcggcgaggtgggcagatcaggaggtcaggagttcgagaccagcctggccaacatggtgaaaccccatctctactaaaaatacaaaaattagccatgcgtggtggtgggcatctgtaatcctagctgctcgggaggctaaggcaggagaattgcttgagcccagaggcggaggttgcagtgagccgagatcgtgccactgcactccagcctgagtgacagagagagactccgtgtgaaaaaaaaaaaaaaaataccaggtcgggtttgggaaattctttctccgtattaaacaccaaaatttaacatatagttaacttggtgttaaccaacaacagtatggccgggcgcggaagctcatgcctgtaatcccagcacttggggaggccgaggcaggcggatcacgaggtcaggagatcgagaccatccgggctaacacggtgaaaccccgtctctactaaaaatacaaaaaattagctggggtgtggtggcgggcgcctgtagtcccaactactggggaggctgaggcagtgaaaatgggtttgaacccgggaggcggagcttgcagtgagccaagatcgcaccactgcactccagccgggtcgacagcggagactccatctcaaaagaaaaaaaaacattcccagggtcgggtttcggcaatcctgccctgtataaaaacacaagaacttaagattagcttaccttgtggtaacccacacagtggttttaacacacagattgttacattgtacgatattctgagacgaccaggaaccaa

SEQ ID NO: 501754 - DNA, 306 bp, Homo sapiens
accaattcctcctcctctgatggtgaattgggctgttaaggaagtttttgattgtcatagatggtagggctttgaaaatcgacggtttcagctgccactcctggcttcaacacattgagtcactgcctagacggttctcttggtcttattcccatcctggccaatgcttaaatactatttgtcgaaaataattctttgagacagatttcagctacctcccttccaggttcgatttaacttggttgtaattgtcaatttgttgttataggccttacctgtgtgaaagaaagaaaaagaaagaaagaa

SEQ ID NO: 501755 - DNA, 359 bp, Homo sapiens
  misc_feature (39)..(39): n is a, c, g, or t
  misc_feature (282)..(282): n is a, c, g, or t
  misc_feature (294)..(294): n is a, c, g, or t
attttcgcatgttttcaacttaaaacagaaaactatgtngtgtgtggctgggcgcggtggctcacgcctacaatcccagcactttgggaggctgaggcagcggatcacaaggtcaggagatcgagaccatcctggctaacacggtgaaactcagtctctactaaaaatagaaaaaaataaaccaggcgtggtggcacggcctgtaatcctagccacttgggaggctgaggcaggagaatcgcctgaacccaggaggcggaggttgcagtgagccaagatcgnaccactgcactncagcctgggtgatggagcgagactttatctcaaaaaaaaattgtgcatgtaaaaacatgaaattt

SEQ ID NO: 501756 - DNA, 130 bp, Homo sapiens
tggggtttccccagggccccccagggggccccctttttttgggtttccaaagggggaaccccccccgggtttgaaatttggccggtttttttccaaaaaaaaggttggggtttttgtgggggggtttcca

SEQ ID NO: 501757 - DNA, 534 bp, Homo sapiens
ggccgggcgcggtggctcacgcctgtaatcccagctctcagggaggctaagaggcgggaggatagcttgagcccaggagttcgagacctgcctgggcaatatagcgagaccccgttctccagaaaaaggaaaaaaaaaaaaaaaacaaagaaacaaaaaaaaaaaaaaaaaaaaaaaaaaaacgtgtggcgggggcgcgcccgcgggcccccggaaaagcttttaaaacccacgcgcgggggggcgcggggcccccaaggggtgaatagaggaaacagaggggcacaaagacggtgttccctagagagagaaacacgcggggcacggagaaaaggggcgggggatctccccacacaaataaaaaacccccgggggggagacacccgcgagagcggtctttgagaaaacaacctccacagagagggaggtctccgaggagggagccaacaccggggagccttcacacaccacaggggagcggcacaaaggggagcctccaagatttctaaatttaaccccccgccgcgggggggc

SEQ ID NO: 501758 - DNA, 510 bp, Homo sapiens
  misc_feature (6)..(6): n is a, c, g, or t
  misc_feature (31)..(31): n is a, c, g, or t
  misc_feature (39)..(39): n is a, c, g, or t
  misc_feature (50)..(50): n is a, c, g, or t
  misc_feature (83)..(83): n is a, c, g, or t
  misc_feature (87)..(87): n is a, c, g, or t
  misc_feature (100)..(100): n is a, c, g, or t
  misc_feature (165)..(165): n is a, c, g, or t
  misc_feature (244)..(244): n is a, c, g, or t
  misc_feature (281)..(281): n is a, c, g, or t
  misc_feature (289)..(289): n is a, c, g, or t
  misc_feature (292)..(292): n is a, c, g, or t
  misc_feature (332)..(332): n is a, c, g, or t
  misc_feature (406)..(406): n is a, c, g, or t
  misc_feature (458)..(458): n is a, c, g, or t
aggggnccccaccaacattggcctcgatttnaaaacatntatcgtagccnaaaattaatgtcaaaaggaactgttctaacagntacnagagcaaaatagnaaatatttgggaattaaactgtcatgaacaaagcaaagaaaaggttagtttcaaagtgctaggcncatcaagtgagtagcttcagaaggctaggtaacatgaaataattcttaggccactctttctcatgggaatatgagctanttgttagatttcagcaaagacatccatctataatttnttcctatngtnttctaagaaaggaatctgctttagattttaaaaatactgngctttctttaatctcttgtcacatcaacctggccactgcagggcaagattttcctatcacgcaccaaggagggnggaaaggactattataggagttaaatcccattcaccaccttggacttatggntcctttctaaaaggaacccccattgtggaaacaatccaccctttaaaaacca

SEQ ID NO: 501759 - DNA, 340 bp, Homo sapiens
  misc_feature (30)..(30): n is a, c, g, or t
  misc_feature (94)..(94): n is a, c, g, or t
cccatttttaacctgtggtcagattgaaanctttgtgcctcatcaacatctacacttagaatttttgaagtagatgtcggctgggcacaagtgntcacgcctgtaatttgagcactttgggaggccaaggtgggcgaatcatatgaggtcaggagtttagagaccagcctggccaacatgatgaaaccccgtgtctactaaaaatacaaaaattagccagtaattccagctactcaggaggctgaggcacaagaattgcttgagcccaggaagcggaggttgcagtgaactgagatcatgccactgcacttcagcctgggcacagaagtagctccgtctc

SEQ ID NO: 501760 - DNA, 703 bp, Homo sapiens
  misc_feature (10)..(10): n is a, c, g, or t
  misc_feature (267)..(268): n is a, c, g, or t
  misc_feature (315)..(315): n is a, c, g, or t
  misc_feature (367)..(367): n is a, c, g, or t
gaaaaaaggngggtcctattaaaaagttttttttttttggtttgttggaaaaaggattaagatttgcaaataaaaggggccttgagctgctgataaaaggcggaagaaggtgatccagatgaaaactgttttaagagtcagatgcaaggaagattgaagatgcagatggaaaggaggttgaagatgctgccgcaaagttgttcaaagatgatgattccaatgagaagttgtttgatgaggaggaagattccagtgagaagttgtttnnccattcttataaaagggggactttgggtggttttgggagtgttgaanaagggcccctatcccctggcagcagctttattttcaggagcgatgatgatgncgatgatatttaatcccttaaacttgctttttagggagagtcccccctttacatttgcctgggcttcaggggaattactagtagggttacatgaacatgggcatagtggtaggatgccctcagattaaagccttgaagggtttccttgttccccggccccaaggggtttaaaaatatgttaattggttgtttagttaaaatgtcatagttccaatgcaagtaaactggaaacttgtttttttgtcagatttgttaaaggcacgcagaataatattttttagaggattgattgaaggttgggatattcccccataaaaatgggttggtaatttgcca

SEQ ID NO: 501761 - DNA, 162 bp, Homo sapiens
catagaggattccactttcagagtagaacagagaacaggaaaatcagcctccaggcatcagcagctgctcatgttcagtgcctgaggctccccttgccaatgtggtgaggtggagtgggtgtactttccttcctttatcaacttatcccattatcttcccca

SEQ ID NO: 501762 - DNA, 219 bp, Homo sapiens
cggcgaaacagagctaataccagtacaacatcctccagatgaatgctattccagctagcacaagttattttgaataaatatgtagaaagaattcagaattatgccccagcttacacgaatgttgggttacttaaacgacacatctacaactgtcaaaaggaagtcagcaaatgcataccaaagggcaatttagttgttacagagctgtatggacccgaa

SEQ ID NO: 501763 - DNA, 221 bp, Homo sapiens
gcaatcgtgggattcctggttttcccaatgcccaggtcccactgtgacaagcaaaatacccaacaacctgtaaagtaggcctgaccaatctgagggcagtttacatgagcaggaggtaggcccaggagagttcctgggtcctaagagttaaccctttaatcattggacaatggaggtggaaagatcgcttgaggctggaaattcaagaccagcctgtgcaa

SEQ ID NO: 501764 - DNA, 361 bp, Homo sapiens
tcaggctccagcacaaccacagtgaggcagagcatcaagtgggcttttgggttccccagttccaggattttactcttgtatggcatttctggacctgccctaagccagcggggagcccattgccctgacaggtgagtcccaggccaggcagcactcatcgcaagctgacttaagagcccttgagcctaaagggaacattggctggtagtctggcagttctccttgtggcctgggatggtgatggctacagggtgaggctcctttgcctttggaaaggggagggaagagtaggaacaagtgcgtctgtgatttgactgccagctcagcctcaatacaatagtacggcaggtagacttctaat

SEQ ID NO: 501765 - DNA, 324 bp, Homo sapiens
atctgactagctgcagatttaacatgaccattaggcattatgagaaggaagaaaaagtgctgcctcgtgtttatttagattataaaagtatggtggcacatgattttattgttcagaatagggaaggagagcttaaatataaattgttctttgataaacatcatcctgagatactaccttgcctgctccttctttgtttgatttatctgcaggctagtaccttgttctgttaaaggctattcacgcctaccggaaccctgcaccagccatggagccagagtcggaaccacaagttgatccttcacgacaggtctaaatgcaata

SEQ ID NO: 501766 - DNA, 455 bp, Homo sapiens
  misc_feature (12)..(12): n is a, c, g, or t
  misc_feature (104)..(104): n is a, c, g, or t
  misc_feature (172)..(172): n is a, c, g, or t
  misc_feature (192)..(192): n is a, c, g, or t
  misc_feature (291)..(291): n is a, c, g, or t
ctaaaatgaagnttagtgctttctttatatgtaggaaagatgggtttaggttatggcctttgccctttaagtcgtttcagggtgtcccttctacaccctccagntacgagggacttataattcctttcccaagctgcccatgggcatccccagggccctttgttccttttcntgggcttatgccccagaggntggggttggcccccatttgtatccttagtttgaggaggattggcccagcggtaggttttgagagttacaggttgcaatggtgtgggagggagccgtggntagtggaaagtgagaccacccggtccaccaccgcatcctagaggggcactcagaaaggcccagaggtggaacgtcatgcctggactccctcactatttggaaagacttttttggagtcctgtcatttaagctacaataaagctttgtttttcattggaaaaaaa

SEQ ID NO: 501767 - DNA, 315 bp, Homo sapiens
ggcgtttacggatggcgccaagctgcatgtcgccctctgatgtgcaggcagcagcctcataggcaactcctgggcccgcccgcactccccacatctcggaatgcagggccagatgttccatgtggctgctggccgagccaggcggtctgccctgcagcagctgcactggtgggctggtgaaccggccctcagccccatccccgtgtggctgcagagtggccccatggctagaggtctcgagctctggcagaggaggatgcctgggagggggcagtggtctggcgggctctcagtgccaggggcatccgcgatcca

SEQ ID NO: 501768 - DNA, 489 bp, Homo sapiens
agcgggtcgttagctcggcagtgctggcagcgctccgggcgcgcttactccattggccggccgtggattgtgagtacgtattgcagagcagcatgcgggcgtgcagagcctggtgttgggcatcctagcggggatgtgtggcacttctcctgcagcgcctagtgtgccccgtgaaagtgacatgggaggccgcgtggatgccaacctgcaacaatgtcgattacacgtctggaaggctatgaatagtcggaaattactactctccttggccaggttccaccaaacatgaacctaagacttattgagtacggtgtggtaccccagccatcaaatcattttgcttagcaacgactaagaaacttacgatcgaacatcacacctcgaattacaacagcaaatgttgcgactagagagtggcctacggccagaggagaaatacgcggcaccgcgggacgaacattgaacacgtgttttagcttgataactggg

SEQ ID NO: 501769 - DNA, 588 bp, Homo sapiens
gggaccctaggcaaacaaaaggtggaggagccatgatcaagtcagcttcatccctgggatgcaaggttggttcaacatatgcaaatcaataaacgtaattcatcacataaacaaaaccaatgacaaaaaccacatgattatctcaacagatgcagaagaagcctttgataaaattcaacaccgagtcatgctaaaaactctcaataaactaggtattgaaggaacgtatctcaaaataataagagctatttatgacaaacccatagccaatatcatacttaatgggcaaaagctggaagcattccccttgaaaaccagcacaagacaaggataccctctcttaccactcctattcaacataaagtctggccagggaaatcaggcaagagaaagaaataaagggtattcaaatagaaagacaggaagtcaaattgtctctgtttgcagatgacatgattgtatatttagaaaaccccatcgtcttaacccataaatctccttaacctgataagcaacttcagccaaattttaaggatccaaaaatcatgtgcaaaaatttacaagccttcctatattcccaataccaga

SEQ ID NO: 501770 - DNA, 221 bp, Homo sapiens
tatgcctgtgtgcctcatccaacctgacctgcgatcgagaggaatacgtccagcagatagcggatgccctgcagtacctgcagaacgtctctggagacctcttcagtcaggtgggttctgccacccacccctcacctgatgagagggccatccttgtccttgcgcgcaatcccagtcaatacagcctctgagagcatcccccttgcgggactcccgttcct

SEQ ID NO: 501771 - DNA, 1396 bp, Homo sapiens
gcgggctctcgggatgtgaccggggctcgtgccttgtggctgcaggcggctggcttcctgtaggctgtcgggatcattgagcagggttgcaggaagaggggccccgaaataccctttcttcttcagggtctaaagaaaactggcgcgctggatgcaagtacaggaacttaatacacaatggcaagagctggaaagttgaagaggagcgagtcctatagctcttgttagatgcccatgtgtagctcaggttgtcaatgccaagacacatacaactgcgcgactcacgcagctgagtacaacagccgccacgcggctcttccatacagtccatggcactcaacacgtcaaccgtctcacaggcgcgacccaacaagcttacaacacaggacgtgacttgagaaacgcaacacaggactcaagagccttctatgtcggataggaagcaaggggccacaatgcgcagcatcgacgctccacagaatcccgtacgtcccgaaggacaaggttccgctatgccgtacgactcgaagtgctcatcgagccacttgtatcacgggaggcatttggacgacgacgggggcatggcgatccaagcgtcatatacgtgcacagtgaatttctccaaccatctgggaaaaaagatttccacagtcaattggggggccaactggacactgctcgcccagtgtgaacaccaggactgggacaaccacttggttacgcgaggaaaattgacacgggaggacaactatagacatcggcactatgaaaataggggcagcacctcagaatgggcgagacgattcacggaggcacaccttatcacctgcacacacgactcaccagcaggcaacagagcaccacgccccgcagcagagcaccaaccgccaaaagcaccacggcgacactaagcgcagactctcgccgtgctacgccagacacgtagcacaaccacacgaactcaggcaacgccatccttcaccgcgagacacccaacacaacgacgcgacccgccttgcggagcgccagactaggcacaccagagacaacgggacccaaacacagacgtagtcctggcctacgccgtcaccacacgcccaccatgccaccacccggcactaacgccctgcgcgcactgacggacaaggataacacgcaaaggacgaggccttacacggaataccccccacacacaagccacgaaccgagcaaaactaatctcaacaaaaaccacccggaaagacaccgctctaagacacacacgccgcacatcaaccgacaccgaggcgaccccagcaccggcaagcccacactgaagcccaccactgaaactgcccaaaccggggcaccccagcggagtcagaccatccaccgacagtataaccacaatgacaga

SEQ ID NO: 501772 - DNA, 717 bp, Homo sapiens
agcggtgttggccaggctggtctcaaactcctgaactcatgtgatccgcctgccttggccctcaaagtgctgggattacaggcatgagccaccacacccggctattcttggtattctttattcttggttctctagcctttagaaaagaaaattctatcttggtaaggaaaatgtcatttaatcaagctccagtacagcttgtgtcaagacctagataagaccaccttctagattgtgttcctggcagtatgacattataaaactaacttgagaattgtcaggatatctccttgttccctgacgttgttattgtaagaatctactacattccttaagaagttaaccataatgccgagttgtcaccgaagagatgagtagttgttatcttgccaaggaattatcttctgtagtagcctgaatattggcgttatatccaaaaaaggcgttaacctccatcgagagacttcttctgcgcctctctctcagcatatgcttgtgatattcgaagtgtgtaatagattggagctatcaggtcacttatttctgaatacatgtatcttctttcttcatagctgtgaagcagggataccaaggaaagtgcttaactgctgtctttctctctcggtgaatgcttatcttaatgaacagctcaactgacaaaaacacctccacctaaaagcaggaaagatggcaattctacatagcagctattatccg

SEQ ID NO: 501773 - DNA, 447 bp, Homo sapiens
  misc_feature (24)..(24): n is a, c, g, or t
  misc_feature (66)..(66): n is a, c, g, or t
  misc_feature (69)..(69): n is a, c, g, or t
  misc_feature (101)..(101): n is a, c, g, or t
  misc_feature (107)..(107): n is a, c, g, or t
  misc_feature (129)..(129): n is a, c, g, or t
  misc_feature (131)..(131): n is a, c, g, or t
  misc_feature (135)..(135): n is a, c, g, or t
  misc_feature (137)..(137): n is a, c, g, or t
  misc_feature (141)..(141): n is a, c, g, or t
  misc_feature (143)..(143): n is a, c, g, or t
  misc_feature (145)..(145): n is a, c, g, or t
  misc_feature (163)..(163): n is a, c, g, or t
  misc_feature (176)..(176): n is a, c, g, or t
  misc_feature (183)..(183): n is a, c, g, or t
  misc_feature (189)..(189): n is a, c, g, or t
  misc_feature (242)..(242): n is a, c, g, or t
  misc_feature (285)..(285): n is a, c, g, or t
  misc_feature (307)..(307): n is a, c, g, or t
  misc_feature (353)..(353): n is a, c, g, or t
  misc_feature (403)..(403): n is a, c, g, or t
ctaaccaagaaacacagagaaaanaaaaaatatagaaaagtgaagattcagaaagaaaaatgacanaanaagaggataatcggtaacaagctgggcctgtnatttcnaaactacagtgcgaatgaaaanangggngngagngngncaatctacatgtttttcnaccaggtaaatanacctganagggtnacctaataaagaaaaaaggctttaaaacttttaaccacaaagaaccttccgcnggcgcacattatgaagatgggctatgcatgtggccagactaantcatttcccaggagattcagcncactgcttagctgcaggaagtggtccaacaatgacagagtatattnacatcaacaccagctcagtcaaccaaagaagcacagtaaaaatttaaaancacactgtttatatccattagtatgtcaaaatcacaatacacag

SEQ ID NO: 501774 - DNA, 833 bp, Homo sapiens
tgatctgtaatgacaagaatctgtactgcaaggtaaaacctactccccaaaaatgtgtggcttagggtctgcattcaaacgctgtagtccgatgttcatgccgaaaaatggctgggaacgttgctttatttacattcagtcagcgttgctttcagatcacactttatccacacaggaaagccagtcagcctatcatgaagtagttattaaaataaatgtaatgaatatgtctacaaagtatacgtttagtggttcattttgctaaaatgcacatatatttgatataatttagttctgacggaagttcagctagtttttctcctttgtttgacttgtcaatttctatctggtttttaagggtctgagcttagcttgtgcatgcaaggttctgggtttagttcatttcatttctttgagcacagctttttcaccttttaacttccgctcgggctattctctactcttacctaagagaaatattggccaagtcgagtttttacatataatacaacgtgtgttcttccagtacattggttcctgtccccatctctgtgaactgtcccgagtattggaacagtatgtcttcaataattcaaatgttactttggagattacatgtgttaaatatagccctagagtttattctcggacaatcaaaccagtctcttaccgcttggcacgcacaacaccacacacacagaccagcccaccagcgacacaacacgcccagaaaaaggagcgggggctcaaaaactcccggcgcccccaacacgcgcccacatcgtacaagggccccaaacgcgcttaaccagggccgcccacaacacccacgc

SEQ ID NO: 501775 - DNA, 152 bp, Homo sapiens
gctggctgtggtgtgcgctgtatccagcctttggaggcaacgctgtggatcacctgaggtcaggagtcgagacagtctgaccaatatggtgaaaccttatctctactaaaaatataaaaattagctgggcatggtggtgtgcgcctgtagtt

SEQ ID NO: 501776 - DNA, 168 bp, Homo sapiens
taagtagaggtggggtttcaccatgttggccaggctagtctccaactcctgacctcgggtgatccgcctgcctcggcctcccaaagtgctggaagtacaggagtgagctaccatgcctggccctggtttatctttttttaaattataagacattttcaaggtcgacgc

SEQ ID NO: 501777 - DNA, 288 bp, Homo sapiens
agcggacagtacaaaatagaaacttgatttttttacaaggtcctcctgtacatacaagacagcatctgctctccagtgcccgggactggcagcggggacctcagtgtaggcaggcaggccgaaggcctgccgtcgaggatcagtgattgggctgagacagacagttgcatgaaactggccggtcaggagcacccagcgagagttcatccatgctctggctggacgggaaggcaccgcggccggttgggagtatataatatatttgtcagatacacttttgtttgttcc

SEQ ID NO: 501778 - DNA, 790 bp, Homo sapiens
ctgctgtaacaaattaccataagtttggtgcttagaacaagataaaggtattattctacagttctgcagctcagaagtctgaaatgatattcacaggactaaaactaaggtgtcagcagggctgtgtttctttcttgggggctctaggggcaatccattttcttgacttttctagtttctagaggcttcctgcattctttggctcatggacctttcaaccatgcgatatgtaaacatgcagtatcgcatcttcaaattctctttgactctgatcttttgcctccattttccatgtttaaaggacacttgtgattacattgggcacacctggataatccaggctgctcttcttattttaagatcagctgcttggcaactttaatttcatctgcaatgttaattctctcttaccatatagcataacatactcacaggttctggggattaggatgggaacatatttgagaggtcataattctgcctactacattgatacacatattttctgttaacataacatttatttatgtacgatatggctttttaaactccaattaatttcgttatgagggaaggaaccaacacttaatcactcacttacaaacattttctgccttaaagtgtgggtcatgaaccagaaggtccagcttatgtaggagcctgttaaaaagggcaaggccttatttccatctcacggcctactgattgaatcagccttcactaaaacccggttaatacccgacggacaaaaaacatggatccaagggacccataggcagtataatcacgg

SEQ ID NO: 501779 - DNA, 393 bp, Homo sapiens
acgcattgtgtgcacggagtgggtgttgatggaggagcacgacgccagagtgccagtcctggaaccgcgcagagtggagcaagcaccacctgtgatctactatgtgcctgacttcatcttcaaagaagaggaggagtgtttggttcgacagggttttaatggcccaaaggcaaagtggacccagctctctgggagaaaggtacagaactggggtgggcttcctcatacccgagggatgggtcctgagagggtgtccccaagggttcagggcttcgtggacaaagagtgcctctaactctttggaggcctcccagattaccatgttctcgtggaccagaatctgtctggggagggcattatgggccacacacccttggtccgtgtgcccccctt

SEQ ID NO: 501780 - DNA, 198 bp, Homo sapiens
  misc_feature (19)..(19): n is a, c, g, or t
  misc_feature (85)..(85): n is a, c, g, or t
  misc_feature (91)..(91): n is a, c, g, or t
  misc_feature (156)..(156): n is a, c, g, or t
  misc_feature (158)..(158): n is a, c, g, or t
ctacgaacgagtgagagantatagtcagaaagtcctggaacgacagcctgataatgccaaggccttgtatcgggccggagtggcntttttnccattctggcaggactatgacccaggcccgcccactaacctccctggctgccgtggaataggcantnaaaaggtaagcaagaagggttttgaattgtaaagacaaat

SEQ ID NO: 501781 - DNA, 261 bp, Homo sapiens
gtaagcagcaggaggacaacatgtgctttatataccggggttgtagcatttagtggtgcagcaacttgcaggtggtttttcctctcactgtcttcacattttctcttttattagcacaggcagcagtcatttcactggcacaggaagcagcacaaagcaaagggcatgtctgcaaatttgaatcacagtcagcaaacatgtttcaacattgtctcgcatgggcagcaagcatgcggggtcaccgagctcgcaattcgtcaa

SEQ ID NO: 501782 - DNA, 126 bp, Homo sapiens
gtgattgctgcggaaatcatcagggtagcattttcttgactatgcagatgtgcagacctggtggctacttctgcatgtgatcgcaggtccttcactgtcattgagcagatatgccgtagcgtggga

SEQ ID NO: 501783 - DNA, 383 bp, Homo sapiens
gtaactgccaccactgtgcatgactcaatacttgcacaatacgctgcgcgtggctatgcaagtcatgagcaaacagggttccctgtctaatgtgcagtctcctctctgaatatggatcatcgtaccttatgtgacggatattaacagttcctctaaggcctttggagcgactgcctctaagaaacatccagcattcctgacaactcctagctctctctcgagataagacttgtagcctgtaaaataatacaggataaaccagttatccactcagtgaacagtcccacacattgttatatcatcatgataatgatacacagacgccccccatgtggttatgatgctagcaccctctgcatatatactctgcgcttccaacacca

SEQ ID NO: 501784 - DNA, 137 bp, Homo sapiens
agcctactacatcagacatgtcctcaaataaaagagtcagaaactgctatgtgccttaggatttgtgtccccacccaaatctcatgtagaattgaaatccccagcattggaggaggggcctggtgcgaggtgactgg

SEQ ID NO: 501785 - DNA, 169 bp, Homo sapiens
actgaagataggcagtcgtcactgatctcagattcaaccttgaccatgggcagtgaccagattgaaaggggagcaagttcggcagttggagagttgccctgttaccccctgcattgtcttgccatttgccagcctgtccagggcatgccaccacgtgggcatttcaggg

SEQ ID NO: 501786 - DNA, 270 bp, Homo sapiens
aacgatgaggtgcttctgattctgtccaggtgaatagggttggagacttgttcaagatcgacaaggagtacttgcttaatatggctacagaggagtgaggaatgctgctgtagcgatacctcattgctaccttggcttagattcttcagaatttctgatcctcttccatagcctctataatcactcttcacgatataattcctcaggatacaataccttgcctctccacggttcatatgtcttttccttttgttttggaaaaaccaacaa

SEQ ID NO: 501787 - DNA, 301 bp, Homo sapiens
acgccatatagatgccaacctatgatatagcagtctcacgaagtctggagttttgcctatccaatggccaatctcaaagtgatcagaaacttagatgagagactcagagtctattaagcctggattcataaaactgctccgtgaaagataaagtaaacacattgtgaattgacacaaagtcctttagaaaccaggcccccaggttttaacagaccataattgaggcagcacgggctctggtgcaaaatcccccaagccacttttggggaagaacccaaggccaggggcgggaataaccttt

SEQ ID NO: 501788 - DNA, 877 bp, Homo sapiens
cagagaaaggcgaagctggatgagaactcgggcttccttcagggcaactggaaggcggagggtggtggagtcctggatcggggaagaaggagaacagctgaagacagatgattatggccgacaacctgtctgtcatgtgcagacggcatcctcacgcaaacgaggaaacttgtgacgctgggctgcaggccttccagcaggaaggcatggccaacatcactggcctcaaagatcagcttctcgccgccgaaacacgttcagtccaaggccatcgaggcccggcacgccgccctcatgaagaggtggagcctagcttctgggcaactctagccgcccgctaagaagaagcttctggaggctcagagtcacttccgcaaggtggaggacctcttcctgaccttcgccagaaaggcttctgccttcaacagctggttcgaaaatgcacgaggaggacttgaacagagcccgtgcgctgtaactccttggaagaaatcaagagcttggcgcgaggcccacgacgccttccgctcctcccctcagctctgcccaggctgacttcaaccagcgtggccgagctgggacccgcagatcaagagcttccgcggtaggactccgaaccctacacctgggtttaccatggaggccctggaggagaactggaggaacctacagaaaatcatcaaggagaggggagctggaagctgcggaaggaacagcggcgggcaggagggcagaacggacaaggctgggccccggaggtttgccccagcaccgccaatggcctttcacccagtgcgatccaagagacccggagaatacctactcggactgggcatcgcattatcgacgagcgcaatccgagtctattaggtatgaa

SEQ ID NO: 501789 - DNA, 419 bp, Homo sapiens
cgaggccaggaggagggtggatctccccagagcaaagcgtcggagtactccgcctccttctacgcctactacggtggcgagattagacccagagaataggatgagacacgtcaaagtgcgagctggactggtgcaatagattcgagagctggctgtgagtggacgctttgcgtgcggatgaagacagacatacgctgaataagccgacgagactgcggctgactgattcggtgaactggagagttagtcaggtgagcaggaaatggtggacgataacaggtgttggatcattaacatggatatgacactccaggttaagcgctagatggtgagctgagcgtagctgaggcagacagtattttgcgtgcacttcccctgggcgtatgtattagcttagcaccgccttctttggacgcctg

SEQ ID NO: 501790 - DNA, 474 bp, Homo sapiens
  misc_feature (451)..(451): n is a, c, g, or t
cggtatcaattattttagctgtttcataatcattaattgttatgtaagaagaatgtctgtgtttttccaggaatgcatacttgagtgtgtagaggtaaaatgacatgcctgggatttgctttaaaataatatcagcaaagagaaaaggagagggagaagataaacaaatgtagcaaaatcatgaaaagtattgaattaggctgatgagttaatgggagttaattcaagtcgtctttatctacttttgtgtatatttgaaatttttcattataaaaacatttatacagttcagggtttttggttgtcttttatgtccgccaccactaactagattgtgtactctaaggaagggattacaacttgtttttgaatctctgttgctttatatagttgctgacattgtagcatagtgtatcatgcacatacagtgttgaataaattaataaaagcntatttaattaagtataaaaaaaa

SEQ ID NO: 501791 - DNA, 217 bp, Homo sapiens
ggcgctgagactgcaggcgagccttaccacgtcaggtgtgtcatgaagagagaggtaccacagccccggtgcctgaggccaccatttgctgggtgatcgtggggttgtattacaaccccacgatcactccaacccctgcttctgaggtcacatctcctactctgaccctcctgcctccctctgtcacagatccttgtgaaagcattgtggcccctgg

SEQ ID NO: 501792 - DNA, 251 bp, Homo sapiens
  misc_feature (19)..(19): n is a, c, g, or t
  misc_feature (35)..(35): n is a, c, g, or t
  misc_feature (163)..(163): n is a, c, g, or t
ccgagacgggctgatcatnaggtcaggagattganatcaagaccatcctggcggctgggcgtggtggctcacgcctggaatcccagcactttgggaggtcgaggtgggtggatcacgaggttgggagatcaagaccatcctggctggcacggtgaaacctgtntctactaaaagtacagaaggttagctgggcgtggtggcgggcgcctgtagtcccagctactcgggaggctgaggcaggagaatggcgt

SEQ ID NO: 501793 - DNA, 163 bp, Homo sapiens
aggtagagtctattgacgcaccccttgaatttgggctgactgtggctgggcgcagtggctcacacctgtaatcccagcactttgggagcccaagcgggggcagatcacgaggtcaggagttcgagaccagcctgaccaacatggtgaaaccctgtctctacta

SEQ ID NO: 501794 - DNA, 738 bp, Homo sapiens
  misc_feature (738)..(738): n is a, c, g, or t
gccgggcgcggtggctcacgcctgtaatcccagctctcagggaggctaagaggcgggaggatagcttgagcccaggagttcgagacctgcctgggcaatatagcgagaaccccgtttctccagaaaaagggaacaaagaaaacaaaacaaaggggcaaaaaaacaaacaaaaacaaaaacaaaaacaaacacggtgtggggccgcgcccgcgggccccgcgggaaaagcgcttcagagaaaacacacaatcgcgggtgaggaggcgcgcggggggcccacaaagagaggacacagggtgacgaacagaggggcgcacaaaagccgaggagtcccccacaagagggagaacacacgcgggggcgccacaggaaacaagaggggcgggagggagatactcctcccccagccccactacataaaaaaaaaaacagaacgcgcccgggggagggacacacaaccccggaggagccgcgcgctcgccgggggagacacaacaacaccatcccagcgagaagggggcgaggagcacaccagccgagagagaggaggggcacaacaacaatagagggggggggacagacacactaacaatacacacaaaagacggggggggcagtcaccccaccaagagaaagggagcgaaagcacccgcggcggaagagaaatgtcataaacacaaacatattatacgagcgcccaccgcgacggagcggggtcgtggggggggcggggtgatn

SEQ ID NO: 501795 - DNA, 330 bp, Homo sapiens
gcctggcccttgcctataggcggcattttgaaatgtctttgtggccgggtgtggtggctcatgcctgtaatcccagtactttgggaggctgagggaagtggatcacagggtcgggagtacgagaccagcctgcttaatattgtgaaaccctgtctctactaaaaaaaaaaaaatacgaagagcagccagccatggtgactggtgcctgtggtcccggctgctcgggaggctgaggcaggagaattggttgaattcgggaggtggaggttgcagtgagccagggtctgccactgcactccagcctgggtgatagagtgagactccatctca

SEQ ID NO: 501796 - DNA, 93 bp, Homo sapiens
ggttcgtgaactctttgaaatggccagaacaaaaaaagcctgccttatcttctttgacgaaattgaagctattggaggggctcgttctgatga

SEQ ID NO: 501797 - DNA, 554 bp, Homo sapiens
  misc_feature (166)..(166): n is a, c, g, or t
cagtgaacagctatgacaaaagatacaaggagaaaaatcacatgatcttcccagcaggtgcataaaaatcatttgacaaaataattgtccattcatgatttaaaaaaaacaaaactcagccaagcatagtggctcatgcttgtaatcccagcactttgagaggccnaggctggcagatcatgaggtcaggagatggagaccatcctggctaacatggtgaaaccccatctctactaaaacaaaacaaattagccggcgtggtggcgcatgcctgtagtcccagctactctgggaggctgaggcaggagaattgcttgaactcatgaggcggaggttgcggtgagctgagatcgtgccacagccctccagcactgcagcctgggtcacagagcaagactctgtctctaccaaaaaaaaaaaaaaaattgttggttggacagactgggaagagagagaaagggaaagggaacagaagctgtagcccaagagtctgaaaagctgggctggagtgctgagcacctgaaaaagcccaaagcgaggcaggccgcggggtg

SEQ ID NO: 501798 - DNA, 2005 bp, Homo sapiens
ggggccggggttagtagcccaggcttagctgggggggcatgaatttggcggggaggcccagggaactgaccacaagctagggaaaacttggccattaaggaagaaaagcacatccgaggtggtctgagtggagcaaggcaggaggggcccagcctttggcttttgcgagtggaggatgcagtctctttgtggttcctggtcctgtttgagaacctggggtcttgaggtggcctgtctgtgcctctcctttgtttcggcctgggctgggtggtgcttgtgagcatttgctccaggatccgcagacgtttcggtggtgacacctgccacgcacacgtgccgcactggggaccaggaacagggatgagtcaggcacagtccttgccttctgggagctcatggtccagaattgaggattcactcaacagatgtcccttgagcgcagaggatctggcagccccttctcagggggccggggcccaccgatgttgcatgctgagggtattttactttaacacccatggtgtgtctaggagactgaggtttccctggtttcatacttgctatctttcctcacgctgtgcctgtccccagcctggaaggataggtcagaaatccttcaaggtagctgtttcaggagatctttttctggccccaggtcaagttctctttggttccgtcctgagctcattacctcctggtgaatcatcacaccatatttattggacacctacagcttgctaagcattatatagaggcctgtctttgaggaaaggaaattaaacaagccctgtacagatcccccaagatgagaagtagctttagttgaggccactgctgctcttagcttctctggcccatctatgcttctagatggaacgtgtgtttaagatgcagattacaggtgtgagccaccacacccagcccaggctcattcttttaacagccttagcgcaactactaatgccaccaagagcggacaggaaggcctgggtcccatccccttgcgaagccagtaggtgaaacatggcagcttggcctggttccacttgcatcgccttttggtcctcacagtaatcctcagagtggcccaggtgggtagttggttggttggtttttttttttcagacggtgtctcgctctctcgcccaggctggagtgcagtggtgcgacctcggctcactgcaacctctgtctcctgggtttaagtgattcttcttctgcctcagcctcccaagtagctgggactacagtcatgtgccaccacgcccggctaattttttgtatttttagtagagacgggtttcaccatattgaccaggctggtctcgaactcctgacctcatgatctgcccgcctcagcctcccaaagtgctgggattacaggcgtgagccaccgcggcccaacagcgggaagtattttttccattgagtagatgagcagaatgagactcaaggggttgctcagatgggccgggcatggtggctcacgcctgtaacctcagcactgtgggaggccaagggggcagatcacttcaggtcgggagttccagaccagcctgttcaacatggcgaaaccccattctaccaaaactacaaaaattagccgggctcacgcctgaaatcccagcactttgggagactgaggaggggtcacctgaggtcaggatgtcaagatcagactggccaacagaatgaaaccctgtctctacaaaaatacaaaaattaggccgggtgccgtggctcatgcctgtaatcccagcactttgggaggccgaggcgggcagatcacaaggtcaggtgatcgagaccatcctggctaacttggtgaaaccctgtctctactaaaaaaaaaatacagaaagttagccgggcgtggcacctgtagtcccagctactctggaggctgaagcaggagaatggcatgaacccgggtggcggcgcttgcagtgagctgagctcccaccactgcactccagcctgggcgacacagcgagatttcccatct

SEQ ID NO: 501799 - DNA, 383 bp, Homo sapiens
gagagagacatacactgctgaacttccataacagtcaatggtacagtcaaacatcacatgtacagaacacacaactctagatgaactgaaattatcagataaaataaaataaaatccaattgcaggaaacacaaaaatcaaaacattagaggatcccatgaaatattcttaaacccttaatgaggattctcactggactcgagagtcatttcgtatgtagagacatatcacaagtatggaccctattaacccgagtcatagggaattctagtgggcagcctgaatggagtggcctgcatcagcacactctagcacgaaaaaatggtaaaccatgtgttttgactactgaaagactcgctcttaacttaagcctctgaatcatc

SEQ ID NO: 501800 - DNA, 107 bp, Homo sapiens
ctcactgtcgtcttcaactctccttaatgagattaacactattctcaccagacctcctaggcgaccagaacattataccctagccaaccccttgtaaaacccttccc

SEQ ID NO: 501801 - DNA, 1161 bp, Homo sapiens
  misc_feature (838)..(838): n is a, c, g, or t
  misc_feature (937)..(937): n is a, c, g, or t
gcatagtacaaagcgtagctcacgctgtcaaaggcaggttcgcgtatgacaactaagctagtcgtgtgttgtgatgtactttaattcgtgttctcagcgtcaattaacactccctcatcttcgggcttgttgttttccccctccccggaggttgtgtctttgcctctcagccaccacccccgtcggggccgcccttgcgactccctccatcgggtgtgcccggggcagcaccttttgcggccctgtttggggggaagacaaggtgtcgctgtgtccccccccctccctaaagtgacgctccgctcctgagagggtgccgccccgtgttccccttttctcttccggggcttcgcgccccaaatgagttgagaggggtaccccctctctcaagccccaccccggtcaggacgtacagggcaccgggccctggatgtcccgcacacatcggttcttgcttgaccacccaagataaggacccggaagtcgtcttcatcgggacccccttggtcccgactcaagcaccacatgcgagattctggccgaactcttctctcctctgcaagcacttaactttggccttggtggtgacggcacacagcatgtactttggcggctgtgagaattggggaactggaacacatccggcccacagattttggtggtcttgggtgggcccccacaaccccggacacccagcagagccggtgactggtggcaatcaaggccaattgggccaactggtgaatgagcgaccacgccccacggcccgggttttggtgctgggcctgcttccgccgagggcccaacaatcccaaacccacacttcgggaaaaagaanccgaccacggtgaaacgaagctgtgtaacgggccggcacactggctggcacacacccttcgggcccacacttcctaagaatgccgacccctcggctttngtgcacactcacagatggcacccacatcacgccactcactgacactgtatgattacctgcatctgaggccccctgggctacacaccctgtttgccgggctctgcaactccctgcttttgcgttctgctggccccagaaccacgggccaaaggtgctcccctgctggagcccgcaccctaagcatcctgctgccttcccacaacatttaactctccttcctcaga

SEQ ID NO: 501802 - DNA, 646 bp, Homo sapiens
ggaagggcatattgcgtgcatgtggcctaagccagaattatggttactctccagccaaacatgtcagtgagttaagcataacaagcaagcatgatgcaaacatgtctgacctacagcatagggggtgtttgtcctatgcacaattatcgatcgtcattcagttatctcccgagccttcagtagcacatattctcgtcagagcagtccctttaccggtgcagggctaaggatcgatcagtacttagccattcaatgagactatgttacagactatcgcatgtcgagatagcttggtcaaatacctgcctttccagggcacatggaccctgcagctctccacagtgctatgtgtctctggtttattagagctagagaatgccgatgtcttgtaccaagcacactgtctgtaaacgttctgttagcttagactacatcgtgctcaaccttaaatcccatagcccttggtttcagctaagacatgtttttgtaaggtcaaggttcgggcacagtgactaggccataactgcaccttcacaacatgtcatcgtaactattgttcaaagtgcaggtcttgttccaaatggagtcttacatgtctttccgatgtacatagacacagtaacagtctgatcgctcactaatgtac

SEQ ID NO: 501803 - DNA, 123 bp, Homo sapiens
cttgtgaaagctgtacaacaaaagaagtgagcaaatatttgatcttacatcacatatctttaagtactacagatttcactcatttgttcaacaactgtccctaaaatctcatcaactacatca

SEQ ID NO: 501804 - DNA, 355 bp, Homo sapiens
  misc_feature (79)..(79): n is a, c, g, or t
gtggagacggggggtttctccatgttggtcaggctggtctggagctccagacctcaggtgatacccctgcctcggcctnccaatgtgctgggattgcagctgcgaagccaccatgcccgggtgctgtgatagttgagatgtaaaccaaaggtaaaattctaagacatccaatccgactgcatggaccctgcctgttgagcaaggacattccaaaggatactgaatagaccagctttagccatgatgggaaggggaggtgtcaaacctctgctttctacatatgatgggggtggattccaacacggctgaccagccttaattttcataaaagatatccttcacaaggcacgggggt

SEQ ID NO: 501805 - DNA, 331 bp, Homo sapiens
atttattaactaagtttaaactataaattatcttaactgccatgagcggtggctcacacctacaatctcagcattttgggaggccgaggccgttggaccacctgaggtcaggagatcgagaccagcctggccaatatggtgaaaccccatctctattaaaaatacaagaattagccggtcgtggtggtgcatggctgtggtcctagctattcagcaggctgaggcgggagcatcgcttgaacccaggaggcagaggttgcagtgagccgagatggtgccactgcactccagcctgggatgacagagcgagactccatctcaaaaaaaaaaa

SEQ ID NO: 501806 - DNA, 122 bp, Homo sapiens
ataacgactacggacacctgaagtcaggacaggttaggtaacctacccaagtcttgcagatagtgaccaagccagcattccaaaccgggtaccctaatttgaaattcatcatatcttttcct

SEQ ID NO: 501807 - DNA, 1028 bp, Homo sapiens
  misc_feature (288)..(288): n is a, c, g, or t
  misc_feature (540)..(540): n is a, c, g, or t
  misc_feature (557)..(557): n is a, c, g, or t
  misc_feature (859)..(859): n is a, c, g, or t
  misc_feature (871)..(871): n is a, c, g, or t
gtctgaatctgccgggaccacccgttaaggctagatactaatcagacaccgatagtgaactagtaccgtgagtgaaaggtgaaaagaaccccgagaggggagtgaaatagattctgaaaccagtgacttacaaggagtcagagcacgttaaagtgtgatggcgtacatcttgcagttatgggccggcgagttatgttaatatgcaaggttaagcagtataaatcggagtccgtagggtaaaccgagtctgaatagggcgactttagtatattggcatatacccgaaancaggtgatctatccatgagcaggttgaagcttaggtaaaactaagtggaggaccgaaccgtagtacgctaaaaagtgcccggatgacttgtggatagcggtgaaattccaatcgaacctggagatagctggttctcttcgaaatagctttagggctagcgtatagtattgtttaatgggggtagagcactgaatgtggaatggcggcatctatagctgtactgactataatcaaactccgaataccattaanattaagctatgcagtcngaacgtgggtgataacgtccacgctcgcgagggaaacaacccagatcgtcagctaaggtcccaaaattgtgttaagtgagaaaggttgtgagatttcataaacaactaggaagttggcttagaagcagccaccttttaaatagtgcgtaattgctcactagtcaagagatcttgcgccaataatgtaacgggactcaaacacaataccgaagctacgggcacattatgtgcgttaggagagcgttttaatttcgttgaagtcagaccgtgaggactggtggagagattaaaagtgagaatgncggcatgagtancgattcgaagtgagaatcttcgacgcctattgtgaaaggtttcctgggcaaggttcgtacacccagggttagtcagagcctaagatgaggcagacatgcatagtcgatggacaacaggttaatattcctgtacttggtaaaagaatgactagagtgg

SEQ ID NO: 501808 - DNA, 746 bp, Homo sapiens
  misc_feature (258)..(258): n is a, c, g, or t
  misc_feature (275)..(275): n is a, c, g, or t
  misc_feature (577)..(577): n is a, c, g, or t
  misc_feature (589)..(589): n is a, c, g, or t
caggatcccagtgctactccacaaacaggttgaagcttaggtaaaactaagtggaggaccgaaccgtagtacgctaaaaagtgcccggatgacttgtggatagcggtgaaattccaatcgaacctggagatagctggttctcttcgaaatagctttagggctagcgtatagtattgtttaatgggggtagagcactgaatgtggaatggcggcatctatagctgtactgactataatcaaactccgaataccattaanattaagctatgcagtcngaacgtgggtgataacgtccacgctcgcgagggaaacaacccagatcgtcagctaaggtcccaaaattgtgttaagtgagaaaggttgtgagatttcataaacaactaggaagttggcttagaagcagccaccttttaaatagtgcgtaattgctcactagtcaagagatcttgcgccaataatgtaacgggactcaaacacaataccgaagctacgggcacattatgtgcgttaggagagcgttttaatttcgttgaagtcagaccgtgaggactggtggagagattaaaagtgagaatgncggcatgagtancgattcgaagtgagaatcttcgacgcctattgtgaaaggtttcctgggcaaggttcgtacacccagggttagtcagagcctaagatgaggcagacatgcatagtcgatggacaacaggttaatattcctgtacttggtaaaagaatgactagagtgg

SEQ ID NO: 501809 - DNA, 195 bp, Homo sapiens
acggttctgccccgacttgtggctcggacccagggaccttcagggcccgcagaccctcccgcgccttgagacccgaggcgccctaccggcccccctccccggttagcgggcggttgtaaggtcctacggcggcgctgcctgccttcctcctagagggtgtttcctagaaactgataaatcagatcgtgcctcttt

SEQ ID NO: 501810 - DNA, 592 bp, Homo sapiens
atggcttggagtggcccagacccgaacttcgctcctgtgcccaaacttggaactctggaaatgtggcttcgctcactggcgccttgagcttgggcgactgccgagtcctcgaaacccgacccctgcagagctgactccgggactattttagtttctaacgtcaacttgcccgattcaagagggtttgcgcaaaaaacgtagcccgttgtcctcctgctgcagctgttgttgcagctgtgtggctgcgtttagtaggaataaccaactcaaattgggaagttcttcagctcagtatccgctcctgtaattagaactttttttctttaagcgatgaaattttggacagagagatctggagtttagtttgtgactcgaagaaaaactccaaaatgtaataccttgtcccatttggggggaaagtttgggctaattcaattcgccatggaagtgtcttctttttaaagtagtttagtaggtatatgaatgtatctgtcagttcttgagagacctatggatttagcagagattttaacttaagtgcaaaaagtttcatatttaaaggcgaataaagcgaatatttcttaaattagcg

SEQ ID NO: 501811 - DNA, 100 bp, Homo sapiens
tcatgcatcactccccgtgacaccaaccaacccatgagggtagcaggtgctgcaacagttggtggtagctagtggcagtgtttttactgacattttatgt

SEQ ID NO: 501812 - DNA, 338 bp, Homo sapiens
ccgcacaagtggccgatgcgagtagcgcgcatcattccaatgacccctcccccatctcagtctcccagcactcctcccaaagacagggcctctctggaaccttcacagacctgatttctggtcctccccaaccagctccctgtccctgcttctgggcgctccttccttcctgagctcccagggcttcctcaagggtcacttatggtgaccggactattaaaaaacaaaatgatggcaggagtggcagagaagaaccatcatacccatagcagagtgccagagttttacagcactccgcatcagcacattacatatacctaaagcaacaataacatcag

SEQ ID NO: 501813 - DNA, 195 bp, Homo sapiens
gtggtagtgatctagaggatcccatacaggacgggtcatccatcgcataagagcaaagaatactattgttgccacagggctacgggcgcacctacttgagctgcacgtctgcccacaccagtcaccagcgacggcacggccatgatcaccagagcaggccttccttgccaggacctcgagtttgttcagttccac

SEQ ID NO: 501814 - DNA, 793 bp, Homo sapiens
  misc_feature (37)..(37): n is a, c, g, or t
  misc_feature (39)..(39): n is a, c, g, or t
  misc_feature (41)..(41): n is a, c, g, or t
  misc_feature (65)..(66): n is a, c, g, or t
  misc_feature (72)..(74): n is a, c, g, or t
  misc_feature (82)..(82): n is a, c, g, or t
  misc_feature (84)..(84): n is a, c, g, or t
  misc_feature (151)..(151): n is a, c, g, or t
  misc_feature (759)..(759): n is a, c, g, or t
gatccatgaccatccttttcctttttcaaaaatttancntntcataaaaacaaatacatataaannaactgnnnttgacccntntcccttctcttgtctacaaaaaagccacagatgttagaatttcttatggtttggctgtgagttcctnctcttgtctctactctttccacatactgtccatatctgtgactcctagaatgtcatctggtaggagtgtgttgcgaaaagacatccaaagccaacagtgccaagcagacctgccagagctcttgtctctgcagatccctctcagaagcctgttgtcttcaattaatcttctcaatgaaaggatcaatcagctccgtaaatcagggtctcagactcatccctgactgcacactcccacaactggcgcatgccaatctgttgccaaatgaagttcacttttctctttaaatgttactcaactcccaccactatgtatttcgctccattgcctcaatgtgggaatatcgtgatatctttctgaagtaatgtaatagttttcctttcctattcctgtcccattccaaacttccttctaaattggcacaggcttctctgtatgactgtgttcctccatcgctgcattttagctgctgtagcttctctcaatccttaattgaaattttctctgtgaacgaggtgagaaatccgtcaaatcaaccgtgatggggtggggagatcgaagttttcaatcaacaccctctaagtagctgcatcctgtgctccttttcncctgttatgttgagctcctcactgtctaaggaga

SEQ ID NO: 501815 - DNA, 1461 bp, Homo sapiens
gggaggatctgatcagaacatgggccccagaaactggggctctttcccaagggcttttgggccagccttccagtcgtccattggacacctggtagcaaactatgactaggccagaggacctagtgctccgttccacaagagtatcgaaccttgtgacaagtccaaagtgtacagaaggctctggataccctgatccagaggtgggcctgcgtactctcccaacctgggtatagaccagagcacagcagcagtactgggtgcaggccatgagggccctcatgggcattcattgaaccaagatgggcatttgacatcgcaaggactcacatagtctttctcgagagcgtacatcgcctccaagttccccaccttcaattcctcgctgggacacgtcacgtgcccaaacgtgtaaccgttggtacctaagagattagcaggcattggtaggagggatgggaatagttttccttcaatgctgccactccactaagagtcccgtgcaaaatttccgtacagcctcgtccacattcacaattttttcgtaacgcaatatcagttgtggtccctccatccttctcatgggcgcccaagaagagcgatggtgtgttggcctttttaatatcactctttcaacagacatggcgttttatttagcatggctaatttgtggcggcgcctggtaactcaatctccggggagagaatagccaatcgcggtccactttggtaacagaaaaaaggtaatacactcagtgcgttcgcggcgagggcggccagggttgacccacgtgttatggtccctaaggggggcgtaatggctaaatttgggcacgaacgtgggggggggttgtccacattcacagaagtcccccgtggtgtatatccgtaaccgtgggagaacatttctgtgcgcactgccccaaggggtcgacaaaagagcttaagcgcccaaacagttgtttggggaaaagtatgggagcaaatttatgggtcccaagtggttgcgacgttgattgccccaatcacaaaccctatctgggtgttcccccattcgtttggaaacctccgttaacgccaaaagagggctttttgccctagagcttgttcgattaccagcacattttgtgaccccaaggaaggcttcaaaaagacatctcctggggccataggccaaaatatccattgcgtctatagaaagatttgaaaaagacaaacacaagcagaaaactttggggggcgctatggtggcactggggcaaaccgatggttggtttcaattccaacttagacgcgttggagatcggcgcattaatttattataaaggaggaagaggcgagagcgttgaaggggaagtatccagttatagaattcaagagtgaacttccttgggagcttgggtgtagataggaaagattgagactattggtggaaagggcacgacatggaaaacgacaagggtac

SEQ ID NO: 501816 - DNA, 820 bp, Homo sapiens
  misc_feature (515)..(515): n is a, c, g, or t
  misc_feature (536)..(536): n is a, c, g, or t
gtacaagactgggctgggacacatggtgagacctagtctctggctacaaaataaaaaaaaatgagctgggtgtggcctcagctacccaggaggctggggtgggaggatcgcttggtgcctgggaggttcaggctgctgtgagccgagaccacgccactgaactccagcttaggccacagggcaagaccctgtcttaaaataagtattacgtaattgtcggtaatgaacgttatcaaaagtatagtgacatatagcacgggcagaaacttatagagtagagttgtagatgcagccgaaatattcttacagaagttcctctaactaagaatgctcaaatcttatcgtcacaggtcaagatggtaagaaattctagttgtagggtttaaagagcatgtgatttgtcaagaagtagtcccttcagttttaagaaagtctggggaatggggtaagcggttttcttaatgggaaatgcattgccagtcattctctactgggagggatgtcctcttagctgnagaaaatgtcttgttgaaggnagattcgtggcgctaaagccattctttgggagtgtaagtttcatagcacgtaaacatgtatagaccagatagtaagtgggtcccgtcctcttaagcagtaactgttgagagtactggatacagtgattcaaaactgtttagatatttattcgacgtggaggctaaggactttaaagattaagggcagtttagaagagggtgtacttggtcactgtgttcttgtcggatagtatttggggtaatcgtactcttctaataaataacttaaatgtataaaagcggac

SEQ ID NO: 501817 - DNA, 189 bp, Homo sapiens
cccccccccggggggggggggggttttttttttttaaccccccccccccccccctttttttggggtttttttggggggggggggggggccccccccccggggttttttcccccccccctttgggggggggggtttttccttttttttttttttcccccccccctttttttaaaaaaggggtttttttta

SEQ ID NO: 501818 - DNA, 142 bp, Homo sapiens
tagtcatgtttgtggctttctctcccgcctctctcgagcagggtcatggtggcgttggcctcttgtcactctcctttctcctttcttcccctttctctgcccgcctttcccatcctgctgtagacttcttgctttgcctctg

SEQ ID NO: 501819 - DNA, 170 bp, Homo sapiens
tcctgcaagctgaatctagagtatcccccttcgtgcgcccgtcgagtggctccttgtggagcctggggctcttccttcttcatcgtaatccaaaagatcgttattccacatcctgttcttgccataatagctaggctcccctgttctaccccgacgcgccacacaagaga

SEQ ID NO: 501820 - DNA, 4845 bp, Homo sapiens
  misc_feature (263)..(263): n is a, c, g, or t
  misc_feature (301)..(301): n is a, c, g, or t
tttatcttttaagttattgtcacaatagttactctcttttagaccctgaacattttcagtacttgctccaaatggtttagcaacttttgaagtgggattaacaagtttggccaatgaagcttcttccctgcccaccgccagaggtgctggagaaaagtaatcctggagggtcggcgtggaggcagtagagaggtttataaaagtcaaggaagtgggaagaggcttgcgagcagcaggagaggcgcagagtcagaggggcaggngcggcggcggagggagcaggaggttggggcttgagccngtcattccggcgcacgaaaacttgaagtcgctcggtagccggggaagggaaggaagagaggcaggctctttcctagaggtgccgtgatcgagggtctggcactccaagccaactcctgagaacgggaaatgggcgggagtcggtggggtggagagggcagccgtggtcgcgagagcgaaggagcggtctgagaatccggcttgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctgtttgcaggcctttcagatatatccatctcacaagacatccccgtagaaggagaaatcaccattcctatgagatctcgcatccgggagtttgacagctccacattaaatgaatctgttcgcaataccatcatgcgtgatctaaaagctgttgggaaaaaattcatgcatgttttgtacccaaggaaaagtaatactcttttgagagattgggatttgtggggccctttgatcctttgtgtgacactcgcattaatgctgcaaagagactctgcagatagtgaaaaagatggagggccccaatttgcagaggtgtttgtcattgtctggtttggtgcagttaccatcaccctcaactcaaaacttcttggagggaacatatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttgcctccacagctttccttgctgatagccagcctccaaaccgcagagccctagctgtttatcctgttttcctgttttactttgtcatcagttggatgattctcacctttactcctcagtaaatcaggaatgggaaattaaaaccagtgaattgaaagcacatctgaaagatgcaattcaccatggagctttgtctctggcccttattttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacttgggaagcacatagatacatcttacaagttgaatagagttgataactattttcagttttgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagattggtagatctctagtgcatattatcatgtgggcaccttctcttagggtggaatgaggcagtctggatgcagcatagttaaaaggagctgtttaatattctctgtagtctggcctcttaactagaaagtaaagctaaatcagaagcctgtatttaaccatgtgaacagggagggatttagtgttctgatggctgattaatagaacagctagatacttagagcatgacgtgggatgggatgagtttacagctgctgccttttcatggtgagcttagcagttttctcattagatgtgtttttttgggttggggaatagcaatttattttattgattttagactttatcaagctaattagctcccctttagataagtacatgttgcacatgtgcacctacttgtaatctcagatatttatgcacacaagtgtgaaggtttttcagggagcagagcatctgggacaggctgattctgagctaaacagggctcctttaaggcaatatgaactgttgccttctataaattgcacattgaggaactctaatagacaaagattaggtgtcaggcagaaaacactcattgtaaatatactattagttgataaacataggactttcttattccccagtttttctttatcatataatttaaatatttattcattttgtatttaaagactacctacacatagatatatgattccaaagtcatactttctccatccccacattagccaagtgaatacagggccaaatgggttcttggaatgataataacaaagcattacaaagtgggtccccttggttccagccttgtccagagtttttggttatatatttctatttattacaatttaccttttaaattgtaaaataaacctttgtgtggacagagccaatgtttcaatcttgaatgagtaaagaaaatactttggaactgatcctcattttgaaattggttctaaattattatccatttccaatgtctgaaattctcttacttcctgctaaaactctctttctgccaaagttgtttcgtaatctgtctcaatgactataatgtaaaattaaagaagtaaccatgcttctcaagggggaattaaaagtgtttattgaattttactcaggctaattgtttggtcagaaattcctaaggccacagctttggggggttcgtgtagatgtacatggtgggtgggttataaatattgggacttaaggcagcttgttctatgtatttatctttgctcttgggtgacttagggaatgattttatttgatttaaccttctttctgtttgccccgagaatactcgccagtggcgcttgcagttgtagcatttaccccaagataactttgcctacgaaatatttcgcttttattattttcacatcattctagtatatggactttggaaacaaaagacattgttctatttatagcattcttttttttttttagtagcggtatttccatttacaaaatatagtaactcttgattactgaaaatgtcaaatcctagaaaacgtagcatgcctatacatgatgttaacatcattctcgaacagttgttggccgaagattcatttgatgaatccaatttttttgaaatagacaattctgatgttctctttagaaataactcagtttttatcttttttcacattgaaaatcagttagatttgcttaagcctcaaagagaatgtttatgtaaattagcgctggcaatttttttttttctaaacaggaaaagggttaaatgaaggttgataaaatggatgttcaattgtctttctgaaagtgagtggcttgaagggatgaataaatattttcttaatatattcaaaaaagtgcattgctttctgtgatggaagttaagacctaaatgtctggaagttgtaaccctcaacacagcttttcctgatttgctgcaaaggcacatagctgattatagaagtgaagacggcaaggacggggactccaacaaaggaaaccctgttgcaggatttgggaactttcatgcttcagatgaaattcaggcatgtgagcatcactgcagaatgtggtgcatcattgccatcatgagtaatcacttgctgctcctacttctgagaccaagactcttttgtcatattctttagcaataggacgggtaaagactggatttaattgctgttcagagtataaaaactcaattgattccaacatatctgaatgtgcagtaaagtcttaaaagtcaaccgttaatcattaagtcttttgcctctaaagtcttttgcctctgaagaggtttattacatgagttgattttcatattttcattttggtggggttttcctgttgttgggcaaggtggggtcacaggacatgggactagtaagcattttactgtttactatatttgtctttttataaacagtatctcccaaaatgtgattagaaggctaccaagcctgtatttggacatttaattgtgtgctttatataatgtaactactaacagtatttggactgcctgttcattcctggagacaaaaatgaaaatctgtcagttc

SEQ ID NO: 501821 - DNA, 645 bp, Homo sapiens
gggggggactctcactctgtcaccaggctgaagtgcaggggcataatattagctcactggaacctccactttcccgggtcaagggattcttttgcctcagcctcctgagtaactgggactacaggcgtgcaccaccacacccaactaatttttgtatttttaggagacacggggtttctccatgttggccagactagtctgaaactcctgacctcaggtgatccgcctgccttggcctcccaaagtgctgtgattacaggcgtgagccaccgtgcctggccacaagtatgtatctgtacattttagttagatggtacagggacagctaatgggaggtaaggtcaggtggcttaggtagcctgtgtgtgatgattagtacttttttgtgtgtaggtgaagaataggacagatctcttgaaaccgctcagagaattttggaatctccagggaaacgttcaacttttgtataacttgaaaatgtatgttaagggggtaaggaaactagaatttaaaacaatagtaacaataacagatggggcgttattttttactaggcacttttgcttgcgcctttcttatatttacttgacccatttaattcggagagcaaccctttaggaacaatcttttatacaaaggaaaaag

SEQ ID NO: 501822 - DNA, 399 bp, Homo sapiens
gcacgcgagagagagagagagagagagagagagagagagagagagagagagagcgtgatgcgctcccgtgtctgcccttcctctctgccctctcctcctcccctttctcctccctttttctctttcctttctctcctctctcccctctcctcttctttccttcctccctcccctctcttcctcctccttcctctcccctccttctcttcccttcccttccttcctctcccctctccttccccttcttccttctctttcctttcctctttcccctctcttcccttttccctccccctctcttcctcttccccctctcttcttcctcttccctttcccctctcttctccctcccgcttctcccctctcctctcctcccctctcctcccccctttctccctc

SEQ ID NO: 501823 - DNA, 5008 bp, Homo sapiens
  misc_feature (263)..(263): n is a, c, g, or t
  misc_feature (301)..(301): n is a, c, g, or t
tttatcttttaagttattgtcacaatagttactctcttttagaccctgaacattttcagtacttgctccaaatggtttagcaacttttgaagtgggattaacaagtttggccaatgaagcttcttccctgcccaccgccagaggtgctggagaaaagtaatcctggagggtcggcgtggaggcagtagagaggtttataaaagtcaaggaagtgggaagaggcttgcgagcagcaggagaggcgcagagtcagaggggcaggngcggcggcggagggagcaggaggttggggcttgagccngtcattccggcgcacgaaaacttgaagtcgctcggtagccggggaagggaaggaagagaggcaggctctttcctagaggtgccgtgatcgagggtctggcactccaagccaactcctgagaacgggaaatgggcgggagtcggtggggtggagagggcagccgtggtcgcgagagcgaaggagcggtctgagaatccggcttgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctgtttgcaggcctttcagatatatccatctcacaagacatccccgtagaaggagaaatcaccattcctatgagatctcgcatccgggagtttgacagctccacattaaatgaatctgttcgcaataccatcatgcgtgatctaaaagctgttgggaaaaaattcatgcatgttttgtacccaaggaaaagtaatactcttttgagagattgggatttgtggggccctttgatcctttgtgtgacactcgcattaatgctgcaaagagactctgcagatagtgaaaaagatggagggccccaatttgcagaggtgtttgtcattgtctggtttggtgcagttaccatcaccctcaactcaaaacttcttggagggaacatatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttgcctccacagctttccttgctgatagccagcctccaaaccgcagagccctagctgtttatcctgttttcctgttttactttgtcatcagttggatgattctcacctttactcctcagtaaatcaggaatgggaaattaaaaccagtgaattgaaagcacatctgaaagatgcaattcaccatggagctttgtctctggcccttattttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacttgggaagcacatagatacatcttacaagttgaatagagttgataactattttcagttttgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagattggtagatctctagtgcatattatcatgtgggcaccttctcttagggtggaatgaggcagtctggatgcagcatagttaaaaggagctgtttaatattctctgtagtctggcctcttaactagaaagtaaagctaaatcagaagcctgtatttaaccatgtgaacagggagggatttagtgttctgatggctgattaatagaacagctagatacttagagcatgacgtgggatgggatgagtttacagctgctgccttttcatggtgagcttagcagttttctcattagatgtgtttttttgggttggggaatagcaatttattttattgattttagactttatcaagctaattagctcccctttagataagtacatgttgcacatgtgcacctacttgtaatctcagatatttatgcacacaagtgtgaaggtttttcagggagcagagcatctgggacaggctgattctgagctaaacagggctcctttaaggcaatatgaactgttgccttctataaattgcacattgaggaactctaatagacaaagattaggtgtcaggcagaaaacactcattgtaaatatactattagttgataaacataggactttcttattccccagtttttctttatcatataatttaaatatttattcattttgtatttaaagactacctacacatagatatatgattccaaagtcatactttctccatccccacattagccaagtgaatacagggccaaatgggttcttggaatgataataacaaagcattacaaagtgggtccccttggttccagccttgtccagagtttttggttatatatttctatttattacaatttaccttttaaattgtaaaataaacctttgtgtggacagagccaatgtttcaatcttgaatgagtaaagaaaatactttggaactgatcctcattttgaaattggttctaaattattatccatttccaatgtctgaaattctcttacttcctgctaaaactctctttctgccaaagttgtttcgtaatctgtctcaatgactataatgtaaaattaaagaagtaaccatgcttctcaagggggaattaaaagtgtttattgaattttactcaggctaattgtttggtcagaaattcctaaggccacagctttggggggttcgtgtagatgtacatggtgggtgggttataaatattgggacttaaggcagcttgttctatgtatttatctttgctcttgggtgacttagggaatgattttatttgatttaaccttctttctgtttgccccgagaatactcgccagtggcgcttgcagttgtagcatttaccccaagataactttgcctacgaaatatttcgcttttattattttcacatcattctagtatatggactttggaaacaaaagacattgttctatttatagcattcttttttttttttagtagcggtatttccatttacaaaatatagtaactcttgattactgaaaatgtcaaatcctagaaaacgtagcatgcctatacatgatgttaacatcattctcgaacagttgttggccgaagattcatttgatgaatccaatttttttgaaatagacaattctgatgttctctttagaaataactcagtttttatcttttttcacattgaaaatcagttagatttgcttaagcctcaaagagaatgtttatgtaaattagcgctggcaatttttttttttctaaacaggaaaagggttaaatgaaggttgataaaatggatgttcaattgtctttctgaaagtgagtggcttgaagggatgaataaatattttcttaatatattcaaaaaagtgcattgctttctgtgatggaagttaagacctaaatgtctggaagttgtaaccctcaacacagcttttcctgatttgctgcaaaggcacatagctgattatagaagtgaagacggcaaggacggggactccaacaaaggaaaccctgttgcaggatttgggaactttcatgcttcagatgaaattcaggcatgtgagcatcactgcagaatgtggtgcatcattgccatcatgagtaatcacttgctgctcctacttctgagaccaagactcttttgtcatattctttagcaataggacgggtaaagactggatttaattgctgttcagagtataaaaactcaattgattccaacatatctgaatgtgcagtaaagtcttaaaagtcaaccgttaatcattaagtcttttgcctctaaagtcttttgcctctgaagaggtttattacatgagttgattttcatattttcattttggtggggttttcctgttgttgggcaaggtggggtcacaggacatgggactagtaagcattttactgtttactatatttgtctttttataaacagtatctcccaaaatgtgattagaaggctaccaagcctgtatttggacatttaattgtgtgctttatataatgtaactactaacagtatttggactgcctgttcattcctggagacaaaaatgaaaatctgtcagttcaagttcttgggtaacatcaagtcattagaatttatctaaagcttatcatgatttgataagacatccattgcatgcagctgttttagctcagtgcaaaacactgaaattgtgattcttagactgtttctgagacatttggatggaaataaatgtataaatgtta

SEQ ID NO: 501824 - DNA, 245 bp, Homo sapiens
caggccaaggcagtgctgagcgccgagcagctgcgcgaacgaggaggtgcacgccggcctgggtagcctgctgcgctctactcagcaactccacggcgcgcaacgtgacctggaagctgggcagccgactgtacggacccagctcagtgagttcgctgatgacttcgtgcgcaggcacagccagccactaccaacttgcgagccactctcacagtatacactctttccggcgcacagagcacagc

SEQ ID NO: 501825 - DNA, 429 bp, Homo sapiens
tgatactgagcaggctgtgaaaccgggctgagtctgatcagtcgagcgtgtgttgagatcgtgcgcgctcagctacacaccgggcctacagcagagccgacgtcagactccacagtggtgtctctaactgctccacaacacaaaggcgatgggggctcagaaacagtgacattgtggggtgacacaagccaccacaatgggagcctcatggatgcggcagcggttgtactgttggggaccagtgagcacgtgctggggagggctcacctgtgcttcctcagtggctccacctctgcttctaagaaaactcactcattccatggcagtggcttatagagaagtcagtagacgggagcaagtgttcaacacagcaacaattctctttgtttctctagttcttagttctacacagtccagctccatcaacac

SEQ ID NO: 501826 - DNA, 5417 bp, Homo sapiens
cttgtgacaatattactgtattaaacattcctttttgttttgtcttgttttgtttagcctccacagctttccttgctgatagccagcctccaaaccgcagagccctagctgtttatcctgttttcctgttttactttgtcatcagttggatgattctcacctttactcctcagtaaatcaggaatgggaaattaaaaccagtgaattgaaagcacatctgaaagatgcaattcaccatggagctttgtctctggcccttattttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacttgggaagcacatagatacatcttacaagttgaatagagttgataactattttcagttttgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagattggtagatctctagtgcatattatcatgtgggcaccttctcttagggtggaatgaggcagtctggatgcagcatagttaaaaggagctgtttaatattctctgtagtctggcctcttaactagaaagtaaagctaaatcagaagcctgtatttaaccatgtgaacagggagggatttagtgttctgatggctgattaatagaacagctagatacttagagcatgacgtgggatgggatgagtttacagctgctgccttttcatggtgagcttagcagttttctcattagatgtgtttttttgggttggggaatagcaatttattttattgattttagactttatcaagctaattagctcccctttagataagtacatgttgcacatgtgcacctacttgtaatctcagatatttatgcacacaagtgtgaaggtttttcagggagcagagcatctgggacaggctgattctgagctaaacagggctcctttaaggcaatatgaactgttgccttctataaattgcacattgaggaactctaatagacaaagattaggtgtcaggcagaaaacactcattgtaaatatactattagttgataaacataggactttcttattccccagtttttctttatcatataatttaaatatttattcattttgtatttaaagactacctacacatagatatatgattccaaagtcatactttctccatccccacattagccaagtgaatacagggccaaatgggttcttggaatgataataacaaagcattacaaagtgggtccccttggttccagccttgtccagagtttttggttatatatttctatttattacaatttaccttttaaattgtaaaataaacctttgtgtggacagagccaatgtttcaatcttgaatgagtaaagaaaatactttggaactgatcctcattttgaaattggttctaaattattatccatttccaatgtctgaaattctcttacttcctgctaaaactctctttctgccaaagttgtttcgtaatctgtctcaatgactataatgtaaaattaaagaagtaaccatgcttctcaagggggaattaaaagtgtttattgaattttactcaggctaattgtttggtcagaaattcctaaggccacagctttggggggttcgtgtagatgtacatggtgggtgggttataaatattgggacttaaggcagcttgttctatgtatttatctttgctcttgggtgacttagggaatgattttatttgatttaaccttctttctgtttgccccgagaatactcgccagtggcgcttgcagttgtagcatttaccccaagataactttgcctacgaaatatttcgcttttattattttcacatcattctagtatatggactttggaaacaaaagacattgttctatttatagcattcttttttttttttagtagcggtatttccatttacaaaatatagtaactcttgattactgaaaatgtcaaatcctagaaaacgtagcatgcctatacatgatgttaacatcattctcgaacagttgttggccgaagattcatttgatgaatccaatttttttgaaatagacaattctgatgttctctttagaaataactcagtttttatcttttttcacattgaaaatcagttagatttgcttaagcctcaaagagaatgtttatgtaaattagcgctggcaatttttttttttctaaacaggaaaagggttaaatgaaggttgataaaatggatgttcaattgtctttctgaaagtgagtggcttgaagggatgaataaatattttcttaatatattcaaaaaagtgcattgctttctgtgatggaagttaagacctaaatgtctggaagttgtaaccctcaacacagcttttcctgatttgctgcaaaggcacatagctgattatagaagtgaagacggcaaggacggggactccaacaaaggaaaccctgttgcaggatttgggaactttcatgcttcagatgaaattcaggcatgtgagcatcactgcagaatgtggtgcatcattgccatcatgagtaatcacttgctgctcctacttctgagaccaagactcttttgtcatattctttagcaataggacgggtaaagactggatttaattgctgttcagagtataaaaactcaattgattccaacatatctgaatgtgcagtaaagtcttaaaagtcaaccgttaatcattaagtcttttgcctctaaagtcttttgcctctgaagaggtttattacatgagttgattttcatattttcattttggtggggttttcctgttgttgggcaaggtggggtcacaggacatgggactagtaagcattttactgtttactatatttgtctttttataaacagtatctcccaaaatgtgattagaaggctaccaagcctgtatttggacatttaattgtgtgctttatataatgtaactactaacagtatttggactgcctgttcattcctggagacaaaaatgaaaatctgtcagttcaagttcttgggtaacatcaagtcattagaatttatctaaagcttatcatgatttgataagacatccattgcatgcagctgttttagctcagtgcaaaacactgaaattgtgattcttagactgtttctgagacatttggatggaaataaatgtataaatgttaattcatgtatataaattagaaacacttttctagattctgtaggcttttgttaaaaatagagaatttcttggggtttacttaggccacagaatggccaaataataataatgacaatgatattactaataataatagctaacctttatttggcacttactgtgtgccaggcactattctatttttttaagaatttttaaaataacagctttattgaaatacactttaccataaacttcacctttttattttttatttttatgagacagggactcacccaggctggagtgcagtggagcagtcatggcacactgtagcctcgacctccctgggctcaagcaatcctcccacttcagtgtcccgagtagttgggactacaggcatgcgtcactacacctaattggctaatttttgtagtttttgtagagatagggtttcgccatgttgcctaggctggtcttgaattcctgggctcaagcgatccacctgctttggcctcccaaaacagtgggattgcaggcgtgagccaccatgcctggctgaaattcaccttttaagatgtacaattcagtggtttttagtatattcacacacaaaattgcacaactatcactaacatctaattttagatcattttgtaacttcaccaagaaaccccaggtctgtcagcagtcagttccattcccccttcatcccagcctctggcaaccactaatctgctttctgtcactattgatttggccagacactattcttctgtgcttctcatgcatctcctgtaataccagtgctacaattctcattttatgtggaaaattgaggcactgagaggttaagtaaattgcccacggtcacacagtaatttgatttacaacagtaataacacattagatgagaacacagtaggacacaattttgaattccatttttatgtacctgaaatgaatacacccctcccccaaggtattttccctattgttagcctttgtaccctaggtacaaatataggtattttccctattgtgttatgtacctgaaatgaatacacccttcccccaaggtattttccctattgttagcctttgtaccctagaactgactggatgtagataacatttgttttcagagtaatggaacactgtatcagcagcatctgagaacataagaacagttggacattggaaagaggtttgttgccctcatccctccttgaacctcttttctctcccgcttccaccaccaccacacatatatacccctttttctcagtcttaagcatcaaacaatttctgcctctttctttttaattctcccagagggatggttaatgcatcacaatttaacttgtctattcaggtattaatagtcaagggatgcatctgtttgcttatagtaccagttatattcctaggaccttagagagcagtagtgtgagaatagaatgcctttctatttgggttaaactatgtgggaggaaaaagtaacagagtaaaggctttgccttaatgaagtcaagtgttctgcctggtgggaagtggccacacgctgcactgcgctgctcttgtttactctgttctttcagagcctttgtactttgccatcactgctagtaatttcttggtccttttcaatactccattttaatcttgatttttttctataaataataaatctgtgaaaaatctgtaaaaa

SEQ ID NO: 501827 - DNA, 140 bp, Homo sapiens
tagatatgtggtacgtagacgtacgtggtctgagggaacacacttaatgtattgtagagtagtggtctgagggaacacacctaatgtattgtagagtagtggtctgtgggaacacacttaatgtattgtagagaagtggc

SEQ ID NO: 501828 - DNA, 120 bp, Homo sapiens
acatgagtgctccaccggctcctgattcttactcctcaggccaggactccaatttcagatttgtactatcccttgctggccacattggaactttattagtaagatgaccatattctggtg

SEQ ID NO: 501829 - DNA, 4536 bp, Homo sapiens
  misc_feature (263)..(263): n is a, c, g, or t
  misc_feature (301)..(301): n is a, c, g, or t
tttatcttttaagttattgtcacaatagttactctcttttagaccctgaacattttcagtacttgctccaaatggtttagcaacttttgaagtgggattaacaagtttggccaatgaagcttcttccctgcccaccgccagaggtgctggagaaaagtaatcctggagggtcggcgtggaggcagtagagaggtttataaaagtcaaggaagtgggaagaggcttgcgagcagcaggagaggcgcagagtcagaggggcaggngcggcggcggagggagcaggaggttggggcttgagccngtcattccggcgcacgaaaacttgaagtcgctcggtagccggggaagggaaggaagagaggcaggctctttcctagaggtgccgtgatcgagggtctggcactccaagccaactcctgagaacgggaaatgggcgggagtcggtggggtggagagggcagccgtggtcgcgagagcgaaggagcggtctgagaatccggcttgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctgtttgcaggcctttcagatatatccatctcacaagacatccccgtagaaggagaaatcaccattcctatgagatctcgcatccgggagtttgacagctccacattaaatgaatctgttcgcaataccatcatgcgtgatctaaaagctgttgggaaaaaattcatgcatgttttgtacccaaggaaaagtaatactcttttgagagattgggatttgtggggccctttgatcctttgtgtgacactcgcattaatgctgcaaagagactctgcagatagtgaaaaagatggagggccccaatttgcagaggtgtttgtcattgtctggtttggtgcagttaccatcaccctcaactcaaaacttcttggagggaacatatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttgcctccacagctttccttgctgatagccagcctccaaaccgcagagccctagctgtttatcctgttttcctgttttactttgtcatcagttggatgattctcacctttactcctcagtaaatcaggaatgggaaattaaaaccagtgaattgaaagcacatctgaaagatgcaattcaccatggagctttgtctctggcccttattttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacttgggaagcacatagatacatcttacaagttgaatagagttgataactattttcagttttgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagattggtagatctctagtgcatattatcatgtgggcaccttctcttagggtggaatgaggcagtctggatgcagcatagttaaaaggagctgtttaatattctctgtagtctggcctcttaactagaaagtaaagctaaatcagaagcctgtatttaaccatgtgaacagggagggatttagtgttctgatggctgattaatagaacagctagatacttagagcatgacgtgggatgggatgagtttacagctgctgccttttcatggtgagcttagcagttttctcattagatgtgtttttttgggttggggaatagcaatttattttattgattttagactttatcaagctaattagctcccctttagataagtacatgttgcacatgtgcacctacttgtaatctcagatatttatgcacacaagtgtgaaggtttttcagggagcagagcatctgggacaggctgattctgagctaaacagggctcctttaaggcaatatgaactgttgccttctataaattgcacattgaggaactctaatagacaaagattaggtgtcaggcagaaaacactcattgtaaatatactattagttgataaacataggactttcttattccccagtttttctttatcatataatttaaatatttattcattttgtatttaaagactacctacacatagatatatgattccaaagtcatactttctccatccccacattagccaagtgaatacagggccaaatgggttcttggaatgataataacaaagcattacaaagtgggtccccttggttccagccttgtccagagtttttggttatatatttctatttattacaatttaccttttaaattgtaaaataaacctttgtgtggacagagccaatgtttcaatcttgaatgagtaaagaaaatactttggaactgatcctcattttgaaattggttctaaattattatccatttccaatgtctgaaattctcttacttcctgctaaaactctctttctgccaaagttgtttcgtaatctgtctcaatgactataatgtaaaattaaagaagtaaccatgcttctcaagggggaattaaaagtgtttattgaattttactcaggctaattgtttggtcagaaattcctaaggccacagctttggggggttcgtgtagatgtacatggtgggtgggttataaatattgggacttaaggcagcttgttctatgtatttatctttgctcttgggtgacttagggaatgattttatttgatttaaccttctttctgtttgccccgagaatactcgccagtggcgcttgcagttgtagcatttaccccaagataactttgcctacgaaatatttcgcttttattattttcacatcattctagtatatggactttggaaacaaaagacattgttctatttatagcattcttttttttttttagtagcggtatttccatttacaaaatatagtaactcttgattactgaaaatgtcaaatcctagaaaacgtagcatgcctatacatgatgttaacatcattctcgaacagttgttggccgaagattcatttgatgaatccaatttttttgaaatagacaattctgatgttctctttagaaataactcagtttttatcttttttcacattgaaaatcagttagatttgcttaagcctcaaagagaatgtttatgtaaattagcgctggcaatttttttttttctaaacaggaaaagggttaaatgaaggttgataaaatggatgttcaattgtctttctgaaagtgagtggcttgaagggatgaataaatattttcttaatatattcaaaaaagtgcattgctttctgtgatggaagttaagacctaaatgtctggaagttgtaaccctcaacacagcttttcctgatttgctgcaaaggcacatagctgattatagaagtgaagacggcaaggacggggactccaacaaaggaaaccctgttgcaggatttgggaactttcatgcttcagatgaaattcaggcatgtgagcatcactgcagaatgtggtgcatcattgccatcatgagtaatcacttgctgctcctacttctgagaccaagactcttttgtcatattctttagcaataggacgggtaaagactggatttaattgctgttcagagtataaaaactcaattgattccaacatatctgaatgtgcagtaaagtcttaaaagtcaaccgtta

SEQ ID NO: 501830 - DNA, 4135 bp, Homo sapiens
  misc_feature (263)..(263): n is a, c, g, or t
  misc_feature (301)..(301): n is a, c, g, or t
tttatcttttaagttattgtcacaatagttactctcttttagaccctgaacattttcagtacttgctccaaatggtttagcaacttttgaagtgggattaacaagtttggccaatgaagcttcttccctgcccaccgccagaggtgctggagaaaagtaatcctggagggtcggcgtggaggcagtagagaggtttataaaagtcaaggaagtgggaagaggcttgcgagcagcaggagaggcgcagagtcagaggggcaggngcggcggcggagggagcaggaggttggggcttgagccngtcattccggcgcacgaaaacttgaagtcgctcggtagccggggaagggaaggaagagaggcaggctctttcctagaggtgccgtgatcgagggtctggcactccaagccaactcctgagaacgggaaatgggcgggagtcggtggggtggagagggcagccgtggtcgcgagagcgaaggagcggtctgagaatccggcttgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctgtttgcaggcctttcagatatatccatctcacaagacatccccgtagaaggagaaatcaccattcctatgagatctcgcatccgggagtttgacagctccacattaaatgaatctgttcgcaataccatcatgcgtgatctaaaagctgttgggaaaaaattcatgcatgttttgtacccaaggaaaagtaatactcttttgagagattgggatttgtggggccctttgatcctttgtgtgacactcgcattaatgctgcaaagagactctgcagatagtgaaaaagatggagggccccaatttgcagaggtgtttgtcattgtctggtttggtgcagttaccatcaccctcaactcaaaacttcttggagggaacatatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttgcctccacagctttccttgctgatagccagcctccaaaccgcagagccctagctgtttatcctgttttcctgttttactttgtcatcagttggatgattctcacctttactcctcagtaaatcaggaatgggaaattaaaaccagtgaattgaaagcacatctgaaagatgcaattcaccatggagctttgtctctggcccttattttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacttgggaagcacatagatacatcttacaagttgaatagagttgataactattttcagttttgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagattggtagatctctagtgcatattatcatgtgggcaccttctcttagggtggaatgaggcagtctggatgcagcatagttaaaaggagctgtttaatattctctgtagtctggcctcttaactagaaagtaaagctaaatcagaagcctgtatttaaccatgtgaacagggagggatttagtgttctgatggctgattaatagaacagctagatacttagagcatgacgtgggatgggatgagtttacagctgctgccttttcatggtgagcttagcagttttctcattagatgtgtttttttgggttggggaatagcaatttattttattgattttagactttatcaagctaattagctcccctttagataagtacatgttgcacatgtgcacctacttgtaatctcagatatttatgcacacaagtgtgaaggtttttcagggagcagagcatctgggacaggctgattctgagctaaacagggctcctttaaggcaatatgaactgttgccttctataaattgcacattgaggaactctaatagacaaagattaggtgtcaggcagaaaacactcattgtaaatatactattagttgataaacataggactttcttattccccagtttttctttatcatataatttaaatatttattcattttgtatttaaagactacctacacatagatatatgattccaaagtcatactttctccatccccacattagccaagtgaatacagggccaaatgggttcttggaatgataataacaaagcattacaaagtgggtccccttggttccagccttgtccagagtttttggttatatatttctatttattacaatttaccttttaaattgtaaaataaacctttgtgtggacagagccaatgtttcaatcttgaatgagtaaagaaaatactttggaactgatcctcattttgaaattggttctaaattattatccatttccaatgtctgaaattctcttacttcctgctaaaactctctttctgccaaagttgtttcgtaatctgtctcaatgactataatgtaaaattaaagaagtaaccatgcttctcaagggggaattaaaagtgtttattgaattttactcaggctaattgtttggtcagaaattcctaaggccacagctttggggggttcgtgtagatgtacatggtgggtgggttataaatattgggacttaaggcagcttgttctatgtatttatctttgctcttgggtgacttagggaatgattttatttgatttaaccttctttctgtttgccccgagaatactcgccagtggcgcttgcagttgtagcatttaccccaagataactttgcctacgaaatatttcgcttttattattttcacatcattctagtatatggactttggaaacaaaagacattgttctatttatagcattcttttttttttttagtagcggtatttccatttacaaaatatagtaactcttgattactgaaaatgtcaaatcctagaaaacgtagcatgcctatacatgatgttaacatcattctcgaacagttgttggccgaagattcatttgatgaatccaatttttttgaaatagacaattctgatgttctctttagaaataactcagtttttatcttttttcacattgaaaatcagttagatttgcttaagcctcaaagagaatgtttatgtaaattagcgctggcaatttttttttttctaaacaggaaaagggttaaatgaaggttgataaaatggatgttcaattgtctttctgaaagtgagtggcttgaagggatgaataaatattttcttaatatattca

SEQ ID NO: 501831 - DNA, 4735 bp, Homo sapiens
  misc_feature (263)..(263): n is a, c, g, or t
  misc_feature (301)..(301): n is a, c, g, or t
  misc_feature (4571)..(4571): n is a, c, g, or t
  misc_feature (4583)..(4583): n is a, c, g, or t
  misc_feature (4587)..(4587): n is a, c, g, or t
  misc_feature (4590)..(4590): n is a, c, g, or t
  misc_feature (4594)..(4594): n is a, c, g, or t
  misc_feature (4602)..(4602): n is a, c, g, or t
  misc_feature (4605)..(4605): n is a, c, g, or t
  misc_feature (4609)..(4609): n is a, c, g, or t
  misc_feature (4612)..(4612): n is a, c, g, or t
  misc_feature (4615)..(4616): n is a, c, g, or t
  misc_feature (4619)..(4619): n is a, c, g, or t
  misc_feature (4624)..(4624): n is a, c, g, or t
  misc_feature (4633)..(4633): n is a, c, g, or t
tttatcttttaagttattgtcacaatagttactctcttttagaccctgaacattttcagtacttgctccaaatggtttagcaacttttgaagtgggattaacaagtttggccaatgaagcttcttccctgcccaccgccagaggtgctggagaaaagtaatcctggagggtcggcgtggaggcagtagagaggtttataaaagtcaaggaagtgggaagaggcttgcgagcagcaggagaggcgcagagtcagaggggcaggngcggcggcggagggagcaggaggttggggcttgagccngtcattccggcgcacgaaaacttgaagtcgctcggtagccggggaagggaaggaagagaggcaggctctttcctagaggtgccgtgatcgagggtctggcactccaagccaactcctgagaacgggaaatgggcgggagtcggtggggtggagagggcagccgtggtcgcgagagcgaaggagcggtctgagaatccggcttgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctgtttgcaggcctttcagatatatccatctcacaagacatccccgtagaaggagaaatcaccattcctatgagatctcgcatccgggagtttgacagctccacattaaatgaatctgttcgcaataccatcatgcgtgatctaaaagctgttgggaaaaaattcatgcatgttttgtacccaaggaaaagtaatactcttttgagagattgggatttgtggggccctttgatcctttgtgtgacactcgcattaatgctgcaaagagactctgcagatagtgaaaaagatggagggccccaatttgcagaggtgtttgtcattgtctggtttggtgcagttaccatcaccctcaactcaaaacttcttggagggaacatatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttgcctccacagctttccttgctgatagccagcctccaaaccgcagagccctagctgtttatcctgttttcctgttttactttgtcatcagttggatgattctcacctttactcctcagtaaatcaggaatgggaaattaaaaccagtgaattgaaagcacatctgaaagatgcaattcaccatggagctttgtctctggcccttattttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacttgggaagcacatagatacatcttacaagttgaatagagttgataactattttcagttttgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagattggtagatctctagtgcatattatcatgtgggcaccttctcttagggtggaatgaggcagtctggatgcagcatagttaaaaggagctgtttaatattctctgtagtctggcctcttaactagaaagtaaagctaaatcagaagcctgtatttaaccatgtgaacagggagggatttagtgttctgatggctgattaatagaacagctagatacttagagcatgacgtgggatgggatgagtttacagctgctgccttttcatggtgagcttagcagttttctcattagatgtgtttttttgggttggggaatagcaatttattttattgattttagactttatcaagctaattagctcccctttagataagtacatgttgcacatgtgcacctacttgtaatctcagatatttatgcacacaagtgtgaaggtttttcagggagcagagcatctgggacaggctgattctgagctaaacagggctcctttaaggcaatatgaactgttgccttctataaattgcacattgaggaactctaatagacaaagattaggtgtcaggcagaaaacactcattgtaaatatactattagttgataaacataggactttcttattccccagtttttctttatcatataatttaaatatttattcattttgtatttaaagactacctacacatagatatatgattccaaagtcatactttctccatccccacattagccaagtgaatacagggccaaatgggttcttggaatgataataacaaagcattacaaagtgggtccccttggttccagccttgtccagagtttttggttatatatttctatttattacaatttaccttttaaattgtaaaataaacctttgtgtggacagagccaatgtttcaatcttgaatgagtaaagaaaatactttggaactgatcctcattttgaaattggttctaaattattatccatttccaatgtctgaaattctcttacttcctgctaaaactctctttctgccaaagttgtttcgtaatctgtctcaatgactataatgtaaaattaaagaagtaaccatgcttctcaagggggaattaaaagtgtttattgaattttactcaggctaattgtttggtcagaaattcctaaggccacagctttggggggttcgtgtagatgtacatggtgggtgggttataaatattgggacttaaggcagcttgttctatgtatttatctttgctcttgggtgacttagggaatgattttatttgatttaaccttctttctgtttgccccgagaatactcgccagtggcgcttgcagttgtagcatttaccccaagataactttgcctacgaaatatttcgcttttattattttcacatcattctagtatatggactttggaaacaaaagacattgttctatttatagcattcttttttttttttagtagcggtatttccatttacaaaatatagtaactcttgattactgaaaatgtcaaatcctagaaaacgtagcatgcctatacatgatgttaacatcattctcgaacagttgttggccgaagattcatttgatgaatccaatttttttgaaatagacaattctgatgttctctttagaaataactcagtttttatcttttttcacattgaaaatcagttagatttgcttaagcctcaaagagaatgtttatgtaaattagcgctggcaatttttttttttctaaacaggaaaagggttaaatgaaggttgataaaatggatgttcaattgtctttctgaaagtgagtggcttgaagggatgaataaatattttcttaatatattcaaaaaagtgcattgctttctgtgatggaagttaagacctaaatgtctggaagttgtaaccctcaacacagcttttcctgatttgctgcaaaggcacatagctgattatagaagtgaagacggcaaggacggggactccaacaaaggaaaccctgttgcaggatttgggaactttcatgcttcagatgaaattcaggcatgtgagcatcactgcagaatgtggtgcatcattgccatcatgagtaatcacttgctgctcctacttctgagaccaagactcttttgtcatattctttagcaataggacgggtaaagactggatttaattgctgttcagagtataaaaactcaattgattccaacatatctgaatgtgcagtaaagtcttaaaagtcaaccgttataaaaaaaaaaaaaaaaaaaaaaaaaaaaaatttnttgggccccctnggcnccntggnaaaaactnttnttanacnccnntcngttgngggcgccgngggccccaatatgtggttagggtaaccgtgggccaaaaagcgtgtccctagaggaaaacccggggccaaggcaaaaggcgcgtgggatttttccccaattaa

SEQ ID NO: 501832 - DNA, 1604 bp, Homo sapiens
aaggctaggtagaggccgggtggtttaatcggccgtaggcccagctggcccgtgctgcgctgtgctcttcctgccctggcgccctgctgcattcctgccattcccccgatgtctggccctgctgggctactggcctgcctgctggagctgcagtgaaccttcacctccctgatggacatggctgccttcccctacgggaccctgtgctcccctgcttgcctgctgcctgctcatgtccccgctgcatgcttgcccaatgcctccatgcatgggtgccacctgatggactccatgtgatgcaccccatgtgccctgttcttcttgtgcccacatgctgccccatcctgtgacccctcatgctgaccctccttgtcctgccctcctgtgcgtgctgctggcctgtcttggatgactcttgcacctgtctgctgtgcctccgctatgacctactgcaatggcccctgctgccggtggttgtgtgtgactgtgtgtgatgtgtgttgtgctgtttcccttgatggtctctgctgtgatgtgaaatgtgtgtctgcatgctttgcaagtccgctgccatggccactcgagtgcacataccatcctgcatcctgcctggcgaacgctgtgcatacacaaaaactactgggacggcggcacgaacggggaatgacacagaaccccaggattccagggaaaccaacgggcattttagggtcccaccttgtgcaaaagcgtcggtaacccagtccaattggttcacccgcattcaagcgtataaattcacattcacacacatggaacccattggtagtgtgaggctggataggttcagatccaatattatatatgggtggcatacgtgcaaggacttcgagtggtgaaagcaccccctggcactggtgcccttacagcgcgacacgcgcagggcacgtggacagaaggccagggataagagcataaacactgtgagcccgaaagccccggcaatgcccgggtgaacattcgagcagtattatcgggagccaaaagacgtggaagaacggccacaccaaaggaagaccgccgacacagcacggcactacaagacggcggagacaccatctaaacgcaccgggggctcggtcagcaacagcgcatcaaatgagaatgagcccacaaaaacgtggacacccgtttcagaagaccttcggcacagaatccgagacagggatcctttgtggccccaagttcaacgaaggctccacaactctccacccacttttgctcaacacggctcagtgacaacacaggcggtaacacccccagtgcacatgcacggccccagcaggagacagaccacgaaagggtcgtggacactacttccaacaactagtgtgaccatgtgtgcccaacagccaagcagcaagcttaaaccacgccgcggacaaagtagttctgcgccctaacagggagggacccgagggagcgcaccctcccccaagacggggtggacgagcacacagagaaaagaggtaatacctccacagcagaggaagaacacacgcactaaagccgtggaaggcgataacacccacagctgagtgagaacccaacagacagaagcgcat

SEQ ID NO: 501833 - DNA, 4928 bp, Homo sapiens
actacaacaactaaattcacgggccgtggggacaggttatacctaattccagttttgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagattggtagatctctagtgcatattatcatgtgggcaccttctcttagggtggaatgaggcagtctggatgcagcatagttaaaaggagctgtttaatattctctgtagtctggcctcttaactagaaagtaaagctaaatcagaagcctgtatttaaccatgtgaacagggagggatttagtgttctgatggctgattaatagaacagctagatacttagagcatgacgtgggatgggatgagtttacagctgctgccttttcatggtgagcttagcagttttctcattagatgtgtttttttgggttggggaatagcaatttattttattgattttagactttatcaagctaattagctcccctttagataagtacatgttgcacatgtgcacctacttgtaatctcagatatttatgcacacaagtgtgaaggtttttcagggagcagagcatctgggacaggctgattctgagctaaacagggctcctttaaggcaatatgaactgttgccttctataaattgcacattgaggaactctaatagacaaagattaggtgtcaggcagaaaacactcattgtaaatatactattagttgataaacataggactttcttattccccagtttttctttatcatataatttaaatatttattcattttgtatttaaagactacctacacatagatatatgattccaaagtcatactttctccatccccacattagccaagtgaatacagggccaaatgggttcttggaatgataataacaaagcattacaaagtgggtccccttggttccagccttgtccagagtttttggttatatatttctatttattacaatttaccttttaaattgtaaaataaacctttgtgtggacagagccaatgtttcaatcttgaatgagtaaagaaaatactttggaactgatcctcattttgaaattggttctaaattattatccatttccaatgtctgaaattctcttacttcctgctaaaactctctttctgccaaagttgtttcgtaatctgtctcaatgactataatgtaaaattaaagaagtaaccatgcttctcaagggggaattaaaagtgtttattgaattttactcaggctaattgtttggtcagaaattcctaaggccacagctttggggggttcgtgtagatgtacatggtgggtgggttataaatattgggacttaaggcagcttgttctatgtatttatctttgctcttgggtgacttagggaatgattttatttgatttaaccttctttctgtttgccccgagaatactcgccagtggcgcttgcagttgtagcatttaccccaagataactttgcctacgaaatatttcgcttttattattttcacatcattctagtatatggactttggaaacaaaagacattgttctatttatagcattcttttttttttttagtagcggtatttccatttacaaaatatagtaactcttgattactgaaaatgtcaaatcctagaaaacgtagcatgcctatacatgatgttaacatcattctcgaacagttgttggccgaagattcatttgatgaatccaatttttttgaaatagacaattctgatgttctctttagaaataactcagtttttatcttttttcacattgaaaatcagttagatttgcttaagcctcaaagagaatgtttatgtaaattagcgctggcaatttttttttttctaaacaggaaaagggttaaatgaaggttgataaaatggatgttcaattgtctttctgaaagtgagtggcttgaagggatgaataaatattttcttaatatattcaaaaaagtgcattgctttctgtgatggaagttaagacctaaatgtctggaagttgtaaccctcaacacagcttttcctgatttgctgcaaaggcacatagctgattatagaagtgaagacggcaaggacggggactccaacaaaggaaaccctgttgcaggatttgggaactttcatgcttcagatgaaattcaggcatgtgagcatcactgcagaatgtggtgcatcattgccatcatgagtaatcacttgctgctcctacttctgagaccaagactcttttgtcatattctttagcaataggacgggtaaagactggatttaattgctgttcagagtataaaaactcaattgattccaacatatctgaatgtgcagtaaagtcttaaaagtcaaccgttaatcattaagtcttttgcctctaaagtcttttgcctctgaagaggtttattacatgagttgattttcatattttcattttggtggggttttcctgttgttgggcaaggtggggtcacaggacatgggactagtaagcattttactgtttactatatttgtctttttataaacagtatctcccaaaatgtgattagaaggctaccaagcctgtatttggacatttaattgtgtgctttatataatgtaactactaacagtatttggactgcctgttcattcctggagacaaaaatgaaaatctgtcagttcaagttcttgggtaacatcaagtcattagaatttatctaaagcttatcatgatttgataagacatccattgcatgcagctgttttagctcagtgcaaaacactgaaattgtgattcttagactgtttctgagacatttggatggaaataaatgtataaatgttaattcatgtatataaattagaaacacttttctagattctgtaggcttttgttaaaaatagagaatttcttggggtttacttaggccacagaatggccaaataataataatgacaatgatattactaataataatagctaacctttatttggcacttactgtgtgccaggcactattctatttttttaagaatttttaaaataacagctttattgaaatacactttaccataaacttcacctttttattttttatttttatgagacagggactcacccaggctggagtgcagtggagcagtcatggcacactgtagcctcgacctccctgggctcaagcaatcctcccacttcagtgtcccgagtagttgggactacaggcatgcgtcactacacctaattggctaatttttgtagtttttgtagagatagggtttcgccatgttgcctaggctggtcttgaattcctgggctcaagcgatccacctgctttggcctcccaaaacagtgggattgcaggcgtgagccaccatgcctggctgaaattcaccttttaagatgtacaattcagtggtttttagtatattcacacacaaaattgcacaactatcactaacatctaattttagatcattttgtaacttcaccaagaaaccccaggtctgtcagcagtcagttccattcccccttcatcccagcctctggcaaccactaatctgctttctgtcactattgatttggccagacactattcttctgtgcttctcatgcatctcctgtaataccagtgctacaattctcattttatgtggaaaattgaggcactgagaggttaagtaaattgcccacggtcacacagtaatttgatttacaacagtaataacacattagatgagaacacagtaggacacaattttgaattccatttttatgtacctgaaatgaatacacccctcccccaaggtattttccctattgttagcctttgtaccctaggtacaaatataggtattttccctattgtgttatgtacctgaaatgaatacacccttcccccaaggtattttccctattgttagcctttgtaccctagaactgactggatgtagataacatttgttttcagagtaatggaacactgtatcagcagcatctgagaacataagaacagttggacattggaaagaggtttgttgccctcatccctccttgaacctcttttctctcccgcttccaccaccaccacacatatatacccctttttctcagtcttaagcatcaaacaatttctgcctctttctttttaattctcccagagggatggttaatgcatcacaatttaacttgtctattcaggtattaatagtcaagggatgcatctgtttgcttatagtaccagttatattcctaggaccttagagagcagtagtgtgagaatagaatgcctttctatttgggttaaactatgtgggaggaaaaagtaacagagtaaaggctttgccttaatgaagtcaagtgttctgcctggtgggaagtggccacacgctgcactgcgctgctcttgtttactctgttctttcagagcctttgtactttgccatcactgctagtaatttcttggtccttttcaatactccattttaatcttgatttttttctataaataataaatctgtgaaaaatctgtaaaaa

SEQ ID NO: 501834 - DNA, 3749 bp, Homo sapiens
  misc_feature (263)..(263): n is a, c, g, or t
  misc_feature (301)..(301): n is a, c, g, or t
  misc_feature (3452)..(3452): n is a, c, g, or t
  misc_feature (3456)..(3456): n is a, c, g, or t
  misc_feature (3467)..(3467): n is a, c, g, or t
tttatcttttaagttattgtcacaatagttactctcttttagaccctgaacattttcagtacttgctccaaatggtttagcaacttttgaagtgggattaacaagtttggccaatgaagcttcttccctgcccaccgccagaggtgctggagaaaagtaatcctggagggtcggcgtggaggcagtagagaggtttataaaagtcaaggaagtgggaagaggcttgcgagcagcaggagaggcgcagagtcagaggggcaggngcggcggcggagggagcaggaggttggggcttgagccngtcattccggcgcacgaaaacttgaagtcgctcggtagccggggaagggaaggaagagaggcaggctctttcctagaggtgccgtgatcgagggtctggcactccaagccaactcctgagaacgggaaatgggcgggagtcggtggggtggagagggcagccgtggtcgcgagagcgaaggagcggtctgagaatccggcttgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctgtttgcaggcctttcagatatatccatctcacaagacatccccgtagaaggagaaatcaccattcctatgagatctcgcatccgggagtttgacagctccacattaaatgaatctgttcgcaataccatcatgcgtgatctaaaagctgttgggaaaaaattcatgcatgttttgtacccaaggaaaagtaatactcttttgagagattgggatttgtggggccctttgatcctttgtgtgacactcgcattaatgctgcaaagagactctgcagatagtgaaaaagatggagggccccaatttgcagaggtgtttgtcattgtctggtttggtgcagttaccatcaccctcaactcaaaacttcttggagggaacatatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttgcctccacagctttccttgctgatagccagcctccaaaccgcagagccctagctgtttatcctgttttcctgttttactttgtcatcagttggatgattctcacctttactcctcagtaaatcaggaatgggaaattaaaaccagtgaattgaaagcacatctgaaagatgcaattcaccatggagctttgtctctggcccttattttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacttgggaagcacatagatacatcttacaagttgaatagagttgataactattttcagttttgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagattggtagatctctagtgcatattatcatgtgggcaccttctcttagggtggaatgaggcagtctggatgcagcatagttaaaaggagctgtttaatattctctgtagtctggcctcttaactagaaagtaaagctaaatcagaagcctgtatttaaccatgtgaacagggagggatttagtgttctgatggctgattaatagaacagctagatacttagagcatgacgtgggatgggatgagtttacagctgctgccttttcatggtgagcttagcagttttctcattagatgtgtttttttgggttggggaatagcaatttattttattgattttagactttatcaagctaattagctcccctttagataagtacatgttgcacatgtgcacctacttgtaatctcagatatttatgcacacaagtgtgaaggtttttcagggagcagagcatctgggacaggctgattctgagctaaacagggctcctttaaggcaatatgaactgttgccttctataaattgcacattgaggaactctaatagacaaagattaggtgtcaggcagaaaacactcattgtaaatatactattagttgataaacataggactttcttattccccagtttttctttatcatataatttaaatatttattcattttgtatttaaagactacctacacatagatatatgattccaaagtcatactttctccatccccacattagccaagtgaatacagggccaaatgggttcttggaatgataataacaaagcattacaaagtgggtccccttggttccagccttgtccagagtttttggttatatatttctatttattacaatttaccttttaaattgtaaaataaacctttgtgtggacagagccaatgtttcaatcttgaatgagtaaagaaaatactttggaactgatcctcattttgaaattggttctaaattattatccatttccaatgtctgaaattctcttacttcctgctaaaactctctttctgccaaagttgtttcgtaatctgtctcaatgactataatgtaaaattaaagaagtaaccatgcttctcaataaaaaaaaaaaaaaaaaaaaaaaaaaaaaaaaaaaaaaaaaaaaaaacaaaaaaaaaaaaagaaaaaanaaanaacaaaaaaanaaaagaaagagagagggggcgcggcgcggaaaccaagaagaatccccgctctgaccgggcgagcgagcagcgcaccgacacgcccccctcggcttattttgactaaaggggggccccccagagggagagcggcagataaagaagcgaggggggggcggggggacgttaacacaaggatgtcggaggggagaacaacacgacgtgggcgggagaagaatgtgagagggcgagcgccacaactcgaggggggaggagagaacaaaaggcggcaagcgaacaacg

SEQ ID NO: 501835 - DNA, 1991 bp, Homo sapiens
  misc_feature (263)..(263): n is a, c, g, or t
  misc_feature (301)..(301): n is a, c, g, or t
  misc_feature (1911)..(1911): n is a, c, g, or t
  misc_feature (1918)..(1918): n is a, c, g, or t
  misc_feature (1923)..(1923): n is a, c, g, or t
  misc_feature (1925)..(1925): n is a, c, g, or t
tttatcttttaagttattgtcacaatagttactctcttttagaccctgaacattttcagtacttgctccaaatggtttagcaacttttgaagtgggattaacaagtttggccaatgaagcttcttccctgcccaccgccagaggtgctggagaaaagtaatcctggagggtcggcgtggaggcagtagagaggtttataaaagtcaaggaagtgggaagaggcttgcgagcagcaggagaggcgcagagtcagaggggcaggngcggcggcggagggagcaggaggttggggcttgagccngtcattccggcgcacgaaaacttgaagtcgctcggtagccggggaagggaaggaagagaggcaggctctttcctagaggtgccgtgatcgagggtctggcactccaagccaactcctgagaacgggaaatgggcgggagtcggtggggtggagagggcagccgtggtcgcgagagcgaaggagcggtctgagaatccggcttgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctgtttgcaggcctttcagatatatccatctcacaagacatccccgtagaaggagaaatcaccattcctatgagatctcgcatccgggagtttgacagctccacattaaatgaatctgttcgcaataccatcatgcgtgatctaaaagctgttgggaaaaaattcatgcatgttttgtacccaaggaaaagtaatactcttttgagagattgggatttgtggggccctttgatcctttgtgtgacactcgcattaatgctgcaaagagactctgcagatagtgaaaaagatggagggccccaatttgcagaggtgtttgtcattgtctggtttggtgcagttaccatcaccctcaactcaaaacttcttggagggaacatatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttgcctccacagctttccttgctgatagccagcctccaaaccgcagagccctagctgtttatcctgttttcctgttttactttgtcatcagttggatgattctcacctttactcctcagtaaatcaggaatgggaaattaaaaccagtgaattgaaagcacatctgaaagatgcaattcaccatggagctttgtctctggcccttattttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacttgggaagcacatagatacatcttacaagttgaatagagttgataactattttcagttttgagaataccagttcaggtgcagctcttaaacacattgccttatgactattagaatatgcctctcttttcataaataaaaatactgncttatcncttcntnattctccttaagtaaaagcaggagggtggggggtcctcccggatggggaactgcttcccatcgatt

SEQ ID NO: 501836 - DNA, 417 bp, Homo sapiens
  misc_feature (16)..(16): n is a, c, g, or t
  misc_feature (21)..(21): n is a, c, g, or t
  misc_feature (51)..(51): n is a, c, g, or t
  misc_feature (149)..(149): n is a, c, g, or t
  misc_feature (412)..(412): n is a, c, g, or t
tttaatattttataangttantaaaaagtatttttgggaccttcatatatncagaaaaatataaacaaatttgaaactttggatgtcagaaaagtataataaatcctgtagcccacttacagaaacttatataaaaaataatgatttantcttttgttaaaaattatttagtactggctggcatgatagctcatgcctgtagtcccagagctttaggaggctgaggcattaggatcacttgaagccaggaattcaagaccagcctgggcaacatagtgagaccctgtctctacaaaaaaaattaataaattagccagacatggtggtacacacctgtagacccagctacttgagaggctaaggtgggaggatcacttgagcctaggagttcaaggttacacacacgcacacntacaa

SEQ ID NO: 501837 - DNA, 291 bp, Homo sapiens
catgcttcatggatagaggggcagctatgctgccttcccagcccctctgcatactagcttctgtaatgggttgaattgtgtttgaccaaaactcatgtgtttaagtcctaactctcagtacctcagaatctaaacgttttttggaaataagggctttataactaagttaaaatgaggcctttagggtgggccctaatccaatatgagtgctgttcttttaagaaattcagcaggccaggtgtggtggctcatgcctgtaatcccagcactttagcaggccaaggcaggtga

SEQ ID NO: 501838 - DNA, 974 bp, Homo sapiens
ggaggcccgggcggcaggagccggcgctggtgaccgcggcgagggcggcggggacggagcagagcacgactgaagacgcacaggcagccgggccgggccgggccacggtgggagagcggccgtgcggcgcagcgaggcgggagtgccgggcgggccgctgggcagccaccgagccgctgaagcgacatggtgctgctcaaggagtatcgagtaatcctgcctgtgtctgtagatgagtatcaagtggggcagctgtattctgtggttgaggccagtaaaaatgaaacgggtggtggcgaaggcgtggaggtccgtggtgaatgagtgcctactgatagtggacggttgagagaggccagtaagaacacgagatctactcatctgcagtagactgaagtacccgacggttgtttcgaaatgactggcccccagagggagccctgacatatacgacgagaaggccctggaatgccttactcccgtactgtgggagcgcgatctttacaaatgagtactgttgaacgcaacgactgtgctgactttagcctggagagctggcactagatgccaggatcttggacaggcatgcgagaatgtgcactaagtctggagccgtgagcgcgtggaacacgcgttgtacgcgcagactatataagattgttgccgattcgaaagccaaggtgcttcgagcacattgactgaggaaggcaggagagaagacgccagcagtactttatcatcttatcacaagccgtgcctgggacccctttggtgtccccaattttggaaaaccaggatcttgatcagcatagaagggactggcagatatgttgtgttgggtacaaagtggtgaaccgtcacgttcaagtttgtggggcctgaagaacattgtggtccgttcagtcgtacgcaagaaaggggctgttaacaggacttccgaggcggatgtttgtgggtcaaaagtgggtgactac

SEQ ID NO: 501839 - DNA, 1519 bp, Homo sapiens
  misc_feature (263)..(263): n is a, c, g, or t
  misc_feature (301)..(301): n is a, c, g, or t
tttatcttttaagttattgtcacaatagttactctcttttagaccctgaacattttcagtacttgctccaaatggtttagcaacttttgaagtgggattaacaagtttggccaatgaagcttcttccctgcccaccgccagaggtgctggagaaaagtaatcctggagggtcggcgtggaggcagtagagaggtttataaaagtcaaggaagtgggaagaggcttgcgagcagcaggagaggcgcagagtcagaggggcaggngcggcggcggagggagcaggaggttggggcttgagccngtcattccggcgcacgaaaacttgaagtcgctcggtagccggggaagggaaggaagagaggcaggctctttcctagaggtgccgtgatcgagggtctggcactccaagccaactcctgagaacgggaaatgggcgggagtcggtggggtggagagggcagccgtggtcgcgagagcgaaggagcggtctgagaatccggcttgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctgtttgcaggcctttcagatatatccatctcacaagacatccccgtagaaggagaaatcaccattcctatgagatctcgcatccgggagtttgacagctccacattaaatgaatctgttcgcaataccatcatgcgtgatctaaaagctgttgggaaaaaattcatgcatgttttgtacccaaggaaaagtaatactcttttgagagattgggatttgtggggccctttgatcctttgtgtgacactcgcattaatgctgcaaagagactctgcagatagtgaaaaagatggagggccccaatttgcagaggtgtttgtcattgtctggtttggtgcagttaccatcaccctcaactcaaaacttcttggagggaacatatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttggtcctcaggttgagaggaactgtactccagaagctatacttaaagaactacatctgaggagcattatgtgcacctggagctggacctgatctcagtgatgaggaatctagaagttcaaactgatagggtaatgggatgagacttttaggggccttgggaggagtgagtgtactaggcatatg

SEQ ID NO: 501840 - DNA, 198 bp, Homo sapiens
  misc_feature (124)..(124): n is a, c, g, or t
tcagtactgcatgaagagacttcattaaaactaagaaacatttattcggggagaaattttaggcatttaagcaactgtcatttttctcattttcaaacaagttcaaattcattcccgtcaattnggcaagcacagtttcgttgcaatgtcaggaccatcaaccgtttgcaagggttttccatttgcaaaacattgcat

SEQ ID NO: 501841 - DNA, 970 bp, Homo sapiens
actccaccttactaccatcacaagcttagccaaaccatttacccaacataaagtataggcgatagaaattgaaacctggcgcaactagatatagtaccgcacagggcaagagatgaaaaattatagccaagcataatatagcaaggactaacccctataccttctgcataatgaattaactagaaataactttgcaaggagagccaaagctaaggagcccctgaaaccagacgagctatcctacagaacagtcgtaaaagagcacacccgtctatgtagcagaaataagtgggaagatttataggtagaggcgacaaacctaccgagcctggtgatagctggttgtccagagatagaatcttagttcaactgtaaattggcccacagaaccctctaaatccccttgtaaatataactgttagtccaaagaggaacagctcttaggacactaggaaaaaaaccttgtagagagagtaaaacaatttagactacccatagtaggcctagaaagcagacaccaaagttaagaaagcgttcaagctcaacaccactactaaaatatcccaaagatataacctgaactcctcaagccaatggggccaatctatcaccctatagaagaactaatgttaggataagttgcatgaaacttctcctcgataagcgtgggtcagattaaagcctgaactgggcagttagcaggaccatatgtacaaatccaccaaagtcatattacccccatgtacccaaacacgctgtgcctagaagcgatcaccagctaaggaagccggaaattcccccggttcaccacatacctctgttacagataaagacggcgccgaaaatttagcggggccacagcgaagaaaaaagctctaagagcgagaaaagccgacagaatcaaaaaagagccagggcacaaacaacatatcataaacctcacacaagaaggacagaaatgtacatcaac

SEQ ID NO: 501842 - DNA, 177 bp, Homo sapiens
  misc_feature (32)..(32): n is a, c, g, or t
tttttttttttggggggggggggggccccccnccccccccttttgtgcgggggtttttaaattttttgggttccccccggggttcccttgggggtccgttttttccttttccccccccccccccgggggggtgggggggtttgtttttttttttttgattaaacctttttttcccca

SEQ ID NO: 501843 - DNA, 326 bp, Homo sapiens
  misc_feature (221)..(221): n is a, c, g, or t
gggggggggggggggggggggggggggggggggggggtggggggggggggggggggggtgggggggggaggggaggggcgggggggggggggggggggggtggggcggggggggggggggtggggcagtgtaggggggggggggggggcggggcgggagggcggcgggggggggggggtccggcgggaggggggggtcgcggggtagggggagggaaaagnaggagggggggtgggggagcgaaaaccccccccattcctccccccactcttgggccttaccgggggactcctacctttttccccttttatggtaatattttttta

SEQ ID NO: 501844 - DNA, 102 bp, Homo sapiens
ggcgggacgggacgtgcggcccagcgagttggtcggtcccggggtcaccgctacgggaagcaggcctcgccacaagactgagaaaaatggctttgtcaagcc

SEQ ID NO: 501845 - DNA, 104 bp, Homo sapiens
acgaatcctcttctgtgacagaccagctgaccaccgcctctgtgctgtggacagcacagcagagaggtggatagcacagagagaggtggacagcacagaggaga

SEQ ID NO: 501846 - DNA, 248 bp, Homo sapiens
atgggttgaggatgggaacgttataaagagcaccattctcaaagcgcaggaatcgcgagccctggggatcgctggtctacttcctaagcagcaaggaatgttatgcatttcagcgcttgctaagtcagtgcgtcctcagagagggcttgcaggctccagggaggcctgcataaggagtgaggcctgggccaagcccaacagaaagtgtcaaataacaggcctgccccttcccaaccgcatcacccgtt

SEQ ID NO: 501847 - DNA, 648 bp, Homo sapiens
  misc_feature (599)..(599): n is a, c, g, or t
atcgacattgcactattataatgctaaaatgatttctgataaaatagttcctaactcaactagaaaactataaagaatgaaagaatgagcagagtactcatgatgcctttgagtaaaatcgaaacatcatagagcgtgatctaatttccaaatcaataggcagtattgtaacattaaaggaaagctattccaatcacttagaaatacttgctaagtactgctttttacagttatgacaactgtttctatgcatatgaaccaagcaaccaaatatctataaccatggaaatatctgattagaaatatttctaatttgggccgggctcggtggctcacgcctataatcccagcaccttgggaggccaaggcaggcggatcacctgaggtcgggagttcgagaccagcctgaccaacatggtgaaaccccgtctctactaaaaatacaaaattggccgggcatggtggcccatgcctgaaattacagctgcttgggaggctgaggcaggagaatcgcttgggcccgggaggtggagattgcagtgagccgagattgagccattacactccagcctgagcaacaagagtgaaactctgtctcncaaaaaaataaagacagacatatgaccaattgtacagaatagggcaatg

SEQ ID NO: 501848 - DNA, 240 bp, Homo sapiens
cgcccgatattctggaggcttagaaccactggacactcccacaaacatcttcagacagacacatactacatgcactctacacacacacaccacgcactatacatacaaacacacggacacatacacactacacaactacacaaacagacacacactatacacacaaacacactacatgcacatacacactacacacaatcatacacacatagacacatgcacacagcacacacacgtata

SEQ ID NO: 501849 - DNA, 1538 bp, Homo sapiens
  misc_feature (721)..(721): n is a, c, g, or t
cgcgggcttgcacccagcaaagtggtgggtcgcccctttgctcgcccgctgtgttggttgttcgctagtaggccggtggggtggaactcagagaggggtgtctaattcactggtggtgagaaaagaagggcagttgacatcgataggggtgtggatgcctgcccgaagataattgtgatgacccacccggttttcctacagtgggctgtgaagattttgtgggcccccttgtaaagaccacaaaggggagtgttaaatgatatgaaggaggttgatgggcggcaatgggcggttttcccccccacatgggggcaagaattcttttggtgggaagagaaagttgaaacacacagtggggaaggattttggtgcggccgagcgagaccgcagatgttgtagaacacagtagtggccgcagcaccaccagtaagagatgtgtgtagcagtttcgcgccccactgtgttttttatagggggttttttaataatcaccgcgcgccccactcctttgttaggaggccccacagcgtggtggtgaaataatataggggaccgcgtttttagactctgctgcgcccgacgaagattctcttaaagaagaaggtgtttgtaaaaggagcccctcccgcgataatatgctcgtataaacgtcttgtgtttaggaggccttcgagacccgccactatgtataaggagggggggcttcgttgtgcgcgccccnccacaacttaggggggaacaatcctcggggagattgttctcactactaatgtgtcctcggtgagagacagaagagagttttttgtggaatgagatggactctcggtgagataatatattatgtgtcgtctctgctcgacacacgctgcgtcacaggagggatctcttttggcgcactactacgcggcgtgtgggccgtcgtcatatactattcgtgagagctctctgtttgtagttgtgtggagagggctcccaacggttctctctcaccgtgttttctctcgcgacaaaatgcggctctctactggcgcacacagtttgtagatagaggtgagagagcgatatagcgccttatatataacatatataagagagagctctctctgtagagccctgatatatctctcgagcgcccgcgccgtgtgggatatctctaagcgctctatcctcgtgtttaacacactctcactcttgttgtagaacaccacgcgccccctcgtgaggtgtccacgctggggtgggctcgcccctcgtttgtgggcacacaactcgtgtccgctctcttgttctctcgtgcgtgtgttttgtgataaagagagctgtctccactctctgcggggctggagacccacgctttcttgcacacacaacccagacacccgcgctgcacgtcacggtatggagcctcttccgcccacagtatttttattttctgtagtaaagcactttccactccaccacaatgcctaaattgtattctgttatatttttgggtttacacaccctgattcatacttataaatattttcaggttttta

SEQ ID NO: 501850 - DNA, 166 bp, Homo sapiens
ctgccctatgcccacttttaccacaaggcacagccgtacaccctcttatcccctatactagtttagctatctgaagaccagtcagcctactcatgcaaccaatagccctgtgccgtacgccttaaccggtaaggttactgcaggccacctactcgtgtcatacatt

SEQ ID NO: 501851 - DNA, 297 bp, Homo sapiens
ctgctcttagcaggatcccgttttgggcttcgtgcgacggctcatgcctataatcccaggagttagagaccagcctggacaacatggtgaaaccctgtctctacaaaaaaacacaacgattaactggtgagtggtaatgcacacctgtggtccctgctacttgggacgctgaggtgggaggattgcttgagcccaggcaggccagcaggttgcaaaatcatgctactgcacctccagcctcaggctacagagtaagcatcctgtcaaacaaaaaaacaaaccaaaagggaacgacag

SEQ ID NO: 501852 - DNA, 237 bp, Homo sapiens
tctaagaggatcccaggattcgtagatatcaactatatggctaccacctttaagctaatgaaatcataagagctacagtggtaatctcttatactggatatggcaagtgctgagaaaaaagcactgctaactaagctcagatgctgggtaagacacttaaggccagcgctgtgactgaaccatctggtttaaatgcactttctggccctggcttctccctgtccctttcacttcatg

SEQ ID NO: 501853 - DNA, 352 bp, Homo sapiens
  misc_feature (26)..(26): n is a, c, g, or t
  misc_feature (35)..(35): n is a, c, g, or t
  misc_feature (38)..(39): n is a, c, g, or t
  misc_feature (45)..(45): n is a, c, g, or t
  misc_feature (62)..(62): n is a, c, g, or t
  misc_feature (123)..(123): n is a, c, g, or t
  misc_feature (151)..(152): n is a, c, g, or t
  misc_feature (172)..(172): n is a, c, g, or t
  misc_feature (201)..(201): n is a, c, g, or t
  misc_feature (221)..(221): n is a, c, g, or t
  misc_feature (223)..(224): n is a, c, g, or t
  misc_feature (226)..(226): n is a, c, g, or t
  misc_feature (249)..(249): n is a, c, g, or t
  misc_feature (256)..(256): n is a, c, g, or t
  misc_feature (272)..(273): n is a, c, g, or t
  misc_feature (288)..(288): n is a, c, g, or t
  misc_feature (294)..(294): n is a, c, g, or t
  misc_feature (321)..(322): n is a, c, g, or t
  misc_feature (324)..(324): n is a, c, g, or t
  misc_feature (330)..(330): n is a, c, g, or t
  misc_feature (334)..(334): n is a, c, g, or t
  misc_feature (341)..(341): n is a, c, g, or t
aaaaaattaatttattattataatgncctaatttnttnntctgangattaaccatttttttntcttagaatatcaaaaagaaaaagaaaaaggtgttctagctgtttgcatcaaaggaaaaanagatttattatcaaggggcaatattttnntcttttccaaaataaatttnttaatgatacattacaaaaatagattganatcagcctgattagtataantnntnttggtaattaatccattcctggnataaaangtctttatcaaaaaannttgtagatgcttgcnttttcnttttttcaatcatggccatattatganntnctaacngganatagganaaggtgtaact

SEQ ID NO: 501854 - DNA, 219 bp, Homo sapiens
ttactgcatgcagcctgagtgcagagtcagcatctctcatctattcatcagacggagatcagcccgtactcattccaacatagctgctcagctccaatcagagccccatcttcccctggagacagctttgagaaggatgtgagagcgcaattgagagctcttaccagcccccactgctgtgatcagtcagcagcccgtctcagtgtaggcaccacacgc

SEQ ID NO: 501855 - DNA, 306 bp, Homo sapiens
tggacagaccacttgaggtcaggaattcgagactagcctggccaacatggcaaaaccccatctctactaaaaatacaaaaaattagccgagcacggtggtgcatgcctgtaatcccagctacttgggaggctgaggcacgagattccttgaacccaagaggttgaggctatgttgagctgagatcacaccactgtactccagcctggatgacagagtggagactctgtttcaaaaaaaccgaaaagacaatatagtttgattcttcatttttttaaatttgccaatctcaggataacacgttcgcg

SEQ ID NO: 501856 - DNA, 132 bp, Homo sapiens
tatcgccaacactttgtggagcaggtgcaggatcacttgaggcaggcatttgatgacagctgtgcaacataggagacctattcctacaaaaatattttaattagctaggctggtggtgcgccatatagtccc

SEQ ID NO: 501857 - DNA, 342 bp, Homo sapiens
ctctgaagaaaaaaaaaactagcatgacccatggcataagatgtttatagttgaggaaacaacctaaagattacctgcaaggacagacttctacaaaaacagaaaagcccagatgtcccaatacccataacaagatttgctttcaagataattatgcttttttttaaagatagttatgctttgatgtactcacacagtagaatgtcaaggataggtttctttaaatcaataccataataaatttggtcatgctgtctgcccatccgcatgtaggcacagcttagtttagtctttgtatagacaaagatccctataggaagaaaaactttaaagactatgtgt

SEQ ID NO: 501858 - DNA, 196 bp, Homo sapiens
tgcaagctcctgggggattacctagggcctgtgccggaatggagccctgcaggagctcagcaagaggctcgaccacaggaattatctcttggaatctccgcataggttcagtgtcgctgacctccaacagcatgtctaccactgcgacctgtgcaccccgcgcggcttcatctgccagatcggccgcagcctcctg

SEQ ID NO: 501859 - DNA, 291 bp, Homo sapiens
aatctatggcaatgggaccaagcatagtcgtgcaccatgttatctgaataaagggctaagtatccgaaactatatcttaggaactgctacaacagttggcaaaaaaaccccgaaataacccactgaaaaaatagaccagagactcgaataggtatttctccaaaaaaaaaaaaaaaaaaaaaaaaatttccaattggccagggcttacttttattcaatcccatgtaaaacccacagttaacattgctaccctctttttatttttcacggatgggccttttttcaacaaca

SEQ ID NO: 501860 - DNA, 1127 bp, Homo sapiens
agctgaatagagcatatcagctgaagcagttaactagtattaaagttgttatcatttacttcttgttgaagatctcagagcctcagatctcactataaattgtctcaagttctcaatattcaaccaaagaaattaacaatgtatataatcgtaagccgcttatagtcgtataaattgggtgtcccagtaccatggcttttaagtggtgggaccatataggaatccagtgactttccaactggtggggaatttacgaggtcagacagcatcctttgctagtagttgatacattacctgttatcagtctctttcggatacagacagtttaaaactaaggtatgcttcaatgaagagcctactggttgtacttcgaggcatagtatatgtctacacagtagacgattcaggcaagcagcagatacttattgcgacagatctgagagaagaaaaaagagaaaagcgtctaagggagaatgccatgatcggaacgggctgaatggagtaaatatcaattggaaaaacccaagactatcaaggggacacgtgcgataagatcagggtcactccatgctgacgtaatgaagccacgcgacagcgaaagaggggagaaggcccagatcaccaaggctgctatagaacggaggaaagcaacaagaggaacacagctgacaggggtgaaccaagagcgggggctacgccaaaagagtccacaggacaaacaggcgcgactgggctgggacccgacacatttggccgacaaggggtcagtgtacggcgcgaaccaccttgaaacgcgggacaacacaacaatactggaccaacagtccctgacagtagaaacaacagccagtagagaagacaagggaaagggaactgcgcaagggggcccttgcgttcacagaatagcgtggagcgttaccaagagagaccaccttaaggtaggcaaatcccaacggaactgggcagggctggtaagcggaagaaaatttagatgcacgccacgtcccaacacgaaaacgcagcacacaaataaggagccagagccggcacggcagacaaccagagagcctagtaggacaatgcaacacagcaggcatgacagcacaggcatgcggcaggggaaagcg

SEQ ID NO: 501861 - DNA, 1463 bp, Homo sapiens
gtcttttctagcgtcttttgagatgagtatcaggtttatttatattctcacttatgatcatctgatgatgaacttaatgtttccattaggtattaatggaatactaagtccctcgtgtgatattctgaaccaagcctattcctaggcctagagattataaatattcgagttcgacacagaatctaacattagacaggccaagccgtgagatgagccatgatgcctgtacagtcctcaagttgcagtagcgggtaaaccagcggatcggcattgcactcccaaaggaaagtttcaaagggctctgacagaaaagagccttaagaaatagcacgcccatatgaatatcaccacacccgttggaaagacaacaagacactaacgcacgccatgtcttccaaacaaacaaagaacttcaaaaagcgatgaacaaacaccagaccaaatacaacaacaagaataaatatacaacctaatattaatttaaaagaacagacataacagtagccccgccaacaacagttatctactccaacacgcaacacctcttttctatgaacccacggcagaagccgaacgccgagactgcgatacgagagccactaaaaccatgggcaacgtatcactactggcatctgacctaccctagcgcaacattataaaagagctgaagcaagaacatcagtccactaacgataaggagatacattccataggctgaaatacaaaacccacagcctacaagagcacgattaccctctcgcgaagcttgcagggtaaacgagagctacatagctaagatgtgggaactcttcataccgcgcgtactgcttctacagagcgcggtatatactttaagtcaattagtgagtgagccatcagaatgaggatatcacatcgaaatttcacacgtcattgtagactacaccgttccagtgtgtgcctgtctgagttgaaaccctgcgtatctgacgtccaactcatcctaacgaagaaagcagccacacgcccagaagacacgcctaagaagggcacaccagagcgaaccgagaggatcatcggggctgacagcccgagtcagtgcggctctggctcccgccgaacgccgacacgcagggcccaccgtcccataggcatcgacgcacttaacaatgactaaatcataatattattatacacacctacactcaccacctcttacctcatcacatacaatcaatagtcacgctgtatgatcaccgactatcgacaggatcataaatactcatctcatctacccctttagccactcataactaaccacactcactagcactatctatcttacaatatatcatctcacttaagacctcagagtccacaccaacgaaatatgactacaacaattagtatactaatctacatacactcagccgacatctctatctctctcctactcacccactaactaacacaagtatccgtaa

SEQ ID NO: 501862 - DNA, 364 bp, Homo sapiens
taccattttcagtttttactactaatcttagcaggtaagaattagtattttgtgttatacatttttcctttcatttaaaaattagccaggtgtggtggctcatgtctgtaatctcagcactttgggaggccgaggcaggcaggttgcttggagttccgagaccagctttggcaacacagtgaaacccatctctacaaaaagtacaaaaattagctgggcttggtgcacgcgcctgtggttctactgaagaggctgagatgggaggatcacttgagcctggtaggtggagaggttgctgtgagctgagaatgcactactgcattcacagcctgcagcctgggcgacagagcaagaccctgtctca

SEQ ID NO: 501863 - DNA, 149 bp, Homo sapiens
gctggcgcgcccggtgcctggtgctggatgaagctcgatacggcatgcatctggctgggtggtgcgccccgaacatgtgcggaagcgttttatcatgcgcctgtgcgcctgtcgcaacgtggcgcagccggtcaatatcatgagccact

SEQ ID NO: 501864 - DNA, 147 bp, Homo sapiens
catcagtggaaacctcaaataccgaacactacaacagatatactaaaaatgaaacgagaaattacaatacatgaccagagaaacccacttccacaaaaaggaagacaggaagaatggaaggggtgacgagaggcgtcagtatcgcta

SEQ ID NO: 501865 - DNA, 157 bp, Homo sapiens
aggtggaaatcaggacatgaataagaccagatctgcgggaaacagaagctgagctccgccgcatgcaagagatgattgcaaggatgcgggccgcaaatgcaggatcgcggatccaggcgcgggaataggcgacaggcgaggcctcctcgggcaacca

SEQ ID NO: 501866 - DNA, 574 bp, Homo sapiens
aagaacttttgagtgcaattagacctcacatctttctagtctcggttagtgatggtggctctaggacgaagcgggacaagctgtacggtctcgggggacttgagcttggggaatcactttcagctcgtgtgtcagcccctcttccctgtcctccacttggcacatcgaagcactatcgtccatccactatatagttcatcagagatgttaatattattattgctccactctcgtatcacggtccattttctaacgggtagaatgagagcaacgtaggtacgtggatcgaggtctgataatgaacccagggtaggagacggagacgatctcctgggcagccgttttcctcatcctttccctctcccagtccatttccaaatgtggcctccatgtgggtgctaggaacatgggaaaaaccactgctatgccatttcttctctctgttcccttcgctcacccccgacggatgtggcatgatgatgtcttctggtgtcactggtgaacaccgcctgttcctgttctggtatttcgcctgtcagtattcccctctcggccaggttgtgtcccaaaatcc

SEQ ID NO: 501867 - DNA, 87 bp, Homo sapiens
ttttttgtccaaatgtggatcgtctatcccgtcttcttccattacgttcctgttgaggtcgaggaccggcgctggtccgattcggcc

SEQ ID NO: 501868 - DNA, 285 bp, Homo sapiens
cgagctcggtccgtatctctaacattacctatgtgtagggaaaagcacacacatgtttactgcccattataaaaaattcaggatccttaaattcagggctcctctcctatacgcaacccactacatgtacatgtgtcccctttctgcattgccataggaactgtggctcgggaaaccagtgcaaatgccaatacccttgttactattattgcagtgaataacgagctgtcctttgtctctagcccagtggtctcatgtctaatgttagagatacggtaccgagcg

SEQ ID NO: 501869 - DNA, 874 bp, Homo sapiens
ccacaagacttaaatcttgctcgcagtaaacatttattgctgcagttgttttacttttatgtatttggatcagccatctaataaatactttcttatgtgtttctccccaagagctacagtttataaatacttcaaatactgcagtcaatgcttagtgctgtattttaaaacaaaataaaatggtcataaggtaacaactggtgtgtaaagtaattaagaattactccttctcttgagaaacgtatagagaaactatagataatagagctgtgtagaaaaaacagaggcagaacttgaggtcaactgtcacgtaggaaaaaagaaccttacagatgtgttctttaaaacgctatcaacacctctatccctgtaccaaagaataaattagagtcaatgcaggagggaaatgaagacactgatttttaattttatatcaggaatctatttactcatttattgatctaacatatattttattgaaagctactaatgtgccaaacactgtggtaggagtagagatacaagggtacatgagacaagagactctgtctcacatgtctttgagttacacaggatattgaacaaatacttaaaagtatgttaatttgtctttcactcaattcataattagttagttttttgtcggttaaatagtgggtaatatagcaatccagatcatcacaggtctgctcttctctactatatgtctgtctcaggaggttgtggcaaacaactgtttactaggatgatcgggggagcagaattgagactttacctaataggggtggggaaagtttgggatagaggcgttggagtggaattggtcggggactcgaaaaggggtggaaggtaaaaagttgggaataagagttgt

SEQ ID NO: 501870 - DNA, 304 bp, Homo sapiens
ttttggtctgtgtgcatgcggttctgtggtcttcgtcttcgtggagccctggtctagcctgtgagcgcgagacgaaatgattgtcgtgactgtcctcgacccatggatccacttcttgcgttcagatcgctggcctccgacgtcaaacagcctgaagtggaggttcttgaatgtgacgtgggtttctacgatgccagtggttttgagcctggttcggaggatgtccttgctcggtgggctggtagtcggcggccccaatccgatccaggcttgtccaggtagtatttggcagagtcgttgagct

SEQ ID NO: 501871 - DNA, 518 bp, Homo sapiens
ccgggttgggttccatcggcccttgtggggttccccaggttgggtcccacaaaagtggcgcccgccccggtttcaaccttgaagaattcaaggtggccggcatttccaaaaggtggggcccggcccatggcctttttttgggttccaggaaggggaacaaattcccggagttccttcaggcccaagttcaacgggttaaagaggtccgctcccaaattattctttttcccaggaaagccccgggcccccaaaaaggggacagttttttttaaaaacttaaaatggcccccccacttgccgggccggttattcccctccgggaagtttttaaaaaagagaaaggccgggttttcccttgggaaaaaaaaaattttaaaacctttgcttgtttccgtatgggccgggccaacgcccgggtttttgggatacgggcaaaaaaaacccaggaaacccccgaaccgggttttttaaaaaaaaaataaagccctcctgggggcttggaatcagtcggccgtcca

SEQ ID NO: 501872 - DNA, 1465 bp, Homo sapiens
cgagttgtttgctccctccccggtgggtgtgcttttttttggtctcgcgcactcagttggggtagcaatatttgcgtgtgcttctcttgcgggttatagtgctttctctttctcggttctgcgttcggtacacccgtctcgttggttgggtcgccgccagtcttttgttgtttctcgccgggtgggtgtgcggccgctttcctcttgtggggtggggcagtgttgttgcctcgagcggccttcttgtgggagtgttttttgggtgtctcccctctccttcccggcggtgggtattggtttcagtggtggttgtgggggggagtgtccttttttcgttgtgttgggtccttcctgtatctcgcggagctcgtgttgtttgtgttgttgtgtaacgatatcttttgttggtggctcgccccgtcgcggtctctcgttctcatctttgtttgcgcgctgttcccgcttcgcgtttttgtgaaggtggtgttcttctatagatggtagatgtgtgttggttctctcccccgcccgcgggatgttgtgtggggtcttcccgccgctgggttggctctctttggtgtgtgtttggtgttcctcgccgcgcgggttgttctgtgtggtgagaccacacctctgtcttcgcgctgcgcgcgattgtttcgtggtgtgtgtttgcacgcgcccccgcgcggcgataagagaggctcggggctcttactcccctccccccccccggaagagatagagagagcgctcccgcgctctctcccgtcggtatatgctctctctctggagagagagacgcgcgtgaggggagcagctctctcccgcgcaacgagctcgtctcgtcgggcgtggtgggcgcgcacctctcgcgcaccctcgcgcgcgctctctcgcgcgcgcggatgcgattattagtgggtgcgctcagcgcggcggaggtggagatagagagagagacaccacctctctctcgtctctctgttgtgtgcgcgtccgcgcgcatacaacaccgtcgtgcgcgcgctgtggtgtgtttttgccccccactcgagtggcggccccgtctctctctgtcgtgtggggcgcctccgcggccactctctcctctcctcacagatattgtttgtgtgtgtcgcgcgagcgtctggttgtgctctctcccgcgcgcgctcctcgcgcacatgcacacactccgtcgggcgcggggggcgccgcgacgagcgcctcttgttgttctgtgtgtgtgttcctcccacacacaggcggtcttggtgggtctttttgtttcttgtggtcttctctctctgttcactccccctttgtcgccccccccccccctcctccgctcccccccccgctgtctcccccccacacaagattttcccccttgggggtgtgtgtgtgagacaccccccgacaacagaaaaacagggaccggtgagggggttttctctcacca

SEQ ID NO: 501873 - DNA, 527 bp, Homo sapiens
  misc_feature (42)..(42): n is a, c, g, or t
  misc_feature (89)..(89): n is a, c, g, or t
  misc_feature (104)..(104): n is a, c, g, or t
  misc_feature (108)..(109): n is a, c, g, or t
  misc_feature (113)..(114): n is a, c, g, or t
  misc_feature (116)..(116): n is a, c, g, or t
  misc_feature (121)..(122): n is a, c, g, or t
  misc_feature (132)..(133): n is a, c, g, or t
  misc_feature (135)..(135): n is a, c, g, or t
  misc_feature (138)..(138): n is a, c, g, or t
  misc_feature (140)..(140): n is a, c, g, or t
  misc_feature (146)..(146): n is a, c, g, or t
  misc_feature (151)..(151): n is a, c, g, or t
  misc_feature (155)..(155): n is a, c, g, or t
  misc_feature (165)..(165): n is a, c, g, or t
  misc_feature (171)..(171): n is a, c, g, or t
  misc_feature (181)..(181): n is a, c, g, or t
  misc_feature (183)..(183): n is a, c, g, or t
  misc_feature (186)..(188): n is a, c, g, or t
  misc_feature (191)..(191): n is a, c, g, or t
  misc_feature (193)..(193): n is a, c, g, or t
  misc_feature (198)..(198): n is a, c, g, or t
  misc_feature (200)..(203): n is a, c, g, or t
  misc_feature (207)..(207): n is a, c, g, or t
  misc_feature (216)..(216): n is a, c, g, or t
  misc_feature (225)..(225): n is a, c, g, or t
  misc_feature (227)..(227): n is a, c, g, or t
  misc_feature (230)..(233): n is a, c, g, or t
  misc_feature (238)..(239): n is a, c, g, or t
  misc_feature (241)..(241): n is a, c, g, or t
  misc_feature (243)..(244): n is a, c, g, or t
  misc_feature (246)..(246): n is a, c, g, or t
  misc_feature (268)..(268): n is a, c, g, or t
  misc_feature (276)..(276): n is a, c, g, or t
  misc_feature (285)..(287): n is a, c, g, or t
  misc_feature (307)..(307): n is a, c, g, or t
  misc_feature (313)..(313): n is a, c, g, or t
  misc_feature (328)..(328): n is a, c, g, or t
  misc_feature (331)..(331): n is a, c, g, or t
  misc_feature (366)..(366): n is a, c, g, or t
  misc_feature (374)..(374): n is a, c, g, or t
  misc_feature (409)..(409): n is a, c, g, or t
  misc_feature (419)..(419): n is a, c, g, or t
  misc_feature (432)..(432): n is a, c, g, or t
  misc_feature (440)..(441): n is a, c, g, or t
  misc_feature (451)..(451): n is a, c, g, or t
  misc_feature (501)..(501): n is a, c, g, or t
ggggaaaagggttttgtacatgggggtgaaacaatataaatncaaaacttacagataagggttagctctaacactcaactctttaaaangtttaaatgaaaatngggnnaaanncnacacnntattgccctnnanatntnaactanagggntttngaaggggaanaagggnatgaaaattntnttnnnttntnctctnannnntctnttattgatnaggtaagantnaannnnccagnntncnngntttcaaatgggaaagggaaagnggaggganagaagctannnaaacttacgtcttctgcccngggggnggggggtcacccccnccncctctgcctcctcgggggcctcctcgccctccaangcctcccnggcctctgcccccaaatcctcctcggcctcctctnccaccacctngtcctccaaagcngcctctgnntccaccacgncccccgaagccaccttcacaccttaggatttggcccacgtccaaggtaantttatattccataaatttcacggtct

SEQ ID NO: 501874 - DNA, 521 bp, Homo sapiens
  misc_feature (483)..(483): n is a, c, g, or t
  misc_feature (504)..(504): n is a, c, g, or t
  misc_feature (520)..(520): n is a, c, g, or t
cacagggctggaggcaacacagggctgaacccctgtcagcctgccgggggacgcggtgcccccctccggatccgggaaacacagcgtcccagccggcgcctgcaggtgccacacttcctggtcctctctggctgcgtctgagggccttagctctggcaggggcctgcaacgggctcagcttctaggggtggcgggtgaaggcctacacctgccccaggacggccaggtccaccagcacctgcaacagacggagaactgaaggagcatcttgaagctgtggcgggtgaaggcctacacctgccccaggacggccaggtccaccagcacctgcaacagacggagaactgaaggagcatcttgaagctgtggctgtcttgaaggtgtcgccgcttgtcctcacgagcaccattttgattctcgtgccctgtgtgcatgggttggcaagcgtttctgttaagggctccttgaacgctcaagattggnctttcagggaaagttcaaggntttccgaagcagaaana

SEQ ID NO: 501875 - DNA, 396 bp, Homo sapiens
tctctaatgatcagagagttggtatcaccagatgcatcgaacacaatcgcgaggatttggcgagcacaccgtatgaaaaaagctcagacggtcgcgtctttatagatgttgaggggtattactcatggggtagagatgggggaggcgtccgcgccgtgtctgcaagttagtatcgagatccacgtcccaataccagtgcgtccggttgcggtgagcgttgtcccagctcaaggccccaggcgccggtaatattatagaaggcagagttggccaaaggcttggaatttggagcacgccatttctcgcggggtacatttcgcattacggcttcttaaccttttccttaaacttccaaagaagggctttgtggcttttcaacagaactccgggaaggat

SEQ ID NO: 501876 - DNA, 840 bp, Homo sapiens
cgcgaacacaggagtattactaggtcgatgcttggttttatattcgtcacgatggaggaggatgaggcggtgtatggtcctggtacggcgagctgggggagcaagaggaggagaagaaaaagaagaagaaaaagaagaggaagaagaagaaggaggaggaggaggaggaggagggggccgagaagagcagctcacccttcgcagcctgcgatgtggtggaagactgactgcctgctgcttcgtgtgcttggcagcgagggtggctctcctgaccctgtggtgcagactcagttgggaagttgccgaaccctggcacccacgtggagctgccacaatctgcgcgcttcacacagacgcggtttgtgtgcgtgcgtcttcgtgtgtgctcccgtcggtggtatttgcgtcgctggatcactagatgcgtctgctttgttgcttcgctccagcctttgctgcgttcgactggagttgcgggggctgagttgccactgccatgtgctgcctgactgtgtgtgcccctctagtgctttcctggaggctgctgtgctgtgcaactgtggaggccctccctgtgatctggccctgtgctgcaacctaccactgcatgtgctgggggacctcctgtgcaagccctgatgtgctgtggttgggggttggcccagtcctggtgggaccactgtccgtgcccatgccctgccggtcgtggagcgaggatgctgggatgcctgtgtggatgccgttggactgcagctgcgccttgtcgggccaccctgaagcctgcttgcactacaatcttgatgctcaccgccttcattggagaacttcaccttctccggg

SEQ ID NO: 501877 - DNA, 295 bp, Homo sapiens
cttaccaaaagtctaggttttgagtaaaatcggaaatgctggcataacagtcatgttgatcttgctttttgttttatctagccgccaaaccttctaccctcgcctttaatctttaaagcctgagaggagtcaccccgtttagctctgccttatacttactgattatctagttgtctcaacgtgtcgattacatgctaggacaatgccgtagtgctttgcatgctctagtagtgtagtcgagaaagagtgcgacctatcgcccatgagcgctagtctctttcccgacattacccgt

SEQ ID NO: 501878 - DNA, 249 bp, Homo sapiens
ggccaacctcctactcctcattgtacccattctaatcgaatggcattcctaatgcttaccgaacgacaattctaggttatatacacttacggaaaggcccaaaggttgtaggcccctaagggtaatatcaacctttggttgaggcgataaaaattttaaacaagggcctgtaaaacggcgaaaataattgaatatatatatagagggacagattgagatttgaaatggattttatagtgtgcagcattg

SEQ ID NO: 501879 - DNA, 332 bp, Homo sapiens
  misc_feature (7)..(7): n is a, c, g, or t
  misc_feature (35)..(35): n is a, c, g, or t
  misc_feature (44)..(44): n is a, c, g, or t
  misc_feature (63)..(63): n is a, c, g, or t
  misc_feature (77)..(77): n is a, c, g, or t
  misc_feature (92)..(92): n is a, c, g, or t
  misc_feature (120)..(120): n is a, c, g, or t
  misc_feature (143)..(143): n is a, c, g, or t
  misc_feature (222)..(222): n is a, c, g, or t
aacccanctgacggtgaagctgccgctgagggagnaggcagccntgatgatgccgtcatcccntgaaaagggagcantgagccggaaggcancagccctgggagggaagggcgccccccnaacccctacctgcattgggctgnccaggcaggggcctgagctacttctgcttttgttactcagagtaacaatgaaccccatggatacagaatcagggctagncgtggtggctcatgcctgtggtcccagcactttgggaggccaaggcgggaggattgcttaaggctaggagttcgagagcagcctgggcaacatggcaagaccctgtctct

SEQ ID NO: 501880 - DNA, 120 bp, Homo sapiens
  misc_feature (46)..(46): n is a, c, g, or t
tgtactaagagttctttggtggttagagagatggcctggagctcanggcaggagatgacgctgaagagttacatctactcaggattaccacctttggttcctaatttcagcattcaactc

SEQ ID NO: 501881 - DNA, 131 bp, Homo sapiens
taaagggccccctggcctgttttggggcaaggtaggttcttgggccctttgggcccccccccctcttatttggggtttaggccaacttgtttttccgtacgtggtgtgaaataaaaccccagccctgggga

SEQ ID NO: 501882 - DNA, 294 bp, Homo sapiens
agagggcgttgtgttcttgttgctcaggctggagtgcaatggcaagatcttggctcactgcaacctctgccacctgggttcaagcgattctcctgcctcagcctcccgagtagctgagattacaggtgcccgccaacacgtctggctaattttttgtatttttagtagaaatggggtttcaccatgttagccaggctgtgtttacactcctgacctactctcaaaccgactcaccttgtacatcaaacctagagggggttctccctacattctatttgcgctctcatgaactga

SEQ ID NO: 501883 - DNA, 564 bp, Homo sapiens
cgcaatctatgtcggcgagtatattcgtccgcgctgtgaatatcagtccgggcttccgtccaaccatagtgcagtttatttaaaggtgcagtgacctgaaagcttggagctctttctgactcgtgcctggtaagcatgtgaaaattgttactagtcactttgcccacagttggtcagtgtgtttgttgaaatgaatgaagtctgacatatgaaacaattgcacttcgttggtatggtacctatagaaggatgaaaaacatatgctcataccgtatacatacacataaaatgatgtgtgatcatcgagtatgatggttcgtactcggccccgtgccaacccgcatattcatcaatagataacttggataatacttaactacagtttacgaagaacaacaacaaacaaggccaggtgcaatggctcatgcctgtaatctcagcactttgagagactgaagtgcagcaccacatgaagcccaggaggtttgagaccaacctgatgccacataggaccgctcctcctcttttaataaaggggtttaattaccccagacaaacaataac

SEQ ID NO: 501884 - DNA, 330 bp, Homo sapiens
  misc_feature (12)..(12): n is a, c, g, or t
  misc_feature (61)..(61): n is a, c, g, or t
  misc_feature (138)..(138): n is a, c, g, or t
  misc_feature (167)..(167): n is a, c, g, or t
  misc_feature (170)..(170): n is a, c, g, or t
  misc_feature (178)..(178): n is a, c, g, or t
  misc_feature (181)..(182): n is a, c, g, or t
  misc_feature (189)..(189): n is a, c, g, or t
  misc_feature (197)..(197): n is a, c, g, or t
  misc_feature (205)..(207): n is a, c, g, or t
  misc_feature (210)..(210): n is a, c, g, or t
  misc_feature (213)..(216): n is a, c, g, or t
  misc_feature (218)..(218): n is a, c, g, or t
  misc_feature (220)..(223): n is a, c, g, or t
  misc_feature (227)..(228): n is a, c, g, or t
  misc_feature (233)..(235): n is a, c, g, or t
  misc_feature (238)..(239): n is a, c, g, or t
  misc_feature (250)..(250): n is a, c, g, or t
  misc_feature (269)..(269): n is a, c, g, or t
  misc_feature (290)..(290): n is a, c, g, or t
ggttgaattgtncgaaaagtcctcaacgtcctgacgggactcccctgaagccaaggcagtntgagtccattcattattctgtcttggatcttaggcaaagccccgggccccttggagcagcaccagggttcccgacanccccaccgaacagggtcaaacgtgccccnggnggggaccncgnnggcgaanccttgcgncctccgtnnnagntcnnnncntnnnncggnncgccnnnacnnttcttgggaangggctaataagacttaaanagagagcgagaagtatatagntagaagtaagactatgaaatagatatagatgagagagata

SEQ ID NO: 501885 - DNA, 273 bp, Homo sapiens
actcctacattacacgataaagaattgataaaaaataacactgtgtggtgattatcagggaacagagacacttcagggcaacactcagaaacatttggaggtatacatgtactgaaacatcacaatatgtataattattatgtacattatgtcttttttttttttaaatagagataaggtctcacttggtcacccaggcgggagtgcagcagcaaaatcatagcttggtaaacttggtaccctcaaattccggggctcaatcgatcctccgtg

SEQ ID NO: 501886 - DNA, 143 bp, Homo sapiens
atgatacgtgcttgaagtccttgcaagagttgagtactacatttgattacacgttcagctgcgtactgtggtgagttttgatgtaatattggtttctcgccaggcgcggtggcttacgcctgtaatctgagcactttgggagg

SEQ ID NO: 501887 - DNA, 195 bp, Homo sapiens
  misc_feature (54)..(54): n is a, c, g, or t
  misc_feature (126)..(126): n is a, c, g, or t
  misc_feature (154)..(154): n is a, c, g, or t
  misc_feature (160)..(160): n is a, c, g, or t
caataatgaaattccacagtatgaaaatggaagaaatcaataaaattatacgtnacctgtggcgaagtacctatcgtggacaagatattgattacatagaaatacggtctgatgccgatgaaaatntatcaccttctgataaaaggcggaattntaactnccgagtggtgatgctgaagggagacacagccttgg

SEQ ID NO: 501888 - DNA, 161 bp, Homo sapiens
agacagcagcaccagcgttgcagagaccccagacattatgctcttttgggaggtggagcaccgattattttcagatcattgacattttccttcaggagttcattgcagttatgagagtatttccaggtaccttccttacagttcaggcggtattcgcaaac

SEQ ID NO: 501889 - DNA, 335 bp, Homo sapiens
ctgccataagcacacttcccatgaaccgacgctataagcaggcgccagaagagcagtaggacactacagctccttccatctggggcagaaaggagggtgcctgggaagtacgagggctgcagtggggaggcagaggtcccagcaacacttgtacatggcaggcagcggcagtgaggggcgaggtcgtgagcgagtccatgagtccagtgaggcggcgcgcactcacttgagtgcggtaagagacccttgcgctgtatgcgatgctggatctcgccgcgccgaagcatgagctgtagaaccttgtgaatgtggtgctccgggtctttctgcttggt

SEQ ID NO: 501890 - DNA, 181 bp, Homo sapiens
aatctaggggatttagcggggtgatgcctgttgggggccatagccatgcggcgggaaaggccagagtcctaagtatttgtgaccatctttctggcccagtaacgggagtcacatggttagctaagaatgagaggatttacagcatgctgggacgtatgttttcccacaacaggtgtagggc

SEQ ID NO: 501891 - DNA, 677 bp, Homo sapiens
tgacttcttgagattccacatataagtgagatcatagagtgtaggtatcccttatccaaactgcttgggactagaagtgtctccgattttaggatggtttaggattttggaatattggcatatacctaatagagatgtctataggaatgggacccaagtcataaactatagagtttatctatgttagcgatttatatcttaatgcacataacctgaaggtaatttgatacaagatttgaaataactttgtgcatgaatacgaaagtttgtgtgcgagctgaacaatcaagaataaaagtgtcagagtgtggagatttactaactgtgtggcgatcatgtgggctgctcacgaaagttttgggattttgaaacgatttcaaattcgtggattgtcagattagagatgttcaagcctatattgggtctttctgtacctggcttatttgacttaagatcatgtgctccacttgccatataatgttcatccactttcttacaatgtgatcacgtatgcacagaattttcgttctctttggaaagctaatataatactccattgtgtgtatgtgtgctgactttatgtgtttgatccattcatctattaacgggccacttaggtggtttcctaaggcgtgagtattgtgataatggcttagtgaatgtggcagtacaaattg

SEQ ID NO: 501892 - DNA, 190 bp, Homo sapiens
tataggcttctacttgttaatttctgttttcctgagtttctctaagtgagttctttatgtctttcttgaagtcctccagcatcatgatcaaatatgattttgaaactagatcttgcttttctggtgtgtttggatattcagtttttgctttggtgggagaattgggctccgatggtgccatgtagtcttg

SEQ ID NO: 501893 - DNA, 299 bp, Homo sapiens
  misc_feature (4)..(4): n is a, c, g, or t
  misc_feature (120)..(121): n is a, c, g, or t
  misc_feature (180)..(180): n is a, c, g, or t
  misc_feature (182)..(182): n is a, c, g, or t
  misc_feature (229)..(229): n is a, c, g, or t
  misc_feature (246)..(246): n is a, c, g, or t
  misc_feature (257)..(257): n is a, c, g, or t
aagngaagtctttgccttctctgctcccttgcaggggtcctccctcaagagtacagaatccttaccaagtgtgcactccagcttcggagggcccctgacgtgggggccaatcaggctgcnnaggcacctcaacattgcatggtgatagtgggccctctctctgggcccaggggctgtggncncctcctccctcagctctctgggacctccttagccctgtctgctaggngctggggagactgatancttggggaggnaagagactgggagccaccttctccccagaaagtgtttaacgg

SEQ ID NO: 501894 - DNA, 207 bp, Homo sapiens
tgtaaatctgctccccatcacaagacctgcttgttctaacatacgatgtctgtgctcgctccctcaacggggattctctaggagctccaacggtacgcgatgcctaccagtacccggacgacgtggactaatcttcgatcctacatacttcccccattattcctagaaccaggcgacctgcgactccttgacgttggcttatccgag

SEQ ID NO: 501895 - DNA, 401 bp, Homo sapiens
tcccgcgttcatagcagcattactcaaaagtcaaacggtagcaacaacccaaatgtccatccacagatgaattaagacatgaagtgtgttctgtccatacaatggaatattatttggccataaaaaggaaggaaattctgacgcatgccacagcctgagtgaatcctacaaatattacgctaagtgaaagaagccaatcacgagtttatgtgaaatgtccagaataggcaaatctgtgtatcagagacaaagcacattggtggttgccaggtctgaggaagaggaagaggccccacctaacaggacccgctttctttggcgatgatgaaatctggactgatggcgcacaactttgtgaatatactagaaaccaatgaattaaaaactttggaagatgaaaa

SEQ ID NO: 501896 - DNA, 218 bp, Homo sapiens
gagaggaacaattgacttggtgcatgttaagttgtagactggggttgacgatcagggtagtgcatgacagtggcagtgaatcgggggtccagggtccgagatcatggcaccttcttctggattggctgacaggaatgtcctttaagcactgacaggttcaaggaccagggttctctaagttccctggctcccccttgttattggtggcagggttcttg

SEQ ID NO: 501897 - DNA, 288 bp, Homo sapiens
gtttagagagtaagggagtggaatagaatcaatccgaatgtaatggaatggaattgaacggtatggaatagaatggaatggaatggaatgcaatggaatggaatcaacccgagtacaggggaatggaatggaatggaatgcaatgggatggaatcatccgtaatggaatggaaaggaatggaatggaatggaaaggaatggaatggaatcaactcgactgcaatcgaaaggaatggaatggaattaacccgaatagaatggaatggaatggaatggaatggaatggaa

SEQ ID NO: 501898 - DNA, 329 bp, Homo sapiens
gctgcacatagagccaacctcagttgagatgccttgggaccagtacatagaaggtgtttaagattctacagttccatttcatcctttacaaaatgtccaccctgaatctacagcttgcttattgaatctttgtgaaatttgaaggggagagggaaacagtaatatgacccaacataagagaagtaccagcgagcctctgtggacacaggtgtgttcataaccaccatcgctctaatccttaggttcattctttctcatttcagtcaaaaaactgattctaaaattaaggcagactgacacccactgcgtcctaaactgtagatgcatta

SEQ ID NO: 501899 - DNA, 363 bp, Homo sapiens
  misc_feature (70)..(70): n is a, c, g, or t
  misc_feature (315)..(315): n is a, c, g, or t
ggcaaggacaggaaaatcaaacacagccaaggtctcactctgtcacccaggctggagtgcagtggcaggntcatggctcactgcagcctcagacttctgggctcaagctattctcccacctcagcctcccaagtagctaggaccacaggtgcacgccaccacacctggctaatttttaaattatttatagggacgagatctccctgtgttgctcaggcgagtctcaaactcctggagctcaagcagtcctcccaccttggcctccgtaagtgagattacaggtgtgagccaccacaactgggattgcacttcctnttagaataaccttttgcgtgtcatgttgggactcaaaacattttcaga

SEQ ID NO: 501900 - DNA, 189 bp, Homo sapiens
cgagctggtaccgccgtgatctgagtgcatgccgcggactgaggatctgaagccccagcgaggcttccgaggctcccacagcaccctcagtcattcccccagccgtgagcgagtgcagccatgtgatggcccctgacgtcccagcaaccccagtggcccctacagagtcacagccaaggtagagccgag

SEQ ID NO: 501901 - DNA, 733 bp, Homo sapiens
cctgaccggtaagtgaatttttaaaatattttagatcatatattatatgtatctacctacattattgtgtagacatgtattccatgattaaaaaaggaaaaagtaattaattctagtctgtaatacactatggcttctgttttccttttaacaatgaaggaatacttgtaaaaagtagaggctacttaggtttgacatcatctttctctctctctctcttttttttttttattttttttgttggagagggggtctcactctgtcccccgggcgtggagtgcaggggggtgatctcagcacatggcaaccttcgccctcccagtttcagagcaatttctcatgcctcagccctcccaagttcccggggacggcaaccttctacctcctgaggttcaagcaattctccgttgcctcagctctccaagatagcggggactgcgggcgtgagccaccacaccgggctaatttgggtattttagtagaggcggggttgccccatgtgggccaggcctggtatcaaacttctaacctcaagtgagtcacctgcctgggcctcccaaagtgctaggataacgggcttgagacaccacacccagctgggtttctctctatgaatatgtagagatttgccttgggttatgaactgtaataattagtaatctgaaatttaaagttggagtgacaaggggctttaattggtctagacaaaatttgttaatagggtccgattctc

SEQ ID NO: 501902 - DNA, 714 bp, Homo sapiens
  misc_feature (224)..(224): n is a, c, g, or t
  misc_feature (311)..(311): n is a, c, g, or t
  misc_feature (586)..(586): n is a, c, g, or t
agcgggagggcgtgcctaacagttgtcggctgttccgcaccttctccacaggtccgggttgtcacgtttgggtctaggctcatgggcatggtgtgcaaccagtagaccctaggagtgagatgtgcccagggagtccggggatgcgcgtgcagcaaagagagcacgctatctctgcctgactgtggtcacgtcatgtgatgtgcaatgcgacaacaggttgatgnttaggttgtctccaagtagacgcctctagccatcgttccatgctcggtagcaagatgtagccacgcattttagcagtcacacttagnatagatcttagaagggaccgtggcccagtttatgcatcgaagcatcctcctatagctctaagcatgtcggataccattcaagcagcctggacccttctccatgagatcgcatcatagtgatacccaggggtctcatcacgaagtgtagtaaggccgagatgacttggaggataagttcccgtgttgatccagtccacgatactacaagtctcccgtggaagcctggcatagcgccgatccgattccgtgttcaagcgtcgggcttatggagaggngccgaaagccctgaaagtagcacacgccaaggagccacacgtgtaccatgcttgccgggccgtgtccccaagtacatgaggggaagggggaccggaacaatggtgctgcacggaaggtgaagtccgag

SEQ ID NO: 501903 - DNA, 203 bp, Homo sapiens
ccaggtcaccgccgcccctttcgaccgcaaactggtcaggcaggcccgtgacgatgctgcggcattcgttgccagcgatggcctgatccgcggtgcacgcctggaagccgcactcgactcgctgcgccacaactgcgctcggcactccgtcggcgaccttgaactggcagaagcaattctcgtccaataactacccctgactc

SEQ ID NO: 501904 - DNA, 136 bp, Homo sapiens
gaagctgcgcgtggccttcgaactgaaagaagacgacatgcacgccatcctcaaggccgccgagttcccggtatccaagcctgagctgagcgcgctgttccgcaagttcggccacaccaactaccgcacctgcggc

SEQ ID NO: 501905 - DNA, 434 bp, Homo sapiens
  misc_feature (102)..(103): n is a, c, g, or t
  misc_feature (105)..(105): n is a, c, g, or t
  misc_feature (112)..(112): n is a, c, g, or t
cgctcccccgaagctttttctccggccccagccaggagccacggaggcgcgggttaatccacggggttacgtctcgcctggggggaaaaacctaattttttnncncccgccnccgcgaaccgcgccaacaccaaaggccggcccaaaggcgggcaccacacgaccgcgcccagccccacgcgcaaggcggccacccccgcggcccatcccaacaagccgcgcgccgcgcgcgcgaacgcgacgcaggcccacgcccccgggcacacacggacgcaacggagccacccgagcccgaaccaagccccggcccggctgcccaccccacaggccggccaaaggacgcccaaaacgccccggggatttcccccggctgtaggccttttggccggtctgcccattggccatttctacctggtattcgcttggccccctcc

SEQ ID NO: 501906 - DNA, 253 bp, Homo sapiens
  misc_feature (15)..(15): n is a, c, g, or t
  misc_feature (82)..(82): n is a, c, g, or t
gcccggctaattttnctattttttgtagagatggggtttcatcaagttggccaggctggtctcgaactcctaaccacaagtnatcctcctgcatcagcctcccaaagtgcgaggattacaggcacgagcccccatacccagcctatccttctttaattactgcctgtgtataagcttgaatgttaattacatatttgacagtcacaataagccatgagtttcgagcatatataattgggctatgggagccact

SEQ ID NO: 501907 - DNA, 252 bp, Homo sapiens
ttgagatatagaacatcttttcatctgcctattgaccatgtatgtcttctttcgaaaaagcctatatacatccttcttccttttttaaaatcacgttatatgttttgtgtgctattaagttttattagctctttatatagttagaatatcaatcctttatcagacatgtagttggcaaatactttattccattttgtaggttaccttttcactctgttgattgtttccttagctgcacagatgctttttagt

SEQ ID NO: 501908 - DNA, 1017 bp, Homo sapiens
caaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaagccaaaagatgatgacaacatttttatcagtattggtgaataaacttgaacacaaatacacgaagttccatgtcatgtcttcagttggtagaagtttttcctctttaaggtaaagcgaccaacttgaactttctcgtggcaacacgattcgcagttatataagggaatcagggttccacgtctctgtatatatttatttatggtgtaactttacatggggaatggtacatatggtggagtctggtttaaagcctttttttttcattaatctggatctggttaacctctggtgaagggggtttggaatcttccctattagttctccaggtgggtccagggtacggatttaagaaatccagtgttggggggattttttctcggggattcatgaatttagccctgttgtacgcttgttaaagggtgacaaacagctggacaaatttttaacaaagtaacaataaaattttatctataatcagtattagtacatttagctttccatggaaccgaaagaaaaaaggtgatatgggaccccgggaaagatttggaaacttgagtgggttggaatacccttctatgtattggagggaagacaacacacaacagctcaatgatatgccagttgtcctccctttaaaaagcttcattggagccactaattgaatatgggtcttaaacccagggtataggaaatttccctatatgtgtaataatataaccagctcacaatgtgtgtccaaaagaaatttcacacattgcgggacccggggagaattcgggattacaggggcatttggaagaccatatacgtggcatgaataaaattagtctggaaaagtacaagcgcgacaaggtattaaatcctttgtgtgcccataaataact

SEQ ID NO: 501909 - DNA, 370 bp, Homo sapiens
  misc_feature (283)..(283): n is a, c, g, or t
  misc_feature (298)..(298): n is a, c, g, or t
  misc_feature (322)..(322): n is a, c, g, or t
cagacaggtcaccggcgagatcagccagtctattacagcactctacacgaccgtcagagtggcattctatagcacaagtccttacgggagtactgtggagggtgaatcaaagcttccagtgtaagtttattgtctggcgaaaacaccagagccaaaaattccaccaaggccctggaaagactgaagtcccctctgtctcatacagtaatcatccatgagatctcccggagcctgggtgatcattacgcccatgatacctgaggcagcgtggactctgccaggngctcctctgacccanagtggagctcactttggagagtcngagctcatgggcgttagcacctaaggatgttgcttgaaaggcacagag

SEQ ID NO: 501910 - DNA, 975 bp, Homo sapiens
  misc_feature (36)..(36): n is a, c, g, or t
  misc_feature (244)..(244): n is a, c, g, or t
  misc_feature (287)..(287): n is a, c, g, or t
  misc_feature (289)..(290): n is a, c, g, or t
  misc_feature (292)..(292): n is a, c, g, or t
  misc_feature (297)..(298): n is a, c, g, or t
  misc_feature (432)..(432): n is a, c, g, or t
  misc_feature (466)..(466): n is a, c, g, or t
  misc_feature (472)..(472): n is a, c, g, or t
  misc_feature (482)..(482): n is a, c, g, or t
  misc_feature (484)..(484): n is a, c, g, or t
  misc_feature (535)..(535): n is a, c, g, or t
  misc_feature (552)..(552): n is a, c, g, or t
  misc_feature (581)..(581): n is a, c, g, or t
  misc_feature (585)..(588): n is a, c, g, or t
  misc_feature (599)..(601): n is a, c, g, or t
  misc_feature (604)..(604): n is a, c, g, or t
  misc_feature (607)..(607): n is a, c, g, or t
  misc_feature (609)..(609): n is a, c, g, or t
  misc_feature (613)..(614): n is a, c, g, or t
  misc_feature (617)..(617): n is a, c, g, or t
  misc_feature (640)..(640): n is a, c, g, or t
  misc_feature (735)..(735): n is a, c, g, or t
  misc_feature (761)..(761): n is a, c, g, or t
  misc_feature (783)..(783): n is a, c, g, or t
  misc_feature (794)..(794): n is a, c, g, or t
  misc_feature (804)..(805): n is a, c, g, or t
  misc_feature (811)..(813): n is a, c, g, or t
  misc_feature (825)..(825): n is a, c, g, or t
  misc_feature (834)..(834): n is a, c, g, or t
  misc_feature (872)..(872): n is a, c, g, or t
  misc_feature (905)..(905): n is a, c, g, or t
gtgacaccagttgctccagaaagtttaaggggtctnttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataaagcatggctttgtgcacagcccagtgtgggantacagctttgggatgaccgcttacaaagtcccgccccgctagnanncncatannttttctatatagccataaatgcgtatatatacccatagggctagatctgtatcttagtgtagcgatgtatacatatacacatccacctacatgttgaagggcctaaccagccttgggagtattgactggtcccntacctcttatggctaagtctttgactgtgttcanttaccnagttgacccngnttgtcttttaggttaagtaagactcgagagtaaaggcaaggaggggggccngcctctgaatgcggccncggatgccttgctgctgcaaccccgcccncgcnnnnccaccgaaacnnnaanccncntttnnaancccaagccccccattacctgggnctgacaacatagaatggggttgagagaagatccgtttgggcttcacagtgtcatttgaaaaccttttttgttttgttttgtaattattgtggaanactttcaagtgaacagaaggatggtntcctactgtggatgagggatgnacaaggggatngctttgatcnnatggannntgggaggtgtgnccagaaagnttgtctgtagcgggttttgtgagagtgaacactttccnctttttgacaccttatcctgatgtatggttccnggatttggattttgattttcccaatgtagccttgaaatttccaataaactttgctctgtttttctaaaaa

SEQ ID NO: 501911 - DNA, 264 bp, Homo sapiens
gaactgtaagtccaataaacctctttcttttgtaaattgcccagtctcaagtatgtctttatcagcggcatgaaaacggactaatacattcttcttcaccttcttcaatgattataagtttcctgaggcctccccagctttgtggaactgtgagtcagttaaacctcttttctttatgaatggcgcagtctaatacaccctctctatgcatattccgggatgcagttcccccgggcaatcctcatcctgggagggtacgagctc

SEQ ID NO: 501912 - DNA, 103 bp, Homo sapiens
  misc_feature (57)..(57): n is a, c, g, or t
aggatccccgacaccaaaccctgtaggtggcctgcagtaatgttagcggttaggcgnttggtcagggctattggctgaatgagtaggctgagggtttcgatga

SEQ ID NO: 501913 - DNA, 366 bp, Homo sapiens
  misc_feature (98)..(98): n is a, c, g, or t
  misc_feature (364)..(364): n is a, c, g, or t
agaaagcctgttgctattctgatgcaccgcctcccccggcccccccctcctccccacacacacacacttaaatttttaatccttggccaggcacagtngctcacacctgtaatcccagcattttgggaggccgaggtgggcagatcacctgaggtcaggagttcaagaccagcttggccaacatggtgaaaacccgtctttactaaaaatacagaattagctgggggtggtggcacatgcctgtaatcccagctactcgggatgctgaggcaggagaatcacttgaacctggggaggcggagtttgcagtgagccgagatcgcaccactgtactccagcctggggtgacaagcgaaactccatntc

SEQ ID NO: 501914 - DNA, 669 bp, Homo sapiens
gtctctaattaccaccgctacaggacaatataaggcttcaagattgctcagcactatgtgaagaggaagaagatgaagatatatggaagaatatgaagagagtggattgttggaaacagatgaggctaccctagatacaaggaaaatagtagaagcttgtaaggcggtgaagatgctattttgcaaaccagaacttatgacctttacatcacttatgataaatattaccagactccacgattatgggcaacggcagcctttaacagttgagcacatgtatgaaaacatcagtcaggatcatgtgaagaaaacagtgaccattgaaaatcaccctatgtgttcagttcacccatgcaggcatgctgaggtgatgaagaaaatcattgagactgttgcagaaggagggggagaacttggagttcatatgatttgtacaagctgtcattccaacaatagaatatgactacacaagacacttcacaatgtaatgaagagagccataaatctatcctaattatttggctctgattttggacattgaccatattcatcaatatatacagtttctctaataggggcctatatgttatgccttaaacaaaatatggtccactaccagccttacttgttaataaaaacagagcgcttttgtccctttaaaggggtaat

SEQ ID NO: 501915 - DNA, 171 bp, Homo sapiens
tgcaggaccctgtggcagcaggtagggaattcaggtgaggacagcatgttgtccagcttggttctatctcatctgcctgtccttcccagggtgtcaccatgaccagagatctgtgtggccccacgtcaccacctgtggcctttgagatgagtcttagaaggtccaggtatg

SEQ ID NO: 501916 - DNA, 645 bp, Homo sapiens
  misc_feature (104)..(104): n is a, c, g, or t
  misc_feature (455)..(455): n is a, c, g, or t
  misc_feature (562)..(562): n is a, c, g, or t
tggccgggtggttgccccccgctggtcccccgggtgtgggggctcccctggccccgcccatgggtgagcgctgccgcagagctccgccccccctctcgtgccgnggctcttgggtctcgggggcggccggcccctcgggttccctgtcttattattaggtgttcccccgatggtgggccgccccaatctctggtcccacgcccttgttccccgcgttgcgttttctggcgtcctgggggcatatccgtttgtcttcctctctcttgccgcccgctggggttgttctctcttgtgtggcggctcgcggtgtgtccccttccggttcccccggtttgggggtattaaaagatgtccccctgtgtcccctaggttcctgggggtcaagggttccccccccaaggcaggggcagacccggcttgtgaggggggaggtttgtggaccaaggggcgggatnggcgccccggggcaaagggggcggccccccctctcactccctctttttttttgtgcctttttggcgcggggggggcttggcccgggggacccgggcccgttttttcnctcgggcgggggggggggttttttttttaaaaaaaaacgcccctgttttaaaaagaactcgagactagtctactctctctctc

SEQ ID NO: 501917 - DNA, 192 bp, Homo sapiens
  misc_feature (12)..(12): n is a, c, g, or t
  misc_feature (29)..(29): n is a, c, g, or t
  misc_feature (47)..(47): n is a, c, g, or t
attcgcgggcgngtcgaccagccgcagcngtaccaagcttcgctcgnacctcatcgctactgacaacagaagccaatccgctcaatccctcgatagggtgggctagaaactgagagagcccctccacatcctgcaagccaccttgggtgatacccaagccgatgtcgacgcggccgggaatttagtaggagt

SEQ ID NO: 501918 - DNA, 531 bp, Homo sapiens
  misc_feature (1)..(1): n is a, c, g, or t
ngatgtggggaaagggtgaatttttaaaagttgaggtttttaaacgaaataacctaaccttttaagaacgtgttaaaattcttattaaccccagtttttgggttaaattaaaacccattaattccccctccgtttggcaatgcttgagatttcataaagatgatcgaatcagttaagccaaagtaaaattctccctttttgtccttaaatgccagtgtagttgcaatccccatacactcaacttcacttaatcattagcttgagatgtctgctattacaatcaaaatcctaccaatcatccgagccccaactcgtatgctacattcttttgaaatgattccctctgtcaaaaacctttatgttgtatttctgtggggctttatagttctgttacagacatcatgttatgatttataagttattaatgtacatgaagaatcagaatcaaattttagggacttaaatatatgtaattcaataccttatccaatgtccaagcccttgacaagaagttatttatctaataataaa

SEQ ID NO: 501919 - DNA, 631 bp, Homo sapiens
  misc_feature (25)..(25): n is a, c, g, or t
  misc_feature (91)..(91): n is a, c, g, or t
  misc_feature (196)..(196): n is a, c, g, or t
  misc_feature (278)..(278): n is a, c, g, or t
  misc_feature (289)..(289): n is a, c, g, or t
  misc_feature (359)..(359): n is a, c, g, or t
  misc_feature (362)..(362): n is a, c, g, or t
  misc_feature (384)..(384): n is a, c, g, or t
  misc_feature (416)..(417): n is a, c, g, or t
  misc_feature (423)..(423): n is a, c, g, or t
  misc_feature (425)..(425): n is a, c, g, or t
  misc_feature (452)..(452): n is a, c, g, or t
  misc_feature (487)..(487): n is a, c, g, or t
  misc_feature (492)..(492): n is a, c, g, or t
  misc_feature (533)..(533): n is a, c, g, or t
  misc_feature (535)..(535): n is a, c, g, or t
  misc_feature (556)..(556): n is a, c, g, or t
  misc_feature (608)..(608): n is a, c, g, or t
aataacttaggggaatggaggagtngcggtggggagagcctaacggtagagtctcatttcgccctcacactgtcttgcacaatccccaggnctacctggaggttccacaggaagagcctgaggaggaggaggaggagatggacgtccggaagaaagggcctaaggtgtatcaccacgcactacttgccctatgttnatgccgctcccctgtggtgcgcgctgctgccctggccatgcccccttcttccctcacccctgtcttgtcagccctacttgcnggacgtgcccnggattcagcactgttctgcctccagggaaagggaggtgtaagtgaggctgggtgctgccagggttctgcnctnggctggaagtcgcagaagagcngtccaggggctggtggtcggtggagaaaactnntgggtnanactccagaggccacccctgggcctctnaggggggtctttttctttcccccatctcaggagancggtncccccacccccaccccccagtgccacagggactgtgggttncngaggttcccccggcttcaggnagggctggggtggtgggcagcggggcccaggcctgggagttaataaggaggncaggagggccctgtcccctctgg

SEQ ID NO: 501920 - DNA, 1560 bp, Homo sapiens
tttgctcccggagtgtgttctcttctctgttctcgcgtggggtggttacttctctcactttctttgtgagggctcgcccgcccgttgtgtggttcgttagtacctttggtctgttagtccttcacatgcctttcctgcggctgtgttcgcatccgtcgtggtgctcgcttccggggtacggttatagggccctcgtcttctcccctcgccctgttctcctcacttcggtggcttttcacttgtcactcgcttgggtctctctgtcttcgttttttgtttcagtcgtgaatatctgccgtcgtgccgaagtgcgtatacctgggggaatttttgaaaggggttctccttcttcccgagtgggggggaaccccctgttgttcgcatggcccactaagagggcaccacattggctgccctccttctgaagggcccttgtgcgtttaacaaacgtcgttgaagcgcgtgcttttttatagagcaactaaagtttctctccgaagagccgctttgatgcccttgtttccgggctgtcgttctctctacagggcggaacaccttctcagcgggggacctcactccagagagtgcgatggcccacgagcatctttgtgggagaaaccttctcctatggggttattttttttggaaacgaaaggcctccttcgtttgggtttcccccgtccgtgtgccgctctcgctcagtggacaacactgtgggggacgtttgtgggctctattctagttttgtctcgcctccccctttggggggtttttgcccgccctttgggtgcttatttctttaggtcgcgctttggggataattcgcgaataaagaatatgattgcgcacacgttgaccttggttaaggtagaactccctctcctctagagcgctatttgtctctcacacacactggctcactaaagaaattttctctctagcgcacacgctgtttttggaggtcctcacagcgcacaatgtgtgcgctcccccagatttgtctctcaccgatgtgtgtctcactccttgctggggactcgctgggcgcatcatacactcactctccaatagcacactgtctttgtgcgttctcaggcgcacacacattctttctgcgcccagagctcattggcctctaagaccccgcgtggagatgtggggggtctggtggcgccacacatctcctcggaggcgagactgaggcaccctatgccacacagagccacacacacagggctcctggcgccacacacaccacagctggcctccccacgcacaaacccacccgtggggttctagccctttatagcccaggctgccagggcgcacactcaacatccatagtttggtgatttgtctgtgtttgtttttctaagaaaatagatatccaaatatgctgcattggatatttgaaatattacctgtaactggtccagtgtacaaccagatttggacccccattccttgtgttacacccaaatttggtaaaaatgctgcgtctcagcctcccaccaatttaaccgcaatgggatttctccaaacaaaaaagaaaaaataaac

SEQ ID NO: 501921 - DNA, 615 bp, Homo sapiens
  misc_feature (615)..(615): n is a, c, g, or t
acagagtgtacaccacgcgcggcggggggcgcggcagaagtagcgccccccacagtgcgccgctgctgcgcgcaaccccaagccgacgccagcggacgaccaaactagctggtcggcagacagacacagacagcaggaggcaggccccaggcgtaaaacagcaggagcaagcgagagaaacaaacagcccccagcaacaccgggggaggtaccacccaagcacagacgaaggagcgccacccacaagggaagcgtacacacacgcggcgggagcgctaccacgcgcagagcaaccgcagccgcgccgccgaacaaggcgcccccacacaaccccccaccagcggcggcgaccacaagcaggaggccggaccccggcacacggcaggcctcagccacacccagtacgagcaggagagaaacaggaagagacggcaccgccgccaccgccacgcggtcgagacacccgggggagacacgaaaaaagccacgcggggaccaaccgggccgtggacaggcacgcggcgcccacccaccggcagacggagtaagcgcccaacgcgacgcacaccaaccgcccaggaggcgcacaacgggacacagagaacggcaagacan

SEQ ID NO: 501922 - DNA, 119 bp, Homo sapiens
ctattggcaagctactcttgacagacacttactggtggcaacatgttgtctgacttactgtttcaacaaaccagcaagacaagtaactgtatgcagttaataaacgccaaagggaaaca

SEQ ID NO: 501923 - DNA, 275 bp, Homo sapiens
acgtaaaccaatgaagacaaaagcattgcgtaagttgcgtcaccttgcttataagtgatataccaaaggacaagtgacgtgatacctgttacgatccaagcgtagtaactttcacgctttttgaagaatgtaagcagccaccaactgttgctgttgcgaacacaagtgcgtctactactggacgtggaccatctgtaaggcgtccaatcaggatcgctgacacggccataaaccagaccaaccgcttacgtacacccacctttaggcaagccacc

SEQ ID NO: 501924 - DNA, 178 bp, Homo sapiens
tcccgtttttccaaaaaaatgcaaaaattagcccgggttgggggcccaaccctggggtccccgctacttgggggggtgagggggaaggaaagcttgagcctaggggatcaagggtggggggagccatgcttgcccccctgccctccccccttggcaccagggggggtttttttcccca

SEQ ID NO: 501925 - DNA, 369 bp, Homo sapiens
tctctctctctctctctctctctctctctctctctctctctgtctctctctcactctctctctctctcactctcactctctctcaatctatctctctatctcactatctatatatatatatatacacacacacacacacaaatgtaaaaaaaacaccgagcgtataaataaacacacatacatacatacacacacacatacacaatataaataaacacacaaataacagcgccaaccacacacagagacatcacgcgcgcacgcacacacacaaacacgcacacacacacacacacacacacaaacagaatcaacacaaagaacacagaaaaagccataaaaaaataccccaatcaagcaacaacaatc

SEQ ID NO: 501926 - DNA, 320 bp, Homo sapiens
cgggaaggagacgctgcagccgcgggaacacccaaagacacacggtgacccaccatcccggtctctgaccatgaggccaccctggggtgctggggccctggcttctaccctgcggagatcacactgacctggcagtgggatggggaggaccaaactcaggacaccgagcttgtggagaccaggccagcaggagatggaaccttccagaggtgggcaagctgtggtggtgccttctgggagaggagcagagatacaggtcccattttcacaaggggggctccggagccctcacctgagatggagcctcttccgagccacat

SEQ ID NO: 501927 - DNA, 313 bp, Homo sapiens
ggtctctagctgtgccttgtcgttgaatgggaccatcgtttgcgatcgatgccaaacgtgtaagaattatgccgaaagagacttccagctagcacgccgcatacgtggagaacgtgcttaagaatccactatgatgggaaacatctcatactcaaaaaaaaaaaaaaaattactcttctacctgtgataggaagttctgaacgtaagatatttatataccatggggtcacaaggtacctaagtatatgattgcgagtggcaaaataggggacagaaatcaggtatgggcagtttatccatttacatttgtgtg

SEQ ID NO: 501928 - DNA, 214 bp, Homo sapiens
ggcagattcacagacgctgctagtcagcttgcagttttacctcgaaagataacagagaattatagtcaaaccagtaaacaaggaatttactttcgaaagattaatccaactgaaatctacccaaacttactcatccaaatatggataaaagtcagcagtgatacattctcttctgactttaggattttcataaaaatatgtagtaggtggatca

SEQ ID NO: 501929 - DNA, 81 bp, Homo sapiens
ctagaagattcagcaaagtacttttgtgctcttggggaatactgggggatagaggaaacctgggacacccgacagatgttt

SEQ ID NO: 501930 - DNA, 153 bp, Homo sapiens
cctatgtctcgatcgttaagtaaatagagcacatggtggccggtgcgcggtgtgctcacgccgtgtcatcccagcactgtgggaggccgaggcgggcggatcacccaaggtcggagttggagaccagcctcaacgtggagaaaccttatctct

SEQ ID NO: 501931 - DNA, 353 bp, Homo sapiens
ggattgtgggccgggcacagtggctcatgcctgtaatccttgcactttggggggctgaggagggtggatcacctgaggtcaggagttcaagaccagcctgagcaacatggagaaaccccgtctctactaaaaatacaaaattagccgggcgtggtggcacatgcctgtggtcccggctactcggaaggctgaggtaggagagtcacttgaacccggtaagcagaggttgcggtgagccgggatcgtgccattgcattctagcctggggcgataagagtgaacttttgtcccaccaccaaaattaaataaattaaataataaaggaattatgggccgggcacagtgggcttaca

SEQ ID NO: 501932 - DNA, 868 bp, Homo sapiens
  misc_feature (63)..(63): n is a, c, g, or t
  misc_feature (584)..(584): n is a, c, g, or t
  misc_feature (649)..(649): n is a, c, g, or t
ctatttgctactaaggtcacgttgtgtagtcagagcaagtgcaacaccgtttacttaccgcanagtttgtgcctgtatacacatcgaagcacagggagaggaaaagacaacttttgtcttcctctttggagtctggatggaaggacaaaaagaaatgacttacctaaggaaaatatttcccacagcagaacaccaaaagaccagacgtcactctggattgtgtacactctgtctaaaattgtttctggggccattcatttcaaatggaggcgagcctacaggggtaaaagacatggattaagaaccccaattaccaaatctcttgaagaaaaaaacttcctctgttcctgaacacaagtcctgaagctctatacaaggagtgttaactttgcaacttaaccaagtactgggtttatatttaaaatttacattttcttttttgaagtatttttgaatttttattaagcctcccgcccaagccatagttccatgatgttagccgacgttttataggctatccgcttatttaacgcctactaaatccatctccgctacgtcacacaaagaatcatgatgagacctanagatttggttatatgtgaccctattctcatcattttagtaagctatggatgtataataaaagggnttatgtgtataagtcttttggtcttaggtggtagttgtgtttgtatatgttatgaaacggaaaagtactggtctgtgtcagctgaggacgaccagcagaagctcggactttgagtcgtattcgagcgtcatagggcctcggcgatccaggccccgagcagccggtctacgtgcgaatgtttcctgctccgcgagatcgattacctgacaggcctagcgt

SEQ ID NO: 501933 - DNA, 187 bp, Homo sapiens
aagccaaacagtgaatactctgctgtgtcgcaacgggatgagactatctagtgaaggtcttcttgcattcactgccttcaaagagaatactagatatgagtactctggtgtttagttacaatcaagctactgtggctcaaacgatttcccacgattcatacgcaggtactagggtaaactactacca

SEQ ID NO: 501934 - DNA, 150 bp, Homo sapiens
  misc_feature (101)..(102): n is a, c, g, or t
ttcttgttaacccatttatgcctagtgttccattattggaatgctaagcttgtgggagtcatttacatcctactgctcaaagtcattccagggttgatttnnactgtcatcagttagccattcatcacacaacacaatgtggtttttaag

SEQ ID NO: 501935 - DNA, 105 bp, Homo sapiens
ccgttctgctccatgcatcttctgcatctcaggctctagcacccctctgctcctatgctggtccacatgacagcacttctggctccttctccagctcctcctctg

SEQ ID NO: 501936 - DNA, 163 bp, Homo sapiens
atctagagtgatcccagctgagataggaatgaatacaattacctacaataaaaaggaaaaactcactctacagttaggggtaataatcttttcactagagctcatcttaaaaattagaattttcgctctccctcgccctctccctctctctaacctttacacg

SEQ ID NO: 501937 - DNA, 264 bp, Homo sapiens
aataagctggtctggatgtcagtcgctacgcgatggtcggggcactttgtgtggccatcgtggacaggccgactccctcttccattagccatcttctatcccccacactgacagaaggccatgtcttcactgtaaactggcactgcagtcctacaagcttgatggtactcaggtgtgtctacaattacccagaagaaataaggagacattttaccccatattttgccacgtatctcatacctcccctaaaatcaatcctgacca

SEQ ID NO: 501938 - DNA, 1123 bp, Homo sapiens
  misc_feature (477)..(477): n is a, c, g, or t
gccgggcgcggtggctcacgcctgtaatcccagctctcagggaggctaagaggcgggaggatagcttgagcccaggagttcgagacctgcctgggcaatatagcgagaccccgttctccagaaaaggaaaacaaaaccaaagagacaaaaaaaaaaaaaaaaaaaaacaaaaaaacactgtgtgtggggcgcgcctgggacccggaaaaaggttttttaaaacccattcgcttggggcgcgcgcgggcccccagtagggttaggggaacactgtggcccacaagcggtgtccccgaagagaaacccgcggcgccatgcacacaggcggcttgggtttccccccaaataaaaaacgcgccgcgggggaaaccacagggcgcgtttctggggaccacaactttcccgagagtggcagcgtgcctgagaggcgaggccaaatcaagggggcgctgtatcacacaacagggaggtgcccanaaggcgagagggtcacgatatattcaaaaattaaaccgccgccggcacggaggtgagtagaaagaacacaaatagacaactactaatcaaagacataataaccaacagataaatagacgacaacgcaacaccatctctactaccgatcagcgtcaaacgacgaggacaacgacgtgacaaagatgacagacagaagagaagaagaaaacgcagtagacaaacaaagaagagaacaagagaagacatacaagaaagaagacagagcagacacgaaaagagagacgagcacgaacaggacagcacagctgagagaagagaaaacaagacaggaacgacaacacagacaaaacagaagacagcgaagcagatagacaagagattgaaacgacactatcgacagccagcatcacaccacaacgacagcacgaacagaaggcataggacacacgagagacacaagacaaactcaggcacacaaacacaaccagcagaagaagagagaggagaacgacagacaacacacacagcaacagagcacgacgcacgaaagcaatcggagactacgtcccatacacacacgaagaaccagagaatacagaccagacacgacacacagacaacagaccagaagaccagagaaacaaaa

SEQ ID NO: 501939 - DNA, 333 bp, Homo sapiens
aatagctggacccagtcgggcggcgggaacagttcgccttcccaccacaccgtgccggcctcgagccgcgtcacgctcggtgtccgacatctgcggcagcaccttgcggtagagattgaagatcggcgtcgacagcaaggcgcgcctgaccgggcgcacccccagcaggacgacggccagcagcgcgatgacgatcagcgcgacgatgactgcgtacatttcctttgtctcctttctcgaatttctcttggaacccgccggaccggccggggggactccctcttagagtcggaccttgcagggctttcaaggctttggcactgggccggtcgg

SEQ ID NO: 501940 - DNA, 272 bp, Homo sapiens
cccccggtttggggggggccttgggccctttggtttcccctcccccttttccgggcccctcccccccccgtggggcccccctgggggccgggccccgggaatcccttttttttttttggttgggggtttttttttttttttaaatggttcccgggggttttaagccccccaggttcccccccccgggggttttttttcccccccctgggtctttttttttccgggttttttttccggtttttttttccttttaatttttttggaacggttta

SEQ ID NO: 501941 - DNA, 159 bp, Homo sapiens
cccttctctatccgtatgtgtctgtcactgtatccgattccagtgtatctgtgtggggttgggtctaatagactgcacacgtaacgctgcttcagactaacacatcagatggaggtggtgctgactctctcacctggattccacgtggcatcgcctggg

SEQ ID NO: 501942 - DNA, 387 bp, Homo sapiens
cccaggaaccttatatcctagattccgggggcagaggatgatgttgaaggccttctgggccacttaaggatggtggccaggaaaggtcctgttgatctggccctgattaagggttatcgaaggggggtgattgaaggttcaaatgggggccagtctgcctataacgttaatctccatgttctgggaggtcggcaaaggcatgggcctccgggttaagcccgtttgggggataatttcctcttctttaggcatggattaagttaggcaatttccagtttgttaggtaccacactaattttggcctgggattggagggattcaggaattatttttaaaccgcgttccatattaaaggccattgttgcatggttaatagtcaaaaaaaaa

SEQ ID NO: 501943 - DNA, 853 bp, Homo sapiens
gcctgggcaatggcgggcgcccctcccccagcctcgcgtgtcgccttgcagtttgatctcggactgctgtgctagcaatcagcgagactccgtgggcgtaggaccctccgagccaggtgcgggatatagtctggtggtgcgccgttttttaagtcggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgtgcacagtgcatgcacccactggcctgcatccactgtctggcactccctagtgagatgaacccggtacctcagatggaaatgcagaaatcacccgtcttctgcgtcgctcacgctgggagctgtagaccggagctgttcctattcggccatcttgggtctggattcggcattacatgtcttaacgggaaaaatcaactcaagatggattaaggacttaaacctaagacttgaacactataacaaattctagaagataacattggaaaaacccttctagacattgacttacgataacgtatttcatgaccaagaacccaaaagcaaatgcaataaaaacaaagataaataactaggacctagctgaactaagagcttttgtgcagcaaaaagaacagtcagcagagtaaacagacaagctacagagtgggagaaacatcttcaccatctatacactctgcacacaggactactattcagaatcaccaaacaacacacatcaggaaacaatctatcaaaagtgggctaggacataagagacaatctcacagaagatctaa

SEQ ID NO: 501944 - DNA, 330 bp, Homo sapiens
tttgctaaccatgttagcaaactagacggtaggtctttggtaatccttccgaagagccatcattaagactaaactaatagtctcattattccttccaccctattgcctctgggtcatgttacaaggaatgccatcattgagatcactctctgtgtggctctgtggaaacctaccatctggcaggtgacagttgccattattaaaaaaatgggactaacaagataataacatagaaattgtggcaaagttgttttttaataaaagcattgagctatggttaatttttaaaatccacatccaaaccttggcacttggagatgagctataaag

SEQ ID NO: 501945 - DNA, 398 bp, Homo sapiens
tatccccaacccggcacgcctttgcgtcctgaatggaatcatccacccgtccctcattctgcgtctggaaggaagctcatccacccatccctcatctgcgtctggaaggaagtcatccgcccatccctcatctgcgtcctgcaggatgtcacccgcccgttcctcatctgcgtccttcaggaagcatccacccgtccctcatctgcgtctggaaggaagtcatccacccgtccctcatctgcgtccggaaggaagtcatccacccgttcctcatctgcgtcctgcaggaagtcatccgcccggtcctcatctgcgtcctgaaggaagtcatccgcccgtccctcatctgcgtcctgcaggaagtcattcagccgtgcctcatctgcttccttcgggac

SEQ ID NO: 501946 - DNA, 638 bp, Homo sapiens
tctgagccggtacccctaggtccttaagcccaagggtcccttaacagtcagactaatcccctgtatgacgaggactataagtactaacctcatgtaatgaggtttaagagaaggcccagcactaaggcaggctctcaggacaagattcaaacaacagttcctctttgcccttcaatatagccccttctcatctgtcatgggctgaagaaccactggacctgtgtgtcatgctcataggtataaatccacagaccaggtgaaggcctagatggcaaaacacatgggctttgtgactccactactgacttccaggctaaggaaggactgacttagtgagctgttccaagaccactgagctcatggttccctgtggctgggacctccatcatgaccggggcttgaaagagggtactctgttcccgctgccacatttggaacagtatgacggctgcagcagaggccaaaaactaagtgatcagccccagagagtcgatgggggacactgacaaaccaatcacaaagttggtgccattagctcttagggaggagaggtggggcctgggcaaggacagcagctggagggtgaaacgcagacctggctctcagtagcggtagtgatccggcttaagggaccttgg

SEQ ID NO: 501947 - DNA, 316 bp, Homo sapiens
tgagacagtatctcgcactgttgcccaagctggagtagagtgacaccatcttggctcactgcaacctccgcctcctgggttcaagtgatttcgcctcagccttcatagtagctgagaccacagatgtgtaccactatgctcagctacttttttttacaaggggggtgaggcagggcgtggaaatggaatctcattctgtcgcccaggctggagtgcaggaacacaatctcgggtcactgcaacctccacctcccatgcccaagcgaattcttctgccttaaccttccgagcagccgggaccacaggcaacagccac

SEQ ID NO: 501948 - DNA, 933 bp, Homo sapiens
agcgcgatagtgatcggaagcgcgcggtaccagtagagaagcttcagtgacgtgcagaccacggtagaaaagaaaatcgagcgggtgacaaacgcccgacggcgcttgatcatcggtaaaacgcagcctggacgcagcgacgattgtcccgcgcaaagcgatataacgcgttcatccttctacggctccaggcattgaaagtctccgcgccataatgaccgggccgctgtggtgagactatctagatcgccaataggaagtaactgcttactatagacatccacgcccagactgaagttgacggcgtgtatattaaccaccatcaacaggcggagtgtcaggtaatggatagaccgtcaccagtgccgacttcgccagacgcaaaatgggttctcgttcacgtaacgggcagcaatacactggatgtgccgccgaaacgggtcattacgccagacggactgtcgtggcagcacgcaagcgggtacctgatcggcggcaagatagttagcggtcgaaactgtactaactctggcgtcgtctgaagcttcctggaatagcacaagatgtgcatcttagccagaagttctataatgacgacaacattcagcgcgtgatgtttgtatatgttccacaccaggaatcgaaaacgctattcggtacttaagggtcccaggggtaatgctgtcgaatgtctgaaaagaccggggaagatccattcgaaggttgacggaacaaaaggaagtggacagcggattacacatttgactgtaaccgttaaggaacctccgatcgagggcaatagaatagactcagactctccaacccatgtttctctacagtctctaattatatagaaactaacgcggtaaaactttggcaccacgtcgagcaaatctaatacagaagcaacataataaaaaaaaggaaaaagag

SEQ ID NO: 501949 - DNA, 192 bp, Homo sapiens
agggatggaaggtggtgttaaagaagagggaaggggccaggcgcagtggctcacacctgtaaccctagcactttgtaaggctgaggtgggtggatcacttgaggtcaggagttcaagaccagcctggccaatatggtgaaaccccatctctacttaaaaaaaggaaaaagagcgaaaaaaaggtcgtatcga

SEQ ID NO: 501950 - DNA, 231 bp, Homo sapiens
tctgctgactactttgttggacgacgcgacgcagttcctgaccggagcctgaccagacttttccatgaatgtgccggacgtcgggcagcgtctatatcaccttgaagaagtatgacggtcgaaccaaacccattccaaagaaaggtactgtggggggctttgagccgggagacaacaagtgtctgttacgcagctcaccgcatgggcaagcacagaagcatcagcactgtg

SEQ ID NO: 501951 - DNA, 253 bp, Homo sapiens
gccatcttggttaaaatactgcattggttttttctagcgtgtgtgtcttgtggggaatgaactgcactgatctgtattgactttgtaataaaaatagggctcccaccacctcccccatttcttgtgtcctttatttgtagcatatgcatgtcttgcaaggttagcccctaagacccctgtagaagactatagcttgcttcagttgccccatttatctctactgctatgattggattgttgactgcatggactg

SEQ ID NO: 501952 - DNA, 257 bp, Homo sapiens
taatgaaccgagcctgtcgggcacctactgtgaaaagaccgatgaatctaggctcaagcactgagcaatcatttcatattgctctccgtggagtgtggcgaatccggtcagtacttttacagcccgtggggcatagcgatgattatggtatctcgacgttaaatatgctcgtgtgtctacgtttattcctactgtaaatatattgtgtgctcacacgataaaccctaggaagccaattgatatcatagctcagatca

SEQ ID NO: 501953 - DNA, 419 bp, Homo sapiens
ggattacatggcatacgctactgcacctggccagagtgcaacattaaaaaataaaaaaaaaagattgttgacggcttttaaattcacaactcttggagacattacaaaccttctgttatctcaggcacttggaaaatctgaagctccaaagaaaagagggtccgggggtaggacatgatcaattccagttatgtaatacacttacatatgggaacaccttatatagtgcttgaccattttatagaacattttttacttctgtttaaagttaacatggatattggtgccagttcatcgataaggttctgaaatctagaaatataggtggttcctctcacttacacgattattatgtaatatacttgagcttaagaatccaagattctggatagcattgttccttggggaggctgaggagg

SEQ ID NO: 501954 - DNA, 2279 bp, Homo sapiens
atgtaaacatgtcgaaaaacctatcaacaacagttccttagtttcaccacttcaaaaaatttattctagtgtcaaatcccacattttaaataaatacagaaatgattttgatgattctccatttctcccacaagaacaaaaagcacaaataagggaaaaaccgtgtgaatgtaatgagcatggcaaagcctttagagtgtcttcaagccttgctaaccatcaagtaatccacactgcagataacccttacaaatgtaatgaatgtgacaaggtcttcagtaacagttcaaaccttgtacaacatcaaagaattcatactggagagaagccttacaagtgtcatgaatgtggcaagctcttcaatcgaatttcactccttgcacgacatcagagaatacatactggagagaaaccttacaaatgtcatgagtgtggcaaagtcttcactcaaaattctcaccttgcaaatcatcacagaatccacactggagagaaaccttacaaatgtaatgagtgtggcaaggtcttcaacagaaatgcacaccttgcacgacatcagaaaattcatagtggagagaaaccttacaaatgtaaggaatgtggcaaagcattttcagggggttcaggccttactgctcatcttgtaattcacactggagagaaactttacaaatgtaataaatgcggcaaggtcttcaatcgaaatgcacaccttaccagacatcaaagaaaccatactggagagaaaccttatgaatgtaaagaatgtggcaaggtcttcaggcacaagttttgtctaaccaatcatcatagaatgcacacgggagagcaaccttacaaatgtaatgaatttgggaggccgaggcgggtggatcatgaggtcaggagatcgagaccatcctggctaacaaggtgaaaccccatctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaacaaacaaacaaacaaaaaaaaacaaatgtaatgaatgtggcaaagtcttcagttacaattcacaccttgcacaacatcagagaatacatactggagagaaaccttacaaatgcagtgactgtggcaaggtatttagtcgacttccgtgccttacacgacatcaaagagttcacactggagagagaccttacaaatgtaatgaatgtggcaaagcatttagagactgttcaggccttactgcccatctactaattcacactggagagaaaccttacaaatgtaaagaatgtgccaaggtcttcaggcatagattatccctaagcaatcatcagagatttcataccggagagaaaccttacagatgtgatgaatgtggcagggacttcactcgaaattcaaaccttgcaaatcatcacagaatccatactggagagaaaccttacaaatgcagtgaatgtcacaaagtctttagtcacaattcacaccttgcacgacataggcaaattcatactggagagaagtcttacaaatgcaatgaatgtggcaaggtcttcagccacaagttatacctaaaaaaacatgagagaattcatactggggagaaaccgtacagatgtcatgaatgtggtaaggacttcactcgaaattcaaacctggcaaatcatcacagaatccatactggagagaaaccgtacagatgaaatgtgtgtggtaagatctttagtaataattcacaccttgcacagcatgagagaattcattcatgagagagttcttacaaactgagtatggcaaactcttcatgctaagttctagcattaatcaacatcagagattccatactaaagagaaatcatagcaatgtatgtgaatcaggtctcttgaggcctgccaaatgactagatatcaaaacatacatcttggatgaaaccatacagatggattatgtatgctgaggctattattcaaggaccattactatggaacatgataagatttacacaagcgataattcagtctctagttctccaatatttatgatactgcatgctgcagaaaagtcacagctccaaatacgttgaatctcatgacgcgatgcatgtcgaaggtccaagggcatgtggaaatggtcagttatattcaggcaattaaaaaacctaattat

SEQ ID NO: 501955 - DNA, 197 bp, Homo sapiens
gccccccccccggggcccgaaaaatttttttacctttttttggggctttcttttcccatttgtgggggcccgggttttttttaaaattttttaagggtcccctttgggcccgggggcccaggggtagggggcccggggcctttttttttggattttttccccaaaggggttggcccccctttttttcccccttgaga

SEQ ID NO: 501956 - DNA, 205 bp, Homo sapiens
cagtaggtgtgtcatctagtagctaatgtggcaaaatctgttgaatgagactcggagtcttggggaggccagagtcgtcatcatcctgattccacctggttccgtctggtttgtctcttcctatagcttcctcctcttgtctccagacctttcacttctcgatacacgaactccagttcaaggagggttcctgtaattagggttt

SEQ ID NO: 501957 - DNA, 1152 bp, Homo sapiens
ccggggtgggtgtatgcgccagccccaccgcttgtccctccttttcggtcgcgggtgacacgtgggaagggcgcctccctttacgtgcgcattttcgcctcgtgggtgggctcctgtgaatcccccctaatctcccaattcctctacttctctgaactccgctcgtgccccaccgtttgaccaccaaccgttcccccccagggaggttcctgtgaaatgggccccttggtgtttgttggcccgtcctctttcatttgggtataaggccccttttgagaatccccgggcgccccccacaagggagggtctgccaagatctccccacatgaacgttgggggccaccctcttggaagggaatttttgataagaggggagaaaaccctgtcacttcacacggggaaaatatacttagttggaaaaagatccacgagaccactctgggggagaaacgcttctcgcacagggatacacagggcttctctgtggaaacaccacggcccaactttcaactctcacggtccacgtaagccctctctcacgctgctgggtaaaaaaagagcttggatttcgtgcttacctcacaccgcgcccccactcgtaaaaaatattagcccctcctggtttaccccactcgtgagacagaatgtcttctctcgcggaagaaattctcgagcccacattggtgccctcgattagggatctcacaaggaccccacatgggaaaagttttcctcgtgagttattcgtggcctgttcccacgctcacaccttccgtgccacaccacggccctgttgtggacccaattgtggaataaattcaggcttcctctgtgagctggccccaccactgagccctgggaaagaggccacatgcacttgccaatttgacccaacacatgcactgctggcctggttttaaagacactttctccaccccaagctatcacacttgtgagcccacgtgtttattttgcccacgtttaacttcttaaatgacacctctttttgggccccgagggatgtaatatttataagaaaatgtgagttcacgccccatattctccttttaatggccaattatagcgccgcatagcaccttctgtggttatcccaactaaaatttaaatactccccgtttttttactccaaac

SEQ ID NO: 501958 - DNA, 448 bp, Homo sapiens
tgatgtaccccacaagctgcattcaaactcaaatctgtgggaatgagtgactcgacaaaatgtaattcggatcagatcctcatcccctgactgtgtgaaaaaagtactctccttctagtgaaggattgtcacagagtttcactggatgaaactatgacccagtattcttactgtattttacatatgcctgtaaattatttgcaaaaaagaagaagaagaggaagaaagaaaagaaagaaaagaaggaaggaaggaaggaaggaaggaaggaaggaagggagggagggaaagagagagagagtataaaaaaatgtgatcacatggaacccaccaatctctcttaaacacacacatgggagacatgcccaattaagtatcagagagccttctatctgggacatatgtgcccctagtgttacaaacacctttgatgtacactgctgaggta

SEQ ID NO: 501959 - DNA, 896 bp, Homo sapiens
ggtcattgacgccatgagcgcgctgtgcggtgtgcgtacgggtgccccagccgctgcgtgcctgcgggttggggaccagtgcaggaccgggtcgcgccgtgatatggcctgtaccacatctgaggagcgcgggccagccctgtcgcgagaaataccgcctctttctttaagaatgtaactggtcactacatttccccctttcatgatatccttctgagggtgaactctaaaagaggaaaaatggcattccctatgaaggacaagcacgaaaatgattgcacatctgacgactctgttaacatactgatcgtacgaaataccctcggggggacaactttgctaaactgcagacttggccaccaaggaagacaaatgacttcccatttaaacaaatattgtaacaggatctggacaacgcctacgcctatgtggccgaatattcttccctttaccaagggtccctatatctgccacttatgggcacccctccctcagactttgcgaagatccccatgcaaaagatcagagcccgaacctgctttggcgaatcagtggatcctattggagtggtgcgcgacaataggggctcaaaagatttcttcccctcggtggggagaaagttcatccaatggtgcaaggatcccttgggaatttggggctctttatgggctcgacgcggggcaaccccattgggcacattaatgggctcatccatgccgaattgatccctgaaagccctcaagaggtgcatggcatctggcctgctggtaacaccgtgtcaccacggggttacctgggaagcctactctcaagtgcagcatcttttagcgcccccctgggcaaccgcacacccttgcttcagggaatccacacaggttgtgcgcggaggttaaccc

SEQ ID NO: 501960 - DNA, 114 bp, Homo sapiens
ctcggaattcacggttactccatgtttggtcaggctgttctcaacactcccaacctcagtgtgatcagcaccgttctcgtgactcccaaagttgttgatcaccacaggtgacga

SEQ ID NO: 501961 - DNA, 123 bp, Homo sapiens
taaaaggacacaccacgggaaagagaagggtcacgcggaagagaagcagaagccccaggctgagcggaaggaggagaaaaacggcggctgccccttgctccttgagtgaggagattcgctcac

SEQ ID NO: 501962 - DNA, 300 bp, Homo sapiens
  misc_feature (224)..(224): n is a, c, g, or t
  misc_feature (258)..(258): n is a, c, g, or t
cctgtttttccctcttccagctgacctgtgacttatactgctcttaccgatgatacttttggaaaaaatagagcgtgtatgcaccgccccgtttgtcccatccgactcacaccccaggatatccatgggacaaacggccctgtttatatttgggtctttatgttggtgctgccaggtctctgagctccagaggtggcctcttggacagatctactgctataggnataaaagacactctgtctcgcaaatggctgcttntcaacaagcccaaagatgcttgtcggaggacggttatggaag

SEQ ID NO: 501963 - DNA, 212 bp, Homo sapiens
cgaatcgcatcaggcagcgccgagctggcgcgccatggcgggcgacttccacacctgcccattgctctgcgcaatcagcaccgccaacccaccttggcggtgcgccaaggccttgcctggcatcggcgcccatcaccatgatggaggcgcccaagccattgacctgtgccaccgaagatgcgatcaggctcacgccgtgcacgcccgtggtg

SEQ ID NO: 501964 - DNA, 685 bp, Homo sapiens
  misc_feature (292)..(292): n is a, c, g, or t
  misc_feature (311)..(311): n is a, c, g, or t
  misc_feature (317)..(317): n is a, c, g, or t
  misc_feature (319)..(320): n is a, c, g, or t
  misc_feature (333)..(334): n is a, c, g, or t
  misc_feature (338)..(338): n is a, c, g, or t
  misc_feature (348)..(348): n is a, c, g, or t
  misc_feature (350)..(350): n is a, c, g, or t
ggagccaccaaaatggtgtgtcgggtatgaggctgggactaagccaagggattcaggtgtggtgccggtgggaatgaggaagcgcccaagctttttgtctgaactcccatgcgttgtgattcctgaggatgggatgactgtatcttgattacccggagtctgggcatataccatgtgctccctaaattatgagcgaatgtggaataaaattctaaaggttttcaagatggcagcatctatgcatggtcagcccagtccttctctagaagatgcaaaatcagaagaccaatgntcatagaaatcatagaaanaaattngnnactatcttagaanngaantgacacaaantntatatcaaatggcgacattttggaacaacagctggtttctctggaatattctcaaacttcctgtcagacgcttgcttcaagggttaaacatgatgcttgtgaaagaccatatgcatcatgtggctacacttccattttggtctactgtggttactgacaaggcttttttgtaatgcgagtgctttgtatcagatactatagcaaggaaaacgtggtgttcccagaagctcactgatgtgccatagcttgggggttctatcccagttcttggggttttactaaaaatggcgcctgcaacccaagtatccatacggtcaagtggccaccaaatggag

SEQ ID NO: 501965 - DNA, 904 bp, Homo sapiens
ggaggcttgtgaccagcatggtccagatctctaccccaaatttaaaaaatggtgtgactgacttactctctttatagcccatcgtggcagagcggcggggccacttggctggtactcttttcctgatgatcttgactctccgtccaaggcaggagcgctgtttcgcctctgtacacgagctgtgccagggctgtagcttccttcttacattcccctggctgaacaagcactgtgcatgactcattcaccccccaggactaagctgtggcagcagctccgcaagaggacgcgctatgtagcaatctacactctgctgctatgatcggggccaccaacgctttggccctcttcactccagcgatccagcaattgacaagtactcttgactgtctctgaccctctacactgcccagcatggcgcagctacatgcactcccaccctccagagacattccaacagaacgcctgccctactgcgcagtcctacgcacatccaacggcgacctgggtgacagctcgcacgcacggccgacacgggctgcgcccagggcagccagcgcacgggcaccacgatgtgctgcaccaccatgccacctgctccgagcacctcgccccccgacgctgcccagaaaccccgctgcccttaagatactttttccactcctgtcacactaaccatcgttgcgccacgcatgataatcctggtaagcgcatgcatgctcccggtcgaagcacatggcttccacattgtgctgcatgagtcgactctcacacttaagtatacacccttcatttattccatccctatctgtcatccccctgccacagccttacaccatcagggtcaacgcgagccccccacgccattttgcgcctacggccttatacctaccctatacgcaac

SEQ ID NO: 501966 - DNA, 752 bp, Homo sapiens
  misc_feature (359)..(359): n is a, c, g, or t
  misc_feature (378)..(378): n is a, c, g, or t
  misc_feature (384)..(384): n is a, c, g, or t
  misc_feature (386)..(387): n is a, c, g, or t
  misc_feature (400)..(401): n is a, c, g, or t
  misc_feature (405)..(405): n is a, c, g, or t
  misc_feature (415)..(415): n is a, c, g, or t
  misc_feature (417)..(417): n is a, c, g, or t
ggagccaccaaaatggtgtgtcgggtatgaggctgggactaagccaagggattcaggtgtggtgccggtgggaatcgtgagggaagctgcccaaggaaagtgatagaccaacgatttccaaaagtgaacttaatcttgtcatgagaaacgtgaggatagacgatgtcaataagacagcctcgtgtttccgtcctccccacctgaaggagctaggaggacaagatacaaagagcctgagctgccttctcggaatgaggagacgaggaaaacaggaagcagtatcagttttcaagatggcagcatctatgcatggtcagcccagtccttctctagaagatgcaaaatcagaagaccaatgntcatagaaatcatagaaanaaattngnnactatcttagaanngaantgacacaaantntatatcaaatggcgacattttggaacaacagctggtttctctggaatattctcaaacttcctgtcagacgcttgcttcaagggttaaacatgatgcttgtgaaagaccatatgcatcatgtggctacacttccattttggtctactgtggttactgacaaggcttttttgtaatgcgagtgctttgtatcagatactatagcaaggaaaacgtggtgttcccagaagctcactgatgtgccatagcttgggggttctatcccagttcttggggttttactaaaaatggcgcctgcaacccaagtatccatacggtcaagtggccaccaaatggag

SEQ ID NO: 501967 - DNA, 474 bp, Homo sapiens
  misc_feature (126)..(126): n is a, c, g, or t
  misc_feature (292)..(292): n is a, c, g, or t
  misc_feature (360)..(360): n is a, c, g, or t
  misc_feature (439)..(439): n is a, c, g, or t
  misc_feature (469)..(469): n is a, c, g, or t
cgggaggatcgcttgagcccaggagtttaaagctgcagtgccctgtggttgcacctgtgaataactgcactccagcctgggcaacatagcgagacctcatctccaaaaaagaaaacaaaaaacaanggaatgatgttctgtagagatggcctttcacttgaggagtactcagttttcagttcttcctagctcggggcttttaaatttgaatctaaacattcttcccaccatccttttgactgttgacctggttttctctctaagtttctgtccctgctgctccttacttttnttccttttgaatctatcttatctgtctttgttcacttttaagctatatatgggcagggtgagagacantactgagcacctggtgagcaagccggcttaaagatggagaagagctctggcaccagaaccctgtcttcctccagttctnaacacggtgttgctcttcagtcaaccgggnctggc

SEQ ID NO: 501968 - DNA, 158 bp, Homo sapiens
  misc_feature (55)..(55): n is a, c, g, or t
gtccttcccacacagatttctcaagagggatcctctgagacacatgatgcggatnggctttccctttaatcacataaagtcatggtgtcaaagcccgctcagcgtcggcggctgctggaagttgacgtaggcatagcccaggtagcggcgggtgatca

SEQ ID NO: 501969 - DNA, 145 bp, Homo sapiens
tttaatgggccttttcccgattacttaaaaagttttatgtcttttatgaaatgtttgtcaaactctttgaattataggggctttggatattcagatgtttaatttttatttgttaccccaattacatatatgtttttcctgtcca

SEQ ID NO: 501970 - DNA, 708 bp, Homo sapiens
  misc_feature (37)..(37): n is a, c, g, or t
aatgagttgatcccatattcattattaataactaacncagcacccaggagctgccaagagcattcttcagctccactcaaatgcttctaactgaccctcctaagaaaatgagagcaaggggactagtgtgaatgacttacttctggctgagggtggctactggtgccttactgctgaatgttctagggcctgttttgggtagcaaagtacctggtccatgggaggatattcttgtccttatctttgtcagcagatttcccaagaaagcccccaaatgttgatcaagacagaaaataggccttttttgtcttttatggagatacactgtttaggctgatcagaaatgtctggtgatctactgcccggactatattaagccattttctagaagataggatattaatttaacaccacttgggcatattaagaaaattggagaaaattagtagtgagaatccagaaatcctcctttaacaagcaaggcacttgaggcgtctgtttaagggttcacagcccctgtctgtgtggttagatctgcccctgctcacttgactgccggttcttatctctaaatgcctttgggaatttacaatttatttggacttttggggggaattctctaatttatctgtgtttaaatgggtgctgtctcatacagtagtaagtttgcgtgagataaggtaacttttagaatgagagaaaaaaaaa

SEQ ID NO: 501971 - DNA, 444 bp, Homo sapiens
  misc_feature (412)..(412): n is a, c, g, or t
  misc_feature (430)..(430): n is a, c, g, or t
aggtttaaggtaggaggattgcctgagcccggaaggttgaggctgcagtgacccttgatctcaccactacgctctagcctgggtgacagagtgagactctgtctcacacacacacgaaaaaaaaacagtttagaattttggttccctttaaactttgagcttcttgaaaagaggagttaggttttatccatattttgcctccatctccatggtaacaagtatatatagtaagtactcaataactcataaatctattcatttaaaaattcaagggaaatttaaagctcatttgaaggttttttttctttttaattgttaaaaaacggataacatagccgggtgcggtggctagcgcctggaagtccccagcactttggggaggcttgaggcagaagggttactttgagggccnggggttggagaccagccnggggccattttagc

SEQ ID NO: 501972 - DNA, 345 bp, Homo sapiens
tatcatgttccattgcttagtatcaatgcaacttctacttaggatcatgggacttgctaccgccttgctgtaccacttgacagtatggaatcttgcataaacacacctcagttaatgccccgtgtattaagagggaggacctgatgactgatatccaggatacttgtacttctaataacatttttcatgaatcatgagaaaatttccacagatacttcccttagaaaatctgctataaactctgtatcattggtagcacaaatttgagcgaggccttgtccattttaaggtggaaataggaaggaccacaacatgacccgtaagtccagcatcggcacatcagca

SEQ ID NO: 501973 - DNA, 257 bp, Homo sapiens
gagtcagccagccagccacatgcagctttgctgataaatggataccttttcacaccatttatgaaaacaaaatttcaactctgttgcctgttctatttaagaaaaattgctgtttctactctctgtatctgattttaaaaggaaaaaaaaattcacacctggctttcaggtaactgactttggattcttacaagcaaaggtcattgtgttttttcttgagtagatacctaataaattttgcttgaaagtaaaaaaaa

SEQ ID NO: 501974 - DNA, 380 bp, Homo sapiens
tgtgagcgcgctcctgtacctcagaatagggcactgtaaggtcagtcagtgaagtctctgctctaactggccaccggggcattgtcttctgacacagccttgcatggagcctgccatctgcaaaagagagttcactccttccgctatattcatgtgagtgtatccgatttccttgataaactccagttacatggtattctgccatttgggaagttttacacactccaaagatgttgccaatcatatcttctggtgagtagcccaaatgccataagtgagcatgaatcttgtaggctgcgtcaattttggcatgcacacagtgctgcatcatctcctttaccagcagtgggtggtgctcgtcacagacccttgaacacgtt

SEQ ID NO: 501975 - DNA, 507 bp, Homo sapiens
cagcatggtttaaaagccaaaaggtagaagcaacacaaatgcctttcaataaatgaatgaataaaataaaatgtggtacagggctgggcgcggtggctcacacctgcaatcccaacacttggggaggccgaggtgggcagatcacgaggtcaagagaccatccgggccaacatgatgaaaccccgtctctacaaaaatacaaaaattagctaggtgtgatggcgcacgcctgtagtcccagatgctaaggaggccgaggcaggaggatcgcttgaacctgggagatggaggtttcagtgagctgagatcacgccactgcactccagcctgggtgacagagcgagactccgtctcacaaaaaaaaaaaaaaaaaaaaaaagcgccggggagaaaaattaattggggatcctaggataggggatttaaatggaaggggaagccaagggaaaaggggtttcttaaaggtgtataaaacttggggggaattattatacattttctacaaat

SEQ ID NO: 501976 - DNA, 232 bp, Homo sapiens
ctgtgtcctggtgtcgcacctagtttacatcatagatatataactggttcaccgtaacaatgtggtggtagcaaccctttagagaaatcatctcatcaccagaggcagatgtgtatttaccttaacagctctgaaagcttcttccgattttgaaagtcttcgtgtattccaagctttatgtttttagagaactgttcatagaatttcttgtagttctctttatcttccgcca

SEQ ID NO: 501977 - DNA, 1103 bp, Homo sapiens
  misc_feature (532)..(532): n is a, c, g, or t
  misc_feature (543)..(543): n is a, c, g, or t
  misc_feature (564)..(564): n is a, c, g, or t
  misc_feature (702)..(702): n is a, c, g, or t
gaggagctgacgggagagatcacaaggccagtcatggatgaccagcgcgaacttatttccaacaatgagtcgattgccggatgctgtgagccggggccctggggtgcccacggagcatgcagagattggcaagcacaggggcagcacgctgttactacgagggcgttgtatccactggcgggatgaactctgcatcttcgacatggccaggaccaccagcggcatacattcgctgtacgcaggcacgtgagtggccgcgcttggtacaatagcgtgaacatgatcacgcttcgccacgcaatgcatgtcacgtctggggacgcaagcgcgtggcaggcgaatgaacgcattcacgcaacagccctccccaaagggccctgttgcacgtgagaagatttgcggcaagtaggggcaaccccacggcatgctggaatgccaatgggcgactgccgcacgagtggagtagactccttgcctgctagggggcgccgagtggcgatggaacttgccgaacacatggtactggctaganccaatggaccnaagagagacgcgatgatagantagcgacacgtgcctcgcgatgagagattgcgtcgagcgcgcgcacttagaatagggttaggtaacactcgagcaaaaccttgtataaggggagaaggcgttcccgcagggaatgaaacaccttagaggtgcatcccnttagatgaagcaagcgcaaatgtgatgacccgagtaggacctgggaaaggggttcctttagacagagcattggtagtggcaacgcacttttgggctctcagtggtatttagagaatactgaagctaggggcgaacctcgctttgggaaggcaaaaaatgcctcaccttggaccagcgtccgacccggaaagaagatgtcaagcttgggaacactggatggacgccggttctttctgtgcgactggggtgttgacccaatgccaggaattctgggggcccaagtcgcgcgcagtggttgaggatgccagccatgattgcggggtcatttcaacgagtccgtgggccaggggcccccagaccaaggctaacagctttggtttgctcccttttcagggcccccc

SEQ ID NO: 501978 - DNA, 375 bp, Homo sapiens
tcccggacagctcagagacgaccttgcccacagccttggcagcgctggtagaggcaggcatgatgttctggagagcccgggggtcattacgccacagtttcccggaggcgccatccacagtcttctgggtggcagcgatggcatggactgtggtcatgagtccttccacgataccaaagttgtcatggatgaccttggccaggggtgctaagcagttggtggtgcaggaggcattgctgatgatcttgaggctgttgtcatacttctcatggttcacacccatgacgaacatgggggcatcagcagagggggcagagatgatgacccttttggctcccccctgcaaatggtctaaatgcaatcaggggatcctct

SEQ ID NO: 501979 - DNA, 321 bp, Homo sapiens
cttttggggtctttgctcagtttcagctcactgcaacctctgcctcccgggttcaagcgattcttctgcctctgcctgttgagtagctgggactacaggcacgcgccaccacgcctggctaatttttttagtatttttagtagggtttcaccatatcggccaggctggtctcgaactcttgacattgcgatcctcccgccttggcctcccaaagtgctgggattacaggcgtgagccacaacgcccagccgaactatgggttttataattagaaagcagcaaagaccccaaaagagcaaagaccccaaaaggggtaccgag

SEQ ID NO: 501980 - DNA, 1601 bp, Homo sapiens
  misc_feature (435)..(435): n is a, c, g, or t
  misc_feature (669)..(669): n is a, c, g, or t
atggcacatgcagcgcagggtaggtctacaagacgctacttcccctatcatagaagagcttatcacctttcatgatcacgccctcataatcattttccttatctggcttcctagtcctgtatgcccttttcctaacattcacaagaaaataactaatataacatctcagacgctcaggaaatagaaaccgtctgaacttatcttgcccggccatcatcctagtcctcatcgccctcccaatcccttaggcatcctttacataacagacgaggtcaagggatccctcccttaccatcaaatcaattgtgccacaatgttactgaacctacgagtacacgataacgggggactaatcttcaatcctaacatatttcccccattattcctagaaccaggggactggactccttgaggttgacaatcgagtagtactcncgatttgaagccccattcgtataatatttactcacaagaggtctgtgcactcatgagttgtcccaacattaggtttaaaaaacagatgcaattccgggatgttaaaaccaaaccatttcacggctaacacgacgggggtatacctacgcgccatggtctgaaatcttggggcaaccacagttctgcccatgtctaagaataatccctaaaatttgaaaggcgatactaataacncttactcgagaaaaaaaaaaaaaaaatggggggggaaatacacatggggggcggtgaaagtagtcgtgtccatggcccagccgcgccgctacacgcgcgacccaccccacaccgggaaggcgacggcacgacgacaagcccagacagcgacggacacaaagaccagcaaagagaggcgaagaagaggtgaaggagagcgacaagaacgaggacagaaagagaagggcggaaaaggacagagcgagagagagaggaagagagcgagaagagaggagaagaacaggacagacagggggaaaaggagagggagggagcaggagcgaatcaaaaccagggcagagacaaggtagacaggaaggggggacggacgagtgacaaaaggcgcaagagagaagggagcagcgggaggcgagaggaagagcgaggggaacagcgacggaggagggacagcggcggaagggaggaggacacaggcaagagaagccaggagaaaaccaagagaagagaacaacggagccgaaggaagggggcaggggcacaaagacaaagagaggggacaaaggaatgcgaggcgaggagtagagacgaagaagagcgagaggacgaacgagagaggagaaaaaaaagagaagggaggaagaaaagagaaggaggacaaagaagagaagaaaagaagagagagagagaaaggacagagccagaaagaagagagaggagggaggagagcgacggagaagagtagagaaggggtacaaagaaacagagcagaggaaggagaacaacggatcaacgcaccagcagacgacagagaacaagagacacacagaaaggacagacgggaggaaagtagaaggaggaaacacgggcagccaggagcgagaaaggaacggaagcaagaaagaacagacaagaaagagaaggataaaagaaaa

SEQ ID NO: 501981 - DNA, 141 bp, Homo sapiens
aagaatacaggaagagtatgtaacaacgtatctagtgtaagaatagatgacagccagtgcaaatgagtttaaataaaggcttactgcatgagaaacccagtggcctacgcaaagagaatttataatcaacatggttacctg

SEQ ID NO: 501982 - DNA, 644 bp, Homo sapiens
  misc_feature (2)..(2): n is a, c, g, or t
  misc_feature (114)..(114): n is a, c, g, or t
  misc_feature (255)..(255): n is a, c, g, or t
  misc_feature (317)..(317): n is a, c, g, or t
  misc_feature (326)..(326): n is a, c, g, or t
  misc_feature (355)..(355): n is a, c, g, or t
  misc_feature (358)..(358): n is a, c, g, or t
  misc_feature (386)..(386): n is a, c, g, or t
  misc_feature (480)..(480): n is a, c, g, or t
  misc_feature (523)..(523): n is a, c, g, or t
  misc_feature (531)..(531): n is a, c, g, or t
  misc_feature (545)..(545): n is a, c, g, or t
  misc_feature (557)..(557): n is a, c, g, or t
  misc_feature (562)..(562): n is a, c, g, or t
  misc_feature (569)..(569): n is a, c, g, or t
  misc_feature (573)..(573): n is a, c, g, or t
  misc_feature (606)..(606): n is a, c, g, or t
tncacagcaaaggcctcagtccagaacacaacataggggccagccgggatcacaatctggtcaaagctctgggagccacactgggaacaccactcccggggttgagtggcaganccaggactttgcagcaactgtggccccagacataacacaaggcagcagccctctcccacagaggcacaggaagctgacacccaaggagcacgtgggccggggacaggacggagaaggctgccgggcagtaacttggcgganatgtggtccagcaccactgccgcctgcgtctaccacactcaggccaggaagcccaggcctgngactgagcnctaggcccagctctacccagtgcagagcngcnggagtgccacagaccctcagcagccccntgccaacagaagaagtatagaggtacccagcctgcccctcggctacatgaacaagaaaggggcctaaacttcggacctggccaaggcatagaantgcccaggaaggaccggaaaggataaagaggccagccccccancaaaccantcccaagaccctantaggacacgtgngagancgcccantagngacaagtaaaggctcttctgacggactcccaangacaaagggccacacacgcaggggtgagagcccctcaa

SEQ ID NO: 501983 - DNA, 208 bp, Homo sapiens
ctctttttttcgggccccgggaacttttttttttccttccaggtaaaacccttcccccttccccccatgggtttttcagtttcccgtttggtttgttggggggttccccggcccccccccccccccctttcccccaggggtggtaaggtaaaatttttttcccaggtcaagaaatttttaaaaaaacgggggctttgccctcttttta

SEQ ID NO: 501984 - DNA, 107 bp, Homo sapiens
tcagtatgattagtcattgttgggtggtgcattcagtcggttgttgcatgcagcatcatttgtcaggtggggcaggttcagttgtggccaatcacagcaatgcattc

SEQ ID NO: 501985 - DNA, 350 bp, Homo sapiens
ccccggacccctggccttggaggggccctcccgcccccggaatttgctttggagggaaatgtttttttttttcccggggatttttttaagattgggggatggtgggtcctccccccagctgcaaacctgccccttccgccttatttccgatccccctgggtgggccgcatttttggttccccgcctgggtttataaaggggcctgggtgtggcctgtttttcttttaccccccccagggtcctttggggttttggggggcccctggtgggggcttttggggtggggttccggtcctttgccgaaaccccctttttgggtgcttttttatttaaacccgccccccccccca

SEQ ID NO: 501986 - DNA, 989 bp, Homo sapiens
ggacgcgtgggtcctggtataaaaaaagacacatagatcaatggaataggtaagagaacccagaaataaaggcatatacctacaaccatgtgatcctcaacaaaactgacaagcaatgaagtaagaacttcattcaataagtggtgctggcataactggctagccatatgcaggatattgaaactggacccctatccttcacgatatacaaaaatcaactcaagatggattaaagacttaaatataaaacctaaaagtattaaattcctagaagaaaacccaggaaatgccattctggacataagtgctggaaaagacttaatgatgaacaccccaaagcaattgcaacaaaaacaaaaattgacaagtgggacctaattaaactaaataacttctgcacagcaaaagaagctattgcagactacagaatgggagaaaatgtttacaaactgcatctgacaaagatctaatccagaatctataaagaactcaaacaaatcaacaatgagaaaaacaaccccattaaaaactgggcaaaggccatgaatagacctttctcaaaagaatacatacatgtggcaataagcatatgaaaaaaatggttaaatatcgctaatcattaaggaaatgcaatcaaagccacaatgagataccatctcagacctgtctgaatgggtattatcagaaggggtattattaaaaaatcacaacatagatgctagtgaggctgcagagaaaagcaatacttatactatgtaataattcagccttgtggaagcactggcgattctcaagactaaagcatagctcaggcagcatccatctggtgttccctagaataacttccccaagaaactgttgttctgggctattccatacaaggcgcacacggagcccacgggccccaaaaatgggaccagggacagggccaaacacgcctcgataggggccaagaaaaaatatcctaggataagccaacaatgggaaac

SEQ ID NO: 501987 - DNA, 459 bp, Homo sapiens
  misc_feature (421)..(421): n is a, c, g, or t
cttacgtatggcatcccaggactatgggacgacaaggcatgtggatcacctgatatctgcagagcgtgaccagcctgacaaacacaccgccctggctctactaacattcaccgaattagcacaggtgtggagaggtgcgcctgctaatcaagctactgaggaccatgctgcaggataatctgtcagacctggaaggcagaagtagcagcgagctgagaccgatccactgtactgacagacaacgagctggactatgcctcactgctgtattcacggatgtcttcagcctatgctagctgtgaattttcgtctgatctatgacaccgagggtcgctctgctgacagtctgttacacctgaggagccacgtacatttgtgcaaggtgagaatgatctttgaggcacatatggagtctctgatntcgtgactcatgatgcccgcatgcgttcccggtcccct

SEQ ID NO: 501988 - DNA, 181 bp, Homo sapiens
cccccccccctttccctttttatgtcagtctgggggggtttttttttcttggggggcatggttggattataagtcattcccccccctctcccggcccccttttttttttggggggcctgatttgttttgctggggccccctgggggtgggggccctttttttaaggtttgccaaccgggga

SEQ ID NO: 501989 - DNA, 850 bp, Homo sapiens
  misc_feature (479)..(479): n is a, c, g, or t
gatagtcgcttcgagactggagctagacttggggacgaagtgagttgggccacacggtgtagccgctctgaaaattgtatgcaagtgagagcgtactaggaaaggtggacaggaagagaggcggcgattgcaagccatctcgtaacactcagcaccatacacagcgtcacactgtaataatcgacgattagattttgttgtgccagacatgcttaggctcctaataattgtgtagggctatcggaccttgggaagatggctcgttgttgaacactagaagtgcatcaagcagccatcctcgttcgatgttaagatcgcgacatgtactatacatagtaaggcgtcctatgcatctacgtgcataatagcgtgtatagtgcatctctccttacgaacaagtgggtgtatgcactcactgttcccatgactgagggttgtgctttccatggtcatatcctgtgagattttacattagaatngacttgggagggagtaacctaccgcgtaatctaatcgttggacccattaaatggcattggacctcgtaatgtaaacctatgcgtcttagtgtggcctttcggacagacagctgatacataaacacactatctgcttacaaaggactcctttcgcatagataagatacagaccataggagagacaatacaaataaagaggagtcggggggcaagcggccaactccaaaaagtagacgacatcaaatcggcctcatccccaaagggaaggcggggcgtcccgcaacaacggtcccctaataaacggaagccgtgagaaccccccccagtagggaaatttcccactggtgtcggtaacaccacaacagggcggg

SEQ ID NO: 501990 - DNA, 683 bp, Homo sapiens
ggaggagtgcggaacccgcgggagagatccccagggagacacttaagggaaattaaactgcagagtgcaagagatgcctcagtcaagtcagccaaaaacagcgcgggtcatccgccaagctccagagagtgacagagccccgatgacacggacgacctcgggtgctgtcacttccctggttcagggcctcccacaggctttgaattggaacggcgagtgcctcagaatttgcgatccatgtgttctgtcttgtcctgggaagttattcatcctggtggtcaggccactcggacaaaatggattcggatctactggacctgaatcccagaattattgctgcaattaagaaagccacacgctgaaatcgcgtacaaggaggttttacagcttttctggaccagacttgaagagacatgaccaatcctcgtccagtccccgaggtctggcagcttgctgagaacgggctccttacacttgcggggaagcagcatgcttacagcactgcagactgcaccagcagaaggagcggttccccacgcagcaccagtgcctgagcctgggctgccggtgtctggacgcgtctgtccgtggtggctgccctggacggtatcactgagctggcggacgcagctcggcagggaagacccagctggcgctgcatgtctgctggtgtgcagttcccg

SEQ ID NO: 501991 - DNA, 169 bp, Homo sapiens
  misc_feature (3)..(3): n is a, c, g, or t
tancgtagtaggatgtacgtatggattcgccagagcgctgaggtagtttacgaggtggaggcatgtctgttggcattgtttgagaacttgtccagctcgaggggaatgagaagcatctggaaccggagaatgtagtgaggggttggctggtgacattccaagcttgatg

SEQ ID NO: 501992 - DNA, 370 bp, Homo sapiens
gcatggcactccagccggggcgacaagagtgaaaccccatctcaaacaaacaaacaaccaaacaaactaaaaacaaaccgtagccttactctgggtaacgggtccaggggcatggcttggtgtggtttcttacaacctaccattatgaccgctaccaactactttcgggactaaccgtttacctacccgtgttctcctccccctactatacctaccacgtgtactaccgcgactacgtactttactcactacggtacactactactctacctgcccaacagcagacgacgccgtccgcctactggggcctttcctcgtacggtgacgacgacacacggacgggcagcacgccgggacgggacgcacagtg

SEQ ID NO: 501993 - DNA, 1054 bp, Homo sapiens
gctgtagttgatgggttagctggaatttcaaactgatcacctgtggtatgagagcaatgggtaactgaagctttatgggctcgggggacagtgtcacgtgcccacgtatgtttgtattcccatttatgtctcagttttgtttaacagttggctctaagttgaatgcagtcctagtgggaatctgcctcaggaagatgattgtagtttgtgtatacaggagatggtgccttctggcatagtagtgtagtccataaaaacgtatgcttcagaggcatttcttgcaggttgtgtaaatacagtagtgtttatctataaaacattctgaaggagcagatacttctgggaaaagggttactgtgaggactcaggtctacctgaggatgaaaaaagccccttgtgaaggggaattatgaggctctatcactgcagagaaccggcggacctcttatgcgagcatcagtctattgagataactttactatactcaattttctaatctataaatggccttgggtgtactgtgggccagacgggagtgagttttcatgacaagtggtattgaaatcttggaaatgtaactaactcagtattaggaaggccgttacatattgtgagaaaggtcgtaggacgttgagagtagtgtagaatttaaaatgagggtaggataagtcgtatcgaatctggtcgtatgacgttgaggtaagggtttagaagggagtggaaaggcagaaggaaatatgcccatgggagacaagggtacacggcacacagagggaagaataggacggacatgcctgatccaagggagttcaagtgaagggcgggaaggtaaaaacgggcagtataggccgagatgaaggagagaagggggcaccgtggaagaaacagggacggcactacgtgcagggaggcaccatagaggagaagaaagcaacaagagactacggaacacaggaggaagaataaagccacagaaggcatggggaaaccatgaaggcgacagggaagcacggagtaagagagcgggatggaaggagagaaaagaaacaggcca

SEQ ID NO: 501994 - DNA, 681 bp, Homo sapiens
  misc_feature (625)..(625): n is a, c, g, or t
  misc_feature (653)..(653): n is a, c, g, or t
  misc_feature (656)..(656): n is a, c, g, or t
ggaaacatgcagcatgtagtaatttatgacagcttctttcacttagcatgaggttttcaaagttcattgatgtggtagcatttgtcagtactctgtgcctttttatggctgaataatattttatcatatggatttaccacattttatcattttatttatccatcatcagttgattgacatttgagttgcttctactttttgagtattatcaataattctgttatgaacattcttgtacaattttttggtagacatttatcttcatatttcttggatatatacctaggagcagaattgctgcgtcagatggtaatgctgtttaaccttttcaggaactgtcagactgttctgaagtgggtacattattttacattccaaccagcagtgtatgagaattccagtttccccacatcctcatcaacagttgttattgtctgtcttttttattatattcatctgtaatgtgaagtgtttatctcattgtggttttgatttacatttccctgatggttgatgattttcaacatcttttcatatacttattaggcattatgtatcctctttggagaatgtctgttcagatcctttacctactttagaattggtttatctttttaatattganctggaatagtttttaaaaaatatatccnaanatacaagtctcttatcaagataata

SEQ ID NO: 501995 - DNA, 1267 bp, Homo sapiens
  misc_feature (1267)..(1267): n is a, c, g, or t
gcggagagattcgtatccctgctgcgtgggggtccctgtgagttccccgtgcccagaccagacccgcgtgggcgccctcagcagcccgcccgtcttgcactcggagagcggtcctggcagtgaatggcctggccagtgtgcaccctggttctgggcccctgcgccctggtgctggcaagatggccactgcccccagcagagactgtgctgcctctaggacaccatcggtggacctgaggaccagctttatccagtggactctaaccatttcccacccccttttggcccacactcacaacgaacaacacaccttcccacagtcttctacctctattacttggtctcgcccattgcccacaaatgccattccaaccaaacagaaataaaccaaaagtatcacaccaataacctataacactacagaatccaagggccatcaagctcaaagcaaatgaggttgtggatcatcaccataacagaggagaaagggaggaaggacaggaagcccaagagaacccagaaaggtaacacacaacacaaggagacgacacacagcgacacaagagacacagacaagaggccaccactacgcacacgtgacaattataagctgaaacaataataaccgacatataataacaattatacgtaatatcatcattcaccaacaaccacacatcctaaccatctccagtacccacacacacactaaacccaaaacaaatcctaacacaccccacacaaccacaaaaacaatcacaacactaccaaactcaaataccaactcacttctcaatcaacactatataatcacccaataacacatgcacaagaaacaaaaatacaatcttcacccactttacatacacccccatccgccagcatctaaccacctattcaccaatcttcatatgtacatcatgcgaataaataactcatgacaaatacaaactcaaaccaatagactataaatagcaccagcgccctacccaccacaccacactccaatctcactagtcattccttattcctctatacaccaccaacctcatcgatagtagacaacaatcacaccataatacacttccatctcataaaatatacttacactgaactaccgccatcaccctcaataccactctaactagatcacatcaatatctcttactagtattgacacagccacacatcacaccttacctacctccccacattctcatactcacctcatccacgtccaccatacatttaccactccacacgagtn

SEQ ID NO: 501996 - DNA, 947 bp, Homo sapiens
tcggccttggttttggtaaaggacccaggtatggctaatgtggcccaggcgggtctcaaatcccggggctccggcgtcagcctcccaaaatagcggggatggcgagcatttggaaccaccgcactcagcggctttttatataaaaagtagagatggggtcctctctcgtgttcacccaggcgtggaattgcaggggccaccatccgggctcacgtgcagcctcgaacctcccaggctcagtgcgatccttcccacctcgagcctctcaagcagccgggactacagggtgtgcatcaacgcacagaccagaccgcatttacatcactgcatctcgaggcaacacgggggcacctgggcggatgatccacccaagagagaggagacaccgaggggggcaccaaacaatgcgccacacagggcaaaccatcaaacccctcagggggcaccaacggtgaatctccaccgggccttgaagatgatccccaaagataaaggggggctacaaacggggggggtgaggccaacacaaacgccgggcatagtaggacggacactatagtagggaaacacaaggggggcatctcacacagtggttggcccccaggagcgggcccacgcaaaaacccgcgggcaccacaccgcaagaacgcctcccaacgagagggacaagccccaaaagggtgcggggaccacacaccgtggagcccgcgcagggggcacacccaaagccaccaaagagcgccaagtgtaggagcgggccccacacccgaggagaaagagactgccccagagaggataaaacggggaaaggagacggcccaacgtgacggcgccgcggctgtagagaacccccacaactctaaacgcaagtggccgaaacagcgcggggcaccaggggaaaagacaaagacaccacgctagcagacacacacaaacacggagaggtg

SEQ ID NO: 501997 - DNA, 245 bp, Homo sapiens
atccccggtctgggtacacagtttgcctagacaggctattccaaaaagtcatttgtttctttaattgttcagaaccatgttgtcagcatgaggcagtctggaacgaggggagggtaaagacaggagtctcccagtattactaacctggacagagcagagcattgccccgagagctgagagcctgagcaattgagcttcctttgattgggaggcagaagaaggatgccccagagtgaggaagcgag

SEQ ID NO: 501998 - DNA, 852 bp, Homo sapiens
  misc_feature (12)..(12): n is a, c, g, or t
  misc_feature (128)..(128): n is a, c, g, or t
  misc_feature (202)..(202): n is a, c, g, or t
  misc_feature (602)..(602): n is a, c, g, or t
ctccataatatnggccgccctcttcttaatagcccgcgggagtattattctccctctttggttgttttacgcctccctcgcaagacataggtgttttgtttttttctttctgcgcaacagaaagagantatttttctttgaagcgcgcacgttgttgtaacacacgctctcagacgcgctgttgtcgcgcccctttctctcnccctcacattttagtggagggggcacctctgggcgccccacaccactggcgtctctctccccccgcgttatattctctccctctaaggatagttctccacacgctctctctctgtagcacacactctcgctttgttttttcttctcggcctctacgggagggtgtttctcacttccccctcgtggggttcccccctcatggttgtgtatatatggtggagacccacccccgcgctcccccgcagtttatttgttctagcccctcgtctttgtattacccacttttttttctgggttgttctctatattatgtataccccgctctctctccacgccgctctctcgaggtgtcttgtctgaggtcttctccctctctacaccttttctggcgggggtatttnttcgggcggcacacatatttgttgttgaacaacaccgggtgtctccccgtagattctcaccgtccattatttggggcgcaacactttctcctccactattgtggttcgatcccgccccaccgtattatgtccccgttacactcgccccacaataccatttgggtctttcgaaccccccccccttttctgcccctttttaaaaatggttttatatttttttttttttccctttttttaggggggtttttta

SEQ ID NO: 501999 - DNA, 190 bp, Homo sapiens
gaatttagtaccatctctactaaataatacaaatttagcagagagcgttatggctacaccctgctgtttgcagctactcaggaggctgaggccggagctatcacttgaacccaggaagcagaggttgtggtgagccgagatcgtaccactgcatttaagcctggcatacatgagcgagactcctgttcac

SEQ ID NO: 502000 - DNA, 332 bp, Homo sapiens
gcctccctgggccacccaacacagacagtggtgttgccccgcattgggcccattgcccagcagaacctggctttgcagctggccgagaagttgggcagcctggtggagaacaacgaacgggtgtttgaccccaagcagggcccctacgggggatacttccgagaccagaaggacgggtaccgcaaaaacgagggctacatgcgccgcggtggttacccccagcagcagtttcagacggcctattgagctttccactttgtttcccgcctgggccatccaaccttgaagtcctaaaccacccctcagtcaataaaggtttgtttaaagttgga

SEQ ID NO: 502001 - DNA, 123 bp, Homo sapiens
ctcgcttgctcctcacgtcctagcttcatcaaacactggttcctggcactcctgtctgctgctgtcttcctagattctctgaatccacttctgtgtagcacctgggtcagttgtcaacttaat

SEQ ID NO: 502002 - DNA, 146 bp, Homo sapiens
atcactcgtcaaaagaggcaaacagcctggcaatatggtgaaacaccgtatctagtacaaatagaaaaatgagctgggcgtggtggcgggcacctataatcccgggtgagctcaggcaggctgaacgcacaagtaatcgctatgaa

SEQ ID NO: 502003 - DNA, 164 bp, Homo sapiens
  misc_feature (33)..(33): n is a, c, g, or t
tgagtatttgacaaattgtaaatgaacaccgangctgtcgctacttctttattcattgcgaacctgacaggactggacgcgaggacggggctttgtagaatgctttgctggtggtagctgttgttcctctcttgttttttcgagacgcctttttgtcaacataa

SEQ ID NO: 502004 - DNA, 956 bp, Homo sapiens
  misc_feature (383)..(383): n is a, c, g, or t
  misc_feature (387)..(387): n is a, c, g, or t
  misc_feature (478)..(478): n is a, c, g, or t
  misc_feature (555)..(555): n is a, c, g, or t
  misc_feature (938)..(938): n is a, c, g, or t
ctaactctctagcactaatgacttacctatctaatctgcccaccacaataaaaatgcagaattaatgttaaacatcactttgttcaaccagatcactctcctacttaagaaggtacacagactttcttctgccccatattttggttaaaatctccccgcttagttctcatagctgttagtccataaccttttgtcccccttcctccttgatgtacactccaggctttggccacctgacccttccccggccctatctcgtactctcccatgcctttccatctcttcttcattgggaaagcttaataattcaaccttcaaattccagctccacttctatctttccccacagagccttccaagatgatttcaccttcctttctacnactncagctactcagacagagaactacacggtttagtagcataaagctctttgtgtagtttcatctctccaaaaagaatgaaaacacttagcaancttgtgccttaaagctttctgtctccccctgagcacctaataggtacggcatattcatcagataaataatttaacangtattgattatctgtggtttcaaataatcgattatctgatgtcactcaaaccaatctaattcttatcagagattctgcaaatgataggaaaaatgcaagaggcattataaattagctataaaacagatatcccttattgacatattcctttcatactactcccacgtcatatacacatttttagttatccaggtagagctggtcagaaaaggtagccaaattatgttaccaaatggcaagtctttattccactgaggtacaggtcctcaaaattatacgaataacttgttttttttcggtggtgtctgtttctgttttttaacacggagtctcgctctgtcacccaagctgggatgccagctggggtgatctcgggtcacggncacctctggctccaggtt

SEQ ID NO: 502005 - DNA, 820 bp, Homo sapiens
  misc_feature (201)..(201): n is a, c, g, or t
  misc_feature (253)..(253): n is a, c, g, or t
  misc_feature (378)..(378): n is a, c, g, or t
  misc_feature (440)..(440): n is a, c, g, or t
  misc_feature (443)..(443): n is a, c, g, or t
  misc_feature (820)..(820): n is a, c, g, or t
ggaagtgaggatacttctggcgagcgccggttgctgtttcttctcaggctcagggaccggccgcggcccgtagggtgttttaactcaaatgggtgatgaaaaggactcttggaaagtgaaaactttagatgaaattcttcaggaaaagaaacgaaggaaggaacaagaggagaaagcagagataaaacgcttaaaaaatgnaagccatatttttttaagtaagtggttttcttaaaggagatttaatttcttngccctcatttttccattagaacaatacttcgatgaagttctttgtacttctaaatgtcgcaggtgagcccaaaatctattctaaaaattaacaaaaatattcaaatattcagttgacattaaagncagatttaacacactaaagctgtgtctagattgagcatacatggagaataaaatacgttgantgntaagtcattagcaaaactggactaatttttctcgtttcattattagtatattcataatactatctctaagtatttttaatatagtgggaactgcctgaaattaatataacctcttttacatctttcttggttgcatggtaatgtactcaggacacttttagtaattggggtagaggcctggcaaggactcttgtgctagattgtgctcattgggtgtcggagtcaggctcctggctcatttttgctccgtttgattccaatacggtggcaccgttggtttcctggggctgggctttgttgaggaccgggcggggccccccgggggaggcccccattttgcggcggggccccctggtcttcttttctttattcttacn

SEQ ID NO: 502006 - DNA, 816 bp, Homo sapiens
  misc_feature (197)..(197): n is a, c, g, or t
  misc_feature (249)..(249): n is a, c, g, or t
  misc_feature (374)..(374): n is a, c, g, or t
  misc_feature (436)..(436): n is a, c, g, or t
  misc_feature (439)..(439): n is a, c, g, or t
  misc_feature (816)..(816): n is a, c, g, or t
gaaatagcccagtgcccgggtcaggtggccttgttcgcgagcacatctcggagcatctccccggtctcaagtgttttaactcaaatgggtgatgaaaaggactcttggaaagtgaaaactttagatgaaattcttcaggaaaagaaacgaaggaaggaacaagaggagaaagcagagataaaacgcttaaaaaatgnaagccatatttttttaagtaagtggttttcttaaaggagatttaatttcttngccctcatttttccattagaacaatacttcgatgaagttctttgtacttctaaatgtcgcaggtgagcccaaaatctattctaaaaattaacaaaaatattcaaatattcagttgacattaaagncagatttaacacactaaagctgtgtctagattgagcatacatggagaataaaatacgttgantgntaagtcattagcaaaactggactaatttttctcgtttcattattagtatattcataatactatctctaagtatttttaatatagtgggaactgcctgaaattaatataacctcttttacatctttcttggttgcatggtaatgtactcaggacacttttagtaattggggtagaggcctggcaaggactcttgtgctagattgtgctcattgggtgtcggagtcaggctcctggctcatttttgctccgtttgattccaatacggtggcaccgttggtttcctggggctgggctttgttgaggaccgggcggggccccccgggggaggcccccattttgcggcggggccccctggtcttcttttctttattcttacn

SEQ ID NO: 502007 - DNA, 1090 bp, Homo sapiens
  misc_feature (316)..(316): n is a, c, g, or t
  misc_feature (430)..(430): n is a, c, g, or t
agcgggcgtggtctagctgcgcactgagtgctatgtgctacgcgctgggaatacgccacgctgggccattgagtctgtgcacaatgaagtacatcgagggtttattaccgccgggctgtccatgccaatcgactgcgctaacttgggcgaaagttccagtggaccgttgctgcgtagatcgttacggagacagggtgcgtcaatggtttaaggcccctatgacaatgggatgcgcagacaatgaaattacctaggagtgcatactaaagatcggtagcacagctatgaacgtgcccttttgaagcgtgtggccatnctgtcgtggacggaactgaaggcagtcattgtcgtcttaccagtagggtagtgaggctcagcttggaggcatacgaggaagacagttgatccagtttgacgagattgacagtancaagtggagtcccaaagactttgagatgacccggcaacaggttgagccaatgcaagtcttgcatcgcaaggaagccttgaatgacagttggataacacttggagctcaggaataaaaggtagggcaaccgtgaaagatgttagacacttgccatgcagtatgcttggcttaacccgcgttcaaaagaaggggtttactctgcacaatgggctgatgcccagcgcttcgtgtttgatagagcccaacaccttcataaggatgagcaccggagaaagactttacaagttagtgattggcggtacaacaccccactgagtccaaggttccctatggaacactccccactcaaacagtattttcggatccttcagagcaggggtttctagcaccttcggggaaggtactcaaaacacgccttatttcattttttttacacttgcgctaggacgttgttgtttgggaccctcgataggacttcacctttcctcgtgtgtcaagaaaaagttgattcgcctccgactcccgttatattcggggcatttccaaagcgctcacgtggtttccccaagagaatctactctttgcaattcccttcctttccggaggggccataccctacgagaaggaccaagacccaaggcattggaaagccaagtgatc

SEQ ID NO: 502008 - DNA, 358 bp, Homo sapiens
caagagtgaggatgcatgttcatgtactgggaaaggcagggctgggggaccactctggcttagttctcattataactcatgaaagtaagaggtcatgtttcatgaagcctgagagcttcacggaagctccagcctacctgggcaacctgtggtccatcttcctggaagccccgcccagctttctcccttgcgggaaacccgactgtgtcaggatgtttatccagattagttttctttgttaaagcacgttcttttgcagctttctaagaaaaggttttgcaggaggtaattttcggggtcttgtgcccctgttctgtccttggatcatttagccgggtatagcatgcaccattatgcc

SEQ ID NO: 502009 - DNA, 224 bp, Homo sapiens
ctgccttcctttgagctctgttgggccgcgggatcttagttttctttcgtctatttcccagctcattcttttcttctcgcacgtccttctaagggggggtgttgtggttttctgtctttgtttcgcttctgagaaagcattcgcctttcttcctctcccaacataacaatcgtggtaacagaatgcgactgctgatttaccgatgtatttaatgtaagtcaaaa

SEQ ID NO: 502010 - DNA, 277 bp, Homo sapiens
ctgaagtggtcttatgttttctgcctccagactctattttcctgcctcaatataatgggggagtctcttcaacaaattgtgttacaaaaactgaatatccatattcagaggaataaaactagacctctatctcttgccatctaaaaaaaattaaatcaaaacggattagagacaaatctaagacatcaaactatgaaactactacaaaaaacattggtgaaactctccaggaaattaaactgaacaaagatgtcttgagtaatacccacaagcacag

SEQ ID NO: 502011 - DNA, 423 bp, Homo sapiens
ggattaatgttggttgaaacacagcagctgtggagttcagtccaggcatgaagactacatctgcttccccaagtagggtgtcaggtcgcatgtttcagtcctccaccatcttgcgctgtgagcagcgctatacctgtgcgttgtctgaaagccttccgtatattctccagctaaatggtcgtttggtagcccttgcatttatcaaactagcatgaggccttctacctttgaatgctccgtgatagaccatttcagctagccacatttcgtatgtgtgagattcctaaagcctttctcctcgtttctttttctcccaactcctattttgtttggtatgtgaattccccttttgaaatgtatagtgaataggttgttgcactggtggcaattcctcatgtagcataataaaattaatttgaccca

SEQ ID NO: 502012 - DNA, 505 bp, Homo sapiens
agtcaatctagaggatcccgggggagacgggggtctcaaaaacaacacaacaaaaagacattccttaaatttagaaaagggagcccactggagaaatggagtaggcaaaagaaaaaatatctaagggtgtctaatggtcaagtactccactaaggctttctcccaaagccctacccttatccatttagggaagggctctcaaatcctccttctaaggtacacttccccgggggcatctggaacatccacatcgtggtctggcggggactggtttctgggggaggaatccttccagtcgggtcacactggagtctactcttcaggtacctcaggcaaaacgggatgggatgagaaaccaccattttcccttatttcttggctatattccatatatcggggagaaaacaaacctacctaattctctagcagggagtccttcagaaagttagtcggtaatcccaggcagtgtgggagggcagggggggcagatcacaaggtcaagaga

SEQ ID NO: 502013 - DNA, 147 bp, Homo sapiens
catcccgggaaagacgctatgatcctctccagtgggtacggatgactctgatacaagaatgcctgtgttcaaatcccaggtctacattatacagctgtgtggctttagcgccattaccttgacctctctgtgcctgggtttcctcat

SEQ ID NO: 502014 - DNA, 838 bp, Homo sapiens
  misc_feature (351)..(351): n is a, c, g, or t
  misc_feature (456)..(456): n is a, c, g, or t
  misc_feature (475)..(475): n is a, c, g, or t
  misc_feature (562)..(562): n is a, c, g, or t
  misc_feature (566)..(566): n is a, c, g, or t
  misc_feature (628)..(628): n is a, c, g, or t
cggcgaatacggtggggtatacagagaccagcagaatggccaccatgacgggtgggcctgagcttgacgatgctgtggcatatggatataccggatgaggtgcctcctgcaggacggatggatcttcatggtcctccttcaacggctattgtgccccagcgactgtgtacttttgatccctcatgcttggactgtcggattggatgctctcccgtatccgaatccaaatcgtagagaatacacatccaaacacgaagactagatagaacgggagatcgcaggaacgcgtacgctccttcggtcgctcattcgtgtgactagcgttgctcgtagagtgcggagcacatcatnggactcttcaatatgcacgtagtcagcacgcggtactcctcttcgtaccacaaaacattaacctgtgtcagtcagcatacagacgattgcactagcatgtagtcntgggagtcgtggccttgangtggcgctcatggtgcatcggtgctatggtgtcttgggcgtatgtgtctatgactgtgtaatttctccatgtcctggggtgtttccncaantagcgcacctatgagcatccctgtcgaggagaccgtgtggctaggtgtcgcacgtccctgtngcgggtgttttgtgctgtggagcaatccccacacaagagtgatagaaccgcgcaggaacgagagagcagtgttacgtgttgggcatgtcgggctggtcagctagcatgtcaactagatccagtaatatagccggaggagcgtccctagagtcccaaagtgagaccatcccttggtgcggtagtggtggataccatcggcccccaccataa

SEQ ID NO: 502015 - DNA, 133 bp, Homo sapiens
agtactcggcaccggttcgaggtgctgaaggcagctaagaacaagaaaaaaagaagccggcggggcgcgtgggggcctggggccaagagcgcagtcaggccgcgggccagaacaactccaacgcggcaggcaa

SEQ ID NO: 502016 - DNA, 265 bp, Homo sapiens
  misc_feature (39)..(39): n is a, c, g, or t
  misc_feature (47)..(47): n is a, c, g, or t
  misc_feature (52)..(53): n is a, c, g, or t
ggttacaaattacaacataaaaaaaaaagttgtatagtntaccaagngcagnnctcaggagggtaacgttcacactacaatatcaattgcaactcaacaagttctccagtcgccaaggagcttaattataatctagacactcatacgtctacagggaggatcaaggcagcctgagaagaaggaagcgcgtaatgtagaaagcaacagaaaaaaggaaacggaacttcttggttctttttctaaaaatgaatcagttccctttttc

SEQ ID NO: 502017 - DNA, 515 bp, Homo sapiens
gactcggtacatgtgcagaggaggcagacaaattcagcatgaagtgtgagaatcatatacgctactgacaatgatactgaaaaatacagtgacacatgagcaaatagcgaaggtacagaatcgctttagtattttgagcgcatcacttagaaatcactaatgtaactcaaaaaatttttggtgcaactaaacatagggcatctatcagaaagcaaggtatttcagttgccaaaacgtcgctgcatatactttttgacgcaatgtggatcacagattctagtgccagaacagtcaaatctcaccagtcggagacgagctcgttagtttaaaggaaaaatcaaagtcttcacagtgctctgatactgcacttcgaaatatatcaaaaacagtgacaaaaggggaatagaaataatagtaagcttgagaaaactactcctagcaaaagacaaatgtctgaagcatcacatgattgtaactggtgcagatagatacactatgagaagtccagtgcttta

SEQ ID NO: 502018 - DNA, 883 bp, Homo sapiens
  misc_feature (1)..(1): n is a, c, g, or t
  misc_feature (304)..(304): n is a, c, g, or t
  misc_feature (347)..(347): n is a, c, g, or t
  misc_feature (356)..(356): n is a, c, g, or t
  misc_feature (386)..(386): n is a, c, g, or t
  misc_feature (394)..(394): n is a, c, g, or t
  misc_feature (401)..(401): n is a, c, g, or t
  misc_feature (407)..(407): n is a, c, g, or t
  misc_feature (463)..(469): n is a, c, g, or t
  misc_feature (471)..(474): n is a, c, g, or t
  misc_feature (476)..(476): n is a, c, g, or t
  misc_feature (478)..(479): n is a, c, g, or t
  misc_feature (481)..(481): n is a, c, g, or t
  misc_feature (488)..(488): n is a, c, g, or t
  misc_feature (513)..(513): n is a, c, g, or t
  misc_feature (529)..(529): n is a, c, g, or t
  misc_feature (537)..(537): n is a, c, g, or t
  misc_feature (540)..(541): n is a, c, g, or t
  misc_feature (678)..(678): n is a, c, g, or t
  misc_feature (756)..(759): n is a, c, g, or t
  misc_feature (765)..(766): n is a, c, g, or t
  misc_feature (779)..(779): n is a, c, g, or t
  misc_feature (787)..(787): n is a, c, g, or t
  misc_feature (875)..(875): n is a, c, g, or t
nttggaaaagtcagcctcttacacaaggttttgtatctatacttttactctgtcaattacagtgggattttaaatgcattgaatataattcattgaatgtctatatctttctgcctcgatttaagtgatattaggttaaaaaaatatttacagttttcattctggtccaccttccctccttatccttatactgaatccatttctctacttttcaggtaagtgaaaggggtcacaaaatttttaggtttgtgtggaggggaaaaatgcatccagcaattctaagcacaacaattttctgtaaggncttctctgaaaaaagagaaggaattacttattaaaactaagcncacttagcnacttctttcccaatcctatctttattcgtntgcctggngccaaanttttcnggccctttttaatttgcaaaccttaaaaaaaaaaaaacaaaaaaacaaaacccccnnnnnnntnnnngngnnanacatagnactaagcgagagagcggatataaangggaccacggggaatnaaaggggnaannttccaggaaaaaaaaattccaatagcttcacagtttaactgaggttttggaaaaacttaagtgaattcagctgatgtttgaaatatctgtctacatttaattagatgtgttgtatttaccaaggaggcacaaatatntagttctgtagattttaatactaacttttccagtaagaaaaataataccaggtgatttcaaaaagggcagtgatctannnncccccnnaatgcatctttgnacaggggngcagaaatagctaatttaatgaaaacaaaccttaagcactttacttggcttctaataagcatcccaagaaaaggtacctgagaggggntgacaagt

SEQ ID NO: 502019 - DNA, 1460 bp, Homo sapiens
gcaaggtccagcctctcctgacctcatctacaaaatccccagagccccctggagccttggcctcccatggccagggatgtacctggctgcatggtgagggcaaggcatccaggagagccctggaaccagactgctagagacagaagaccgagctagaaagaaagaagggcaagagagaacgcaggtgcaacaacagggagaccgacaataaaagagaggaaccacaacacacaaaaacgagacgcgcaaaccacagaccaaggacaacaaaccacacagaaaagagcaaaaaaggcaacaagacagaaaacaaagaacaacacagaaaaaaaaacaaaaacaaaccagcgaccgaacaaacacacgcacaaaacaacgagaaagagaagaagaaagaaaaacaaatagcagaagaaaacaaccataggagcaagaggcaggcaacgcacgagaaaagagaggaagcaacaaaggaaccgaaggagagacgagaaaaaggagagaaacgaaaagagagcgcaccacgacagaacagaaaaagacaacaaaacgaagaaagaaggaagacagcgaaacaaacgaacaaaaggaagagaacaacacaaaacgagacgaagaagcagaagaacaaagaaacaggagcgaacgagaacaacaaacgaaaggcacagaaaaagacacagaagcaaagagaagcaacgaaaacaaaaggccagaaaaaccaacacaaaaggaggcaaacacacaacagagaaaagaagaacaaagcacgcgaagaaacgaacaagagagcaaggagaaaaggacacaacacaccggacaacaacagaccacaaaacaagcacaagacacacagaagcacccgaaaacagtagagagaccgcgcaaaacaaagcaaaaaccacaagagacacacaaagaacaaagagaaacacacaagcacaaaagccagaacacaagacagaacaaaagaaaaggagaagaccaccaagataagacgacagaaggacagaagagccacagagccacacaccacaagagcacagaaaccaacaaagaaggccgacagaggaacacagaaaaagacacaacagaagaacaaaacaagagaaggacagcaggacaccaaaacaccaacaagaccaacgaaagcagcaaaagagaagacgaaggggacaacaaaggcgaagaaacaaaaacacaacaagagaaaacacacacggacacggcaacgcacaaccacactcatcagaaaaagtgaaagaaaaacaaagaacgaacacagaaagaaacagtgacacagggaaaaagaagcaagagaagccaaaaacgagcacgcacggagcagcactacaaaacaaaaagaggagaaagagagaacgacaacaagagaaaaaacaagaaaagcaagagaaacaaaacgaaagacaggagacgacaacaacaggcaacgacaagcg

SEQ ID NO: 502020 - DNA, 386 bp, Homo sapiens
tattttggaaaatacagattttaaaaatcacacctcagtctcccaaagtgctgggattgtaggtgtgagccactatgcctggccgaaactgggtaatttataaagaaaaggaatttatttcctacagttctagatgctgagaaatgcagggtcaaggggccacatctgatgagtccttcttgctggtggggactctgccgagtcatgaggcagcgcagggtatcacatggtgagggcgtggagtgtcccttcaggagggcagactcagtgagcccaatcccaatcgtcttttaaagccctcgtctttcaatactgccaccatggggattaagtttcactgtgcgttttggacgggaccaacatttaaagcatagcactcatcttag

SEQ ID NO: 502021 - DNA, 1226 bp, Homo sapiens
aaggctggtacctgccccgggagttacgggcatctgcgcggctgtcctgggcgctctgcctgagctcggtggccgctggcagccgatgtcgaactgcgggagccgatgctggagctgccgcggcgcagtctggcctggcgaccaccagggcctgaggatgaagccaagtctgctgtgccggcccctgtcctgcttccttatgctgctagccctggcctctcgaccaccctgacatcaacaaccctttggcagtgcccacctggggaggagaccgaactggacccagtggcagggcacattatgcagtgccctgcacccaccaggaaccttactcagcatgcatggggctccagcccatgaacagcacaccatgccctgtatgcagcactatatggaggaggctggaggcccaggtgggcatggcaacatcgagatacactctgtggagactgctggccctgggtaggttatgggccttggaggtgtacaaacagcagtaccatgtcaagccaatgttatcctgaggcaaccctctggggataacatcaatggacatgtgactgacgttggcgagggcagcgagggaccccgcaaaaatggacacatgaaggggtggcacagacaggatgcacaacaaaaaagggatggttgaagacccacgaagaaagcaccttgcaagacaccggaaaaccacggggacaaacaaggaagggaccaccaaaaagggaaagaaaaaggagacggaaccaaaaaaacaagacgaagaacacaaatacagaccaaacacagacgccaggaaacatacgcagagagatacaaagagagaaacaagaaaagaaagacaaaacacaagaggggatacacaaaccaaccacacaaaaacacgcacaaggagaaacacaagacgagaaaaggaggcacaacacagaaacgaaagagaaaacaccaccacacataaaaacgaaggaacagaaaaaagaaaaaaaaaaaaaaacagaagcaaaaacagacaaaaaaagagaaaaagccaaacgaaaagaaaacaacaaaaagcgaggatcaagagaaaagacacagaaaccacaagaaaaagagaaaacgacgaaaacagaagagaaacacaagaaaaacaacacacaaaacaaaacaaaaaaacacaacaaacaccaaacaagcacgaacgaaaaaaaaaagaacacaaacaccagcacagcaaacacaaacga

SEQ ID NO: 502022 - DNA, 846 bp, Homo sapiens
agcggagcggaagtggctgcgtcgtcgacgctgggctttcgggtcccgcgcccagagatgggctccaaggcaaagaagcgcgtgctgctgcccacccgccagcgcccacgtgagcaactgagatgcgggtggcgcggcagagtcatttcaccatcctggccggaagggatggggtgtactatgttgtccaggctggtctctactctggggctcagtgtcctcccgctcggctccaaagtgctggattaccaggcgtgagcaccacactggtgcatcgtcatgtagaagaacccggtggcagctcactcgggactgcagggaaccctgcctttgggggcagtagtgaggggtgccagaggatgggtggtcagagagtgatgtgtgtgtctgttcaacccccattcccttcaggatgatggaggatgcggaggccccgggagagcagctctaccagcaaagcgggcctacgtggctgcaaccagcggctgaagcaggcgggcaacgtgctgaggcagaggtgtgagctcctgcagcgagccggcgaggacctggagcgggaggtggcccagatgaagccggcagcattaccggcagccgcagctgcctcctcaggctcgactctcggggcctgcaggcttgggcagcgcacaagtggcctgaccccaggctttccctgggggtcgtcggcccagaatggcattcacggggtccagcccacgtgcgtgttgacacacggcgccgcccatgaattgtgggctgcggttcatcgtcgtctcattcctgccgagttggtgggaccacccagttgtccggtcctggtgacctgcgggccactgggtcttgaga

SEQ ID NO: 502023 - DNA, 150 bp, Homo sapiens
attggcatagaaatcgtaatggccaagggcaatttctgtcaggacaagtgagaaaggactacctagagccaaccagatcctctgtaaactgtaagatcacaattttaccagttaaaaacagttccaccatatcctgcagacagcatatca

SEQ ID NO: 502024 - DNA, 724 bp, Homo sapiens
agctgttccagtgttaacgacggcagtgtatccgcgtactgatttacgtatacgattacatatggcataggaaaatccaagatttgagcattccacatgtataaattataccccaatagaaaaagtttatttaaatgagttttagattctctaggcattcaacaattttctggactttgatttgagaggaagatacatttcagaagtaccctgggaaaatggaaagttgttcaaagtataacaatgagtatttataaaaaggcaaataaactaaaagttctactacaattttgaacaattccaataaatgtctgaagaccccattcagaagtggttatggtgcaaatcccacatctccaaaaccaggaccgtcatctcttctgctactctccatttcttcctgccttctctatctccattaacattctgccattcattcacaaggactcaagccagaaatgtaggaacgtggactcctctccctcccccatcaaattatttccagctccagtttccatgaaatcaggcacctttccattcattctactgcagccaagctcccaccattttgggcttagcccacggtagctgcttcttactagtctctacctccttgctggactaacttctcaaattgagattagatcatatgactcctctgctttggatttttccagtgacttcctgtccctttttaggccaagatcccacttttttttttgag

SEQ ID NO: 502025 - DNA, 374 bp, Homo sapiens
gcgtcgacatgggcttgaaccattgtgcctggcctgagagttattatttaatgggcatggagttacgatttgggaagatgaaaaagttctgggccaggcgcagtggctcatgcctgtaatcccagcattttgggaggccaaggtgggtggatcacctgagaggtcaggagttcaagaacagcctggccaacatggtgaaaccccatctctactaaagtacaaaaattagcccggcgaggtggcaggtccctgtaatcccagctactcgggaagctgaggcaggagaatcgcttgaacctgggaggcggagatcacagtgagccaagatcgtgccactgcactccagcctgggcgacagagtaagactgagtctc

SEQ ID NO: 502026 - DNA, 178 bp, Homo sapiens
cgctgctgctgcggtcgcatctcacagctaccccgttccatttctcaccatggcccccttctccccttctggccttccacagttctccgtttgcacatcaatttgctcactcaacccacccaagcatctgcacctgcggcggtgtcagcccttgcacacgggtcccgcagctcgcaca

SEQ ID NO: 502027 - DNA, 534 bp, Homo sapiens
ttggataccaatgacccgatgaggtgctggagtatttatagccacttcggcgggggaaccttgtggaacccaccacttgaatgtactcccagtcgtaagcgcatagtatgattatcatacgttccactagtctgtctctcggctcacccctgaatgcccttcccaaggatccgtgcacagcatgtcctattggccaaacacacctcagcccctgtattgtctattgtccatgtctgacatggttatcgagacacccgcgttcagcagcatatcacatgcacatgggtatgtaccatatgcatctcatcgtgtgtgtactgtgatagctatgtagctcgattctgcgtctagcctcatggacgctcgttcgcacatttgctcccagccccagttgctgtcacatgtcgtcccagatgtccttgccatggccacagacatatctgccgtctcctggaaacgctggggctgcccttacagagagctggcagccccagcagtcgggcctgctttgcagaaaagactggacccaactcc

SEQ ID NO: 502028 - DNA, 454 bp, Homo sapiens
gacctagaggatcctatctgaggaggagctgaggaatactcccagtgtatccaagagaggcgcagatacagcaacacgggattcaagcccagagagtaaagagaatagagtgatctaaaaggaacattgaacataagggtgtttcaattgttcccaaaaggtaaaggaataaaactatatgaccagaacagctaattattacaaatgcagagtttaaaaggaccgaagttctaaaatgcgttaatgaaaaatgaaacacaaacagaaagttccagacaaaaagtgggataactccaaagacagatctgagcagcatctgcccttgagccccactgaccgagatggaaaccagaaacaggatgttgtgtgctgggagcagatacaggagtgtctagcagggcagctcactccaccatactcaggccactccaccatactcagatcctcctcagct

SEQ ID NO: 502029 - DNA, 693 bp, Homo sapiens
agcctcctataatcagtattgatatcctgcagtctctcatagaggaaggggggtaactccccttcacagagccagatgtatttaacctcctgtcttctgtgataaagtcctcctggtttccctccttgcctttctggccattctcagttacccttaaaatgttgggatttgggccaggcgcagtggctcaagcctgtaatcccagcactttgggaggccaaggtgggcagatcacctgaggtcaggagttctagaccagcctgagcaacatggagacaccccgtctctaccaaaaatataagaaactagccaggtgtggtggttgaggcctgtaatctcagccactggggaggctgaggcaggagaatcgtttgaaaccaggcggaggaggttgcagtgagcagagattgtgccactgcactccaccctgtgcgacggagcaagactctgtctcaataaaaaagttctgataacataatgtggaaagagctgcattaagctggatttccttcaatgcctgagggttttactttggtttcagtaaatgatacagagttaatggattaccaggatgtttctctctgacacatgattgcccatggtagatatgggaataggccagtttacattgatttacatgcttagatgatctctaaatggcaattggtggaagcctctgaatttcaatgtgga

SEQ ID NO: 502030 - DNA, 493 bp, Homo sapiens
taaataactaaccttgtgcctagaaatatagaagaattcatttactgtttaacagggcaaagtatacatcttgatagtggtcatccattagggattaaaaaaattgtaattttaaatggcatttctttgactgataattgtaaggaattgtcaatatgcacacagattagtgttttgtcttggggaagaaaccctgaagtctgcaagacagtatgaatttaattcaccttcactgtttaacttgcaaaaaccattgtgaatcaaaggttgctaaaaggtttttaaaggagagtaaagttgctcttggtagagctggctggcccagcgccacgtgagcacagtgcgtttaataactcgcccactaaggggcaggtggcttaactgtgagaacttctcagccttacaatcagcagctctgactctcctcggcatgcaaggcgctcgcacacactaaagggctgagcgcccagcactggccgactcctccatacag

SEQ ID NO: 502031 - DNA, 438 bp, Homo sapiens
ggtcgacggagacagtaaaaatatcggtggttgcaaagggttggagcctggggttagtgcagtgaaaatactctgcatgatactgtcatggtggatacatttcactatacatttgtgcaaacccgtaggatgaataacaccgagagcactaatataaactatgggctttgggggatatgatgtgtcagtatggcgtcatcagttgtaacgagtgcacccctctggtgcaggatgttgataatggtaaaggttatgcatctgtggggacaagtatatgaggtatctgtttaccttcctctccatgttgctgtgaacctaaaactgatcttgaaaaaaaaaatcttggccaggcgcagtggctcacgcctgtaatcctagcactttgggaggccaaggtgagctgatcacctgaggttgggagttcgagaccagcctgac

SEQ ID NO: 502032 - DNA, 273 bp, Homo sapiens
gttgacgtgtggaacacaattgttcatctgccaaactcatcaattgtcacttaaattggtgaattacacagtaagtaaattatatcccaataaagctgatttaacaaataaaagcaatgaaatatatgttgaagacttttatactggtgggaatgtttgataacttacccatccaagaaacagttccaatttgttagatttgaacacatcaacatgtaaatacttaaaaaaaaaaaatttcaaaagttatcggtggaaaggtaagtgtctctc

SEQ ID NO: 502033 - DNA, 501 bp, Homo sapiens
  misc_feature (149)..(149): n is a, c, g, or t
  misc_feature (153)..(153): n is a, c, g, or t
  misc_feature (170)..(170): n is a, c, g, or t
  misc_feature (203)..(203): n is a, c, g, or t
  misc_feature (256)..(256): n is a, c, g, or t
  misc_feature (258)..(258): n is a, c, g, or t
  misc_feature (262)..(262): n is a, c, g, or t
  misc_feature (268)..(268): n is a, c, g, or t
  misc_feature (279)..(279): n is a, c, g, or t
  misc_feature (300)..(300): n is a, c, g, or t
  misc_feature (304)..(304): n is a, c, g, or t
  misc_feature (321)..(321): n is a, c, g, or t
  misc_feature (325)..(325): n is a, c, g, or t
  misc_feature (359)..(359): n is a, c, g, or t
  misc_feature (362)..(362): n is a, c, g, or t
attgccctcgtcggagtgagtctgccaaaaaagaggtggttgctgaagtggtattagccccgcaggtagttgccgaagcagctaaaactgcgaagcggaagcgagagagtgagagtgaaagtgacgagactcctccagcagctcctcanttgntcaagaaggaaaagaanaagagtaagaaggacaagaaggccaaagctggnctggagagcggggccgacctggagatggggacagtgataccaccaagaagaanangaanaagaanaaagcaaagangtagaattggtttctgagtantgangccacttgaagctggangagnaactaaagccttattgagcatgttatagatcctntgntgctgatagagtggaacatagggtctaaacagggttgaagagttctggcacattttaaccttgtacctttgagaccttcggtgatggtacccttgaggttgaacatcccaattttgccccggttttggtatgggtggtg

SEQ ID NO: 502034 - DNA, 207 bp, Homo sapiens
  misc_feature (163)..(163): n is a, c, g, or t
ctaagtaatgctatataatggagaagaattgaaaatgcacaaaaaaattcatctacatatcagaactgcagtgaacttaacttatgtaactaaacagttagcaggtgccaaactatgagggtctgtatccacgtaacacaggtagttacaaaaacatgttatngtactgtgtaaagatgcatagtcatctcatttggttggctttgt

SEQ ID NO: 502035 - DNA, 901 bp, Homo sapiens
tgggagcgatctggagtgccgcccgcggccccgaagctcggctctcgagccgccggccggcctgtgccggtgtccgtagtgcgctgctgccctcggctggggccctatgtgtgtgctggcccgcccgaggccgcccgaggcttagtgcctccaccagacgccctggcctccgctcgggccatccacatgggtgcctcccgaatgagctgccgcagacgcccggccctgcatggtcagtgtaaagagattataaactcttccactgaaatgaaaaaacattttctaaaagctgcatattactccaagaaaaaaacccacaaattgtttatgacgtgttagtgccgtgaattgaagagaagaggtcatccagaaggctgtgatggagtttgatctccacccgaaggccaggattgaagataggcaagtcaaaatgcttctcagaactcttctgtgtgcacaatattatcaggctgggcaagaaaccagtgtaggcagatcatgttgcaaaagaggtgcttcttggaggccaagacccagcgtccctcaagagcggcctaggaagctcgcaagggacctggtgtgagcgcaagctctctgaagaaaccttgtttctgagttgcgcagaaacctcggatctgagaagaatcatggcgcctcgaccgtgggtgtggtaacctacagcggttgtagacaccccccctttgctttggtaacccccagtggctgttttgtggcgcacatgtgggggctgtgtgtgagccccccttactgctccggggacctggcagaggtgataggctgtgcacaacagacgcggctacttcacgagtaattaaccctgtgctgaaggtggctatcaccagtctgttcaaccggccagaaaaaaagcatcttgacccat

SEQ ID NO: 502036 - DNA, 679 bp, Homo sapiens
  misc_feature (679)..(679): n is a, c, g, or t
taaggttggagggggaatgcgggaaatggtaaggggtatggagacttattcatattaagtaagtgctaggggtgaggtggataggaagtttttctcataggagggtgtatgagtgggctcgtagcgcaatcgggggtatgcgtgtctcgaattcataaaaaacagggaggttaaaagtagggtctgggtgacaaaattatgtgtggtgtagaagtttcagggagaaaggtgcgctcaatatgatgtggtcccataggaagaaatgtgtaggtgggtagaggggtgtatatctataaataagtggtgggtgatatcacggcatattgaacaaactagggacgaaagagggaccgtggcaggcgcatactccccaatgttgagaaacgccgtggcaccacctacctctcgggaaactcacacctttgaggcaaacagggacaacacacagcggggatacacggctggcgatcacaccgtgcgcccgcgtgttcgagaaccaactacaacctccacacaccacaacgggcgcccaacaggacgcacccatcagacgcggaccaaagcgaagcataacacacaacaagaggagccaccaaagactgcacgacgacgaaacaacaggagcagcgacacaagagacaacacagcgaagcacacacaaacacacaaagcaagagan

SEQ ID NO: 502037 - DNA, 510 bp, Homo sapiens
acgtactccggggtagtcagggacatgatgctatccggcttaggagcatggagtcctatcgtgtagtcctgtccccacttacaccggaggatcacatgcccgaacaggaaacaaataataatgaccccattaatagttccggacaacagacaactcttttaagttaggtcgtgtagagaaatccacgggtcacaactttattcccaaaatggtgctttatttatttacagcaagaactaagactacttcttatccgtgaacaatgggcgtggaaggtgcttaggatgcgttggtgtctttggcaattatcactgctttttcttaatgcagatggtcagtaggacagaaggtaacattgatgacacgctcattggtggacatgcctccgctgaaggccccgagggcgaaggtaccgaaagcacagtaatcacaggtgtcgatatagtcatgaaccatcacctgcaggaaacaaggttcacaaaagaagcctaccacgcagtacaatcaaag

SEQ ID NO: 502038 - DNA, 691 bp, Homo sapiens
  misc_feature (544)..(544): n is a, c, g, or t
  misc_feature (571)..(571): n is a, c, g, or t
aaggaaggaaggtgagacgtgtgctaatgaagtcccctggcaaggcatattctgctaggtcttaagaaagaccctgtttgtcttgatgccctgatttccaggcccagtggagcatcagtggcacctctggctctgtagctggcctactccatctgccctgcctgaagagtcgagctttgaggtcggagtcatccaacgcaggcagccatctgtgagagactacaacacagctgtgcagggcagcttttaaacaggtagcgacagtcttgactacatgctcccacccacgccctatcccagctgtactctctgagtctgacattgaaggggcagccatggcggatcctgcctgtacttccagcactatgcaaggccagcgtgaatggatcactgtaggacagcagttctctcgcctgagcagcctagaggaacctgatccttactcttccttcaattaatagctgcgcatgtgatgctagtagcgctaatggattggttacagcgttagagcctgtgatcccagctactcgttagtctagggcangagtatctcttgaacctggcatgtgangattgccttgagctgcaatgacacaattgacctacaggctgtgtgacatagccagaccatggtctaatatacggagagggactaagtagtaccctacagattgagtactgccaatgctct

SEQ ID NO: 502039 - DNA, 118 bp, Homo sapiens
catgatacgactcgagtgagtacctataagtacatgacaacacttctcaactccgcactagcctgcgtcagattaataacactgaaatgacgattaacagcccaatatctacaatcta

SEQ ID NO: 502040 - DNA, 374 bp, Homo sapiens
aaacaaattgattgggtagggccgtgtgcagtgctacattgcctgtcatctccgtacttcgaggactgcgatggctgggaggatcactgaagtccagtagttctagaccagcctgggcaacacagtgacatctgatctataccgcaccccgccccacaatatgtgtgtgtgtgtgtgtgtgtgtgtgtgtgtgtgtgtgtgtgtagagacagactcatgtagagccaggtgtgtgggcggcgcggtcttgaactccggggtctcaagcaagtgctctctctttggtctctcagagccagagattacgggcgtgaggtagtgtgcgctggaatatggggggagtgcattatcattccttctgtgagcgatgagtt

SEQ ID NO: 502041 - DNA, 319 bp, Homo sapiens
gaggatcgtggagctggtcatccaggcattagttcatgggactaacagagattattactccattactattaactatcgggaaaaatgaactgggaacagaagatgttgctaaatttgcataagaagagtgggatggaaggtttgacacttcaggactacagtgaacatggtaaacacaatgaatcagtggtaaaagagatgtgggaatcagccaagaattacaataaggctgtagaagaagaagataagatgacacctgaacagctggcaataaagaatgtgggcaagcaggaccccaaacgtcattgggaggaacatg

SEQ ID NO: 502042 - DNA, 85 bp, Homo sapiens
ccgcttttttttttttataccatcaggtatcatgaatttataatctgaaagaggacttaaaataataattaaaacttaaaaaaaa

SEQ ID NO: 502043 - DNA, 856 bp, Homo sapiens
tctcgtgttacttctggcgctgtaattcatggtcgctagtcctatcgctacgttgcgtcacggtgtcattgtatttggtggtgagtagtgtccgtgcctaactaactctcctcctctctgaaatgtgatttcctgttgcgtctctctttttctctcttttttgttagtagaatgcctctcgactccaaccatcctttactggctccagtttgccggaatatgtctgctgtccatgtcctgtcgtaagtctatgttctggataatcacccccaaagcccattcgtctgcgctagatccccttaatgatgctgtcatgcatccttcaaggtccagtcttgtgataagtgtgtcgcctcaagatggcctccagggccatgcctctcgtgatggatatgctaggtttttctctcatgggatcctcatagtgagccacgtcagttgtccccaaaatggtcgtgtctcaccaagagcccttctcctaaatggagaatgccctgcgttcgtgaggcccatcctggtgtgctggagcatgccatcactgcccgcacctggaagcgagatccttctgataagcacaactttggccagagaggcagaagatggtctgcaggcaactgcagtaagcggcgcctgcattcgctcggtggctttgagctacccgcatctgcgtcagtgccaggtccacaccaacatgcagcgtggagatctggctctctatagcatttctctgatacttccgctacttttaggcctggtctaaattccaagatagataacactcaagactacataaagtacgtgatctccagtactgacacactgttattttctagctgttatttgctatttggtacac

SEQ ID NO: 502044 - DNA, 134 bp, Homo sapiens
taaaggcaaaatatgcagcaagtttaatacctgaaggttaacataaatgacaacaggacacagatgcaatgctacagtcaaatgtggttggggatggaagggggcaaaagggaccctggattttattacaacaa

SEQ ID NO: 502045 - DNA, 259 bp, Homo sapiens
atcgtggtatcagagcaaacaaaacaaaacagaacaaaaaagggaggggggactggtcgaaatgaacgaaggtgggagcgagatcgaggaaaggggggagaatttttttttcttcttcccatttctttaaaaaaccaacacaagaaaacacacacacacaaccaacgtttgttcccgagtagaaacataaatagcggagaatcgaacactctgttcttctctcttccaaagaaaaaaaaaaacacgttcacgttacgga

SEQ ID NO: 502046 - DNA, 421 bp, Homo sapiens
gcctggtgtgattccgtcctgcgcggttgttctctggagcggctgttcttttatctccgtccagccttctctcctacctaagtgctgtgcctgcaccctgatggaagattcgatggacatggactattgagccccctgaggccccagaactatcttttcggttgtgaactaaaggccgacaaagattatcactttaaggtggactaatgctgacccatgagcaccagttatctttaagaacggtcagttcagcgggctggtgcaaaggatgagttgcaccatggttgaagcagaggcaatgaattacgaaggcagtccaattcaaacgtaacactggcaacctttgccacttgtctgtacagccaagggttcccctgtgggggctttgacattaacaccaccaggtggtcttcaaggtctg

SEQ ID NO: 502047 - DNA, 1132 bp, Homo sapiens
ctgtcagtgtcactgacggcagcgtgctgctctgggtggaagctcctctttcacctggcccggacagagggagaggaggcttccaccagagaggagccgggaaggtttcaaagggcacaggaaccaggtgatttgcctgtcagagtccactgaggcagtgtgctgtctcaggctccacgacgagacgtgcgccttgggacgtgcagagccagcagtgccataccggaccgggcgcccacgacaggcaccctgtcaccaatgcccgccatccatgcaggacgccacgattagacaatgctgcagcatcagacatcacagggcaccagccgtgccgatgcaccaaattcaacaaagccaccactgcgggcgccgagccacgccgaccgagcacgcgccaagaggcgcctcacatctgcgccctgcggcctaccacccagcaagggacatcggaaaccacaccgcataccatgtgaacccgcgccgcgcagccagccaggcacggccggtaccgggtgccaacacacccgctgggaccacacgacgccgatgacctcgcgaccgaccacgacacccaggacgccgcgccacaagcgcggcaccgcagcgcagtgacagcatcgaacggtacgcacacccacgcaccacacaccccacacccggcaccaccgcgcaccgaccccctacccagacggcatacatcagcagccgcgtccgcgccaagacacagagcacgcaccaacccgggcaccgaccgcgcacagggcgacgccccacgcgctccacaagacacagcacgcacccagagcgatgatgcccacacacaagagcaacgctagcccactctccccagcaccatggtcacgcgactggacgaaaacacaaccatcaccgaaacccaccaagaaacacacgacgaccacccacacacaccgtctcaccacgacaccaccacagacgggtacacaggctcaaactgccgaccggtcactcctatcagtcgccaacagacccaccactgacccacagcccagaacaccgcacccaaccccgctaaccacacacagctcaacaacagccgaacacgaggcacccaacaacacacaccacacaacccaagacacccaaagcacag

SEQ ID NO: 502048 - DNA, 467 bp, Homo sapiens
  misc_feature (25)..(25): n is a, c, g, or t
gcatcaaataatgtaaaagtaaaanactgcatccaaaggacagcagcttcaaagattaaaggaacatcagcccacacagatgagaaaaagccagtgcaagaacaatggcaactcaaaaacccagtgtcttcttacctcaaaacaatcacactggctccccagcaatgatacttaaccaggccaaaatggctaaaatgacagacatagaattcagaatctggatagccatagagatcatcaagattcaggagaaagttgaaatgtaatccaaggaatccagtaaaatgagacaagagctgaaaaatgaaatagtcattttatgaaagaaccaaaattatctgatagagctgaaaaactcactagaaggatttcataatacaatgggaagtattaacagcagaatagaccaagctgaggaaagaatctcagagcttggagaccaattcttctaaacagctcagtcagac

SEQ ID NO: 502049 - DNA, 322 bp, Homo sapiens
  misc_feature (85)..(85): n is a, c, g, or t
ccccccccctttaaaaaaaaacccggggggtggggcaagggggtttccgccctaaaaccccgccggagaaaaaaggttttttgancggggggaatttccaattaaaaatttccccccggcattaaagaaattcccccccggggaaatccctttggctttcaaatttatttaaaaaaatgagccgggccaaagcccaatgcaaaaggcaggcctttataaaaggggccccttttgcccccagcccaaaaaattatgggaaaattgggggaactgagggaaaattcaaaggggggtttgaaatgggaaccaaggagaattttta

SEQ ID NO: 502050 - DNA, 143 bp, Homo sapiens
ccagagtcaaacagtgcaatcctaccagcagtatggtagagtcatgtttctccacatcttcaccaacatttattgttcatcctttttatttagtcagcctggtaagaccaatgatgctgagcatcttttcatgtgcttatcag

SEQ ID NO: 502051 - DNA, 1116 bp, Homo sapiens
cgcctttctcactgtagatggatgtgggtgtgggattcgcaggagtctatcctatcttcgggtttggattaagttcctaacgccacttgcacaaactaggggtttgggcgtcggctagtgtttttgttatgtgtttgtcttctccagtggtgtgggcaattaaagtaattaacctttctaagaggcaaccccgacccagtgcgacaagtaatagagtgtggttcggcattgggtggaggacgagttcccaatcaccatttcagttctattagcgcaagttacgtatatttgtcataaacagtggtgctcaggaatacgtggtgccatacgaagtctcatttattctcctcattgtgaaatttaccggctcgtgcagtggggaccagacctaaggaaaagcaaacagtgggtgttagaaaaagaggatttaaccgtgtggggagtctaggaaagtgcgccagcgttaactcatgtgccaagtgtgggtgtgtgacgaaaaagttttattagtgaaaataagcccaaagaggggagagtgtgaggaaggaagtgggggaacatttttcttgaggggacattgtgtgggtggacgagaaacattctgtggaagacacaagaggaagaaggcctttgtgtgaggagtgcgttggttccaaaagaggaaaaagtgggaagaagtttatacagaggaggtcgtcgcgaaagctactgtggacggtgctacgcggactggggcgccagacaagcaccgttgttgacaaaacccgtggagcaggcgggcggaacaaaaacaaacggggcgccgaacgctacaccatgtgaaaaagactaccttgtggatacaacggggacaaggattttggtggaagaccatttcgtaactcctatatcaaacaacgaaaagtttatccacaagggggacaaacttccgacgttggggaccagcccatcttactggaccgccagcaaggtcgtgccctgtttggaagccacaccgcccaatgtcctaaacaatgtgttgtggcccatttcaccagacaacctgtgggaggaggagatttgagatggaccagctggagggcaggtgtcaacgccgcgcgcgtgggcaatataccc

SEQ ID NO: 502052 - DNA, 258 bp, Homo sapiens
ggggcatggcagggtccccgtggacgtggccgcgcagttccggcgtgtgcggagaggagtgagcgtgaaggtctcccggcctgcagcagctgcgaactctgcgccgggaagttctctggcgggggatgggagggcggtttacggcgtttggggtaggtttagtcgcgtctaagatccacacgtcatctttcgcctccgaagttcgagggtaactttcgttccctcctggccttcgcgacaccctcgagtcggacggag

SEQ ID NO: 502053 - DNA, 130 bp, Homo sapiens
ttgctgtctcatatgaaagtctcaagggtggcagaattggtcagatttttccattttcctgtatttccattttaacactgacagtcaagttgcctaaagtgtttgaacaaatactgacatgtaaagggga

SEQ ID NO: 502054 - DNA, 1181 bp, Homo sapiens
  misc_feature (439)..(439): n is a, c, g, or t
  misc_feature (494)..(494): n is a, c, g, or t
  misc_feature (567)..(567): n is a, c, g, or t
  misc_feature (576)..(576): n is a, c, g, or t
cgcagtgtcctatgcttgtgatcccagtactttgggaggccgaggcaagtggatcacaaagtcaggagttcgagaccagcctggccaatatggtgaaaccccatctctcctaaaaatacaaaaattagccaggtgtggcggcgggcgcctgcagtcccagctacttgggaggctgaggcagaagaatcgcttgaacccgggaggcggaggttgcagtgagctaagatcgcaccactgcactccagcctgggagacagagcaagactccatctcaaaaaataataataataataaaataaaaattaaattaaaaaataaagcaagctacagaacagtctgtatatgacctttttttcaacagacacagatttatacatgcccccataaaatatctgggaagtctcggccacctgatatcagacggacttgcacctgttgntttatatgcctctgtattaattgcttccctcgacacatgcaccatatactacttntaataaaatatattttaaagtactctttagaatgaccattaagaaaaaacaaaaaacaaggatgggaacatgnaaagaacantagaagcaaaaacagtaacagaaaagacaagaagaaagtaaagaaagagaagagggagggaaggctgaggccatacataagaaaatttacaacagaaagaagctgaacaaggacgttcaatggacttacgaacctttaaaaccagaggaccccaccaattatagcagatttaacttgcacaggtaacacaagcccgaaaagaagcacgcttaacacaggtttaacggaagttaagtggttctaaaagcatatccaaaggcagaaccggttggtccaaggcttcacttgaatcccagcatttggaggccaagtggccaatcccccgagttagagttcggacaacctggcaacattgtgaacctcgtttattaatcacaaattgacacggttgtggggccctgaaccccctttgggaggttagctctggaattttggccggcagacctgttccgggctcttttccctgcttcaatgggctcaaggggagtcttccaaatcaccatcaccgtgggcgtctgcctatcttgcttcgccttcatctgcgcatctctctctgccaatgtctatcggctccagtgccctctactcctgtcccttctcctccc

SEQ ID NO: 502055 - DNA, 231 bp, Homo sapiens
tatcctcccatgatggggggagctactgtaatactatgtaaattggagaaaccacaatactcatcacgaggatagactatagtacacatgatgaggtattaagtatcattgaaaaagagagagtcctacatgtccgcatggaaggatctcaggagacactgttaaagtttggggaaaattgaaagacaatacctgtatacatatgatactagtgatgtaaatcacatcaca

SEQ ID NO: 502056 - DNA, 1368 bp, Homo sapiens
  misc_feature (1172)..(1172): n is a, c, g, or t
  misc_feature (1234)..(1234): n is a, c, g, or t
ggactagacagtgcccatcgggggtggcgggtcgcgcggcctcatacggagcctgggagagatttctctgagagatgtgtgtaacagtaggcacatgtcctcgtgactccgtggacatcggctggcgtgacaggaatgtctcgcaggataaaacgcgagtattgggcctattgcccatggttcgaagcagtaggaaccgtgacataccgccatacgacttgctacgagaataagaagctttatctcagcttgtctgagtcaggcttaacgtctgagtaccgggtaagaaggcaatcagcgacagccgtatgatataccgacagagggtaaaggggctcgtagctctagtcgtatgtggatgattagctcggttcaaatcctgcatacagtgcgtaggcaccaggatggactaccttcttagaggggcatcccgagagatacttcgtaagcgggatgacaggtacatcgcttggggcacttgagtcgagcggaaaccgatggacaattgcaacatcatttcgatatgcacagcgattggaatgagttgggtcgacccctggaggagcccacaccgtggccaatgaatggcatggggaaagcgctgggctcgaggaggcgtttgtggccatcttcgggttccgtggaacacattagtcgcgcgcgccgagggaaaaattgttggacccttcaatagaggcccgaatcagtgcgggaaggaggccacctaaaaacgggatcttcccgaagttcgatccaagacccatttaatcgggggaaccataagtaggtatgcccctaaaggagtgattgtggctgttagtggggccacatttttagcgaaggctgtggtttccaccagaggggaacgtggaaacggaaagagcccgatggttgcgataaccaatgcctatgtggcggtggtctcctaatacaggggtagggtttgcaccaagaacattattccgttagcggcggcgcccaactatgtaccacaggccgtatggcgccacacaacctcccggttacctcctcacgtgccaagattccataggcgcgtgtgactcggcgacacttaagggggggagaacttaaacccagggcgttggggtggataccgacaagatggcctacatttgggggcgaaaagcccccatgtgggggtgctataaggntcctaggtgcggacacagaagcccctccggccaagatgaagacccaattatgtgccacaagnatttcttgtggcgcccagagtcagacggcaaagatgggcgttaggcttcgcataggacaacttctgaccctggggggtgggaaccatgaggttccaatactttctgccacacgccattttgcgcacatttcacc

SEQ ID NO: 502057 - DNA, 123 bp, Homo sapiens
actggacaggcggattaagaaggctggggagaaagaagagggtggcagctctggtgcagcgccagagcagggagcaggtgaagagtggctggacttggcttgccccacccccacctccaggcc

SEQ ID NO: 502058 - DNA, 336 bp, Homo sapiens
catagctgatactggggattgtcaccgtgtctagctagttgatacagagaaatgaggcatgtgcatagtggcgggcgcttgttagtcgcagctacttggtaggctgaggcagaagaatggcgtgaacccgggaggcggagattgcagtgagccgagactgcgccactgacatgccagccggggcaacagagcgagactccatcgtcaaaaaaaaaagaatcgaaccgtgtggtgcaggaacaggatccgtgtgccctatataatttctcgtgattcacaaactctaagacgggttaactgtggagcagtggaaaaactcttggacttttgcaaacc

SEQ ID NO: 502059 - DNA, 841 bp, Homo sapiens
  misc_feature (333)..(333): n is a, c, g, or t
gctggggaagactgtcgcggaaaaagttgggggtcgcagagacgagggcgttggagggtggttggggagagaggcgcggttttcccaggaggttgtggcgtggtcccccccgggtgttccggtccggtgtgtcgaaaagtcccgggggggcactttttcgaggggcccccccgtgaggcgcctgtgtcatgtccgcgggtcgcagcagcaccaatggttggggctacaccgacgctgcccgtcatgcggcccgcgccagtgtgtggcgcggcctcatggctgcggcgcccggggtttggataatctcgcggcgccggcgtggacacagacgcngtgtggggaccaaagagacttgtgatgggtaatcccccagccaattatggggccctgcacacgcaaggagagcctctgtgaaaaaaaagtgccatagggccacccgccgttcataatcccccgtgcaagacaaccctcgccaaattataaaagtcccccaacaccctttcgggccccactgtgtttccccgacccccctacgattcctgttggggccagcttaataacagcagttctggcttataagccccctgccaataacacactgctggcaatccctcccccgtgtttacactcgacacaatgcactcgcgtctttttaccaaccggcgtcacctttgctcacacattaaacccacgattccttcctcatatgagagacccccctttccctgggcgacgcacaccattcctcccttctcgaccggcgggggaacaagcagttcaatctcgagcacagttacgtgccccccccaaaaaaacaaaaccccccgaaataaacaaaaca

SEQ ID NO: 502060 - DNA, 827 bp, Homo sapiens
ctaaagctgatagtggaagtatgtacctcatgggtagaagttgaaaagatgaaatgaggagagaatgtaagacagcttgctattgacaagtctagctcacttccagtcatagagccctcctatagaaagtaacaagaaaaacaatagtacataagaacattgttttggaccgtcccatcggagcctacctagtaatatggtcttctctagaacacggactgcgttattgcggagcgtgggccataatgccggatggagacaaggcaataaggagagcaacatagagaggggcgaaccacggatagaggagagaaacctcggaggccaaagaatcgacaagggagagtagagaacgacatcagacacagcgacgaaagaaaaaccagccagccgggtgccagcaaaaagccgcatccagctgaactcgaaaaggaaccaaattcacacgacagagaagagcaaaacgccgcgaagtacaaacattacaccagtggaagcgacacaaactgagacatgggacactaacgatagtcacgcaaaaggcccattaaagcatttccaaggaaatgacataaccctcgaaccctagcaggggtacaccaggaaaacgataaaagggccagacaacatgcggcacacacaaacaaaggagaaatagagaaccgcaaccaaggagcaccacacggcgaagacccaaaactacacacgtagcgacgaagacgccagcatacgggagcaaaaccacgcgcgcccggagagcacgacgaaaatcacagaaaccaaaaggcctcacaatacaacaaccaaacacaacggcagggcacaca

SEQ ID NO: 502061 - DNA, 259 bp, Homo sapiens
cttatatgattggaatataaattgtgatttgggatggctttacatcttgcctaccattgcatacacattggggtttcttcaaaatgtgtgtatcatacttctttagcgaggggggttgttttcttctgtttattttctgatactcctacaggagccaaatttgtaattaagagacacttaattttgttaatcctgtctgggacacttaagtaacatctaaagcattattgctttagaatgctctaataatatttcctgt

SEQ ID NO: 502062 - DNA, 865 bp, Homo sapiens
atctccccaaagtagcatagccagtttccagatgggccacagactggggaggagaatcagtggcccagccagaagttacagggtgctgagggttgaggtgagagtgcacctctgctcttgttgggagtgggtggcttgcttggaaataggcccagggtgcgtctgccagcctccggcctctccctcctgagttgccttcttgttggtggcttttcttcttgaacccacctgtgtaaatgagtgttttcagattacacgtgggtttccccttttgattctgtaaatatgtcccagagagaattcgtggtgctgagggcaattctgtcttgtgagtgaatgaaggcctggacattcagcctgtgagagtctgaggcttttctgaacgggatgtaggtgacgccttcgtatgcggtctcagaccataagtgtgtactacacagaacgctgtgtctctctaagttctaggtcattgctgcttgaggactgtctctggtaacactgccatgggtttgactacggtggctgctgtgctgctttggcagcaaagggggtgcatttcagggctggtgggccaccacgcgatgcatgatgaagtatctgtggctcatggccttctagggactggctcccgttgcaacagggtgcccacgctggagctcttaacccaatcttgcctgcaggggagtggaaaggggtgggcccctactttgttcaacccaataaccacttatttaccaaattacagcttacgccaggaatacagccatggaccttaagaggagaccggttgcagacgtccacgacctactagcacttggcacaatgcttgatagaacctccacacattactcgcggcccaacgcga

SEQ ID NO: 502063 - DNA, 273 bp, Homo sapiens
gggccccttttggcccggtgttagccccaggcattttccccccgccccttccggggggccaaccagggggtgggcaaacgtgggggccccttaacccaaatgccctttttaccagggagctgggccggcctttggcaggccccccccttactttttttgcccggcttaggttgtggggggggcctcctggggggccccattcccccagctttgggttttatgttttttttttttttggggccgccagtgcccccattaagggtccgaagttta

SEQ ID NO: 502064 - DNA, 363 bp, Homo sapiens
aaccatacatgtctgatgacattatttggcattctcactggacagcacctttcaacattaagaaatagtggccgggcatggtggctcatgcctgtaaccccagcactttgggagaccaaggcaggtggatcacctgaggtcagaagttcaagaccagcctggtcaacatggtgaaaccctgtctctactaaatatacaaaaattagccaggcatggtggcaagcgcctgtaatcccagctactcgggaggctgaggcaggagaattgcttaaagccaggaggtggaggttgcagtgagcctagacagtgccactgcactccagcgtgggtgacagagcgagactctgtcatcagacaatgtat

SEQ ID NO: 502065 - DNA, 1004 bp, Homo sapiens
ctcctagtcctcattgtacccattctaatcgcaatggcattcctactgcttaccgagatcgaaactattctaggctatatacaactacgcaaaggccccaatcgattgtagagcccgctacgaggctactactacaccctatccgctgacttccatagaacactcttgcaccaatagagcccctaatacacccgacacatctaccatcatcctctacatcatcgccccgatcttaattctcaccatccgttcttctacaaattaacccccctcgacccatagccaaccgccctgatcgatcatcgactctagcgcctctcgtattcatatctacatctagtctctgagccatacgcgattcaactccatcgctcgtattcagtgttaacatcaatgtccccttaggtgcagctcaaagccctggaagcactaacgaatgccactcgtctccgttctatgtcacgccaactgatgattgctacatcatcgagaaaatttccttgactaactggagcgtgccatgtgtcctcgctacttgcaactccgatctcgatcatctggtcaggaatgctcgcatgatcattcggtgacgttctatcgaagcattgcagccctaatcttatgagccctgcaaaaactagccatcccgaggcccctgaacgctctctgaacgagcagaactgcgattcaggatgccaaacactgagaggtacactagtccaagtaagggccgcctggccggcccatccctgaattgcttcatacgtcagactactacatcttccttataaagatagtccttcaccactagatgctgactacaacgtctttgccttctaatccataaaaccccacaaataattcgctctaaccaaacataccccgtactaacacttaacaactcccaaacgcataaccctcaacctctttaaaatctcactccaataaaacctcctcccaataaccctacccacaaaaaaaacccacaaaaacaccactcacct

SEQ ID NO: 502066 - DNA, 120 bp, Homo sapiens
gatgccgcgctggcgcgcctggcaagcgccagtcgtccggccagatgcgcgcgccgatccgcaccaaggccaactttctttaaggaaaagccatgtccgccgcatccaactacaccgaga

SEQ ID NO: 502067 - DNA, 162 bp, Homo sapiens
cagctacaagtagggctaaaaactggcaagtggcattacactaacccctccaatggagtttggcttggatggaatgaaacaatgacctcactcctgttgcttagtgaggagctacctgtctattcttgctgcccatgttcataagtccctgaaatgaaatgc

SEQ ID NO: 502068 - DNA, 948 bp, Homo sapiens
tgctgctctgctcttccttcgctcggttgtcttcgtcgtgttaggttcttttcctgcggatcgacgctcaatctctcttttcttgtctctctcttctctctctttttggttgtgcgcgtgtggtgcttccctcactcacgtatgtgcccaccttctgacgtcttttgtcctctttgtttctctcatcgtcttcgtctttctgtctgtgcttttcctttccttgtcttcctccggctccagctcgttatcatagaacgacacgctccatctccctctctcttggttctcttggcgcgacgctctcgtcccacacgcgcgtgtgtgttcttttccttcttccttattgtgtttcgctgctctctgcctaggtacgctcattctttgtcactctctctttctcacgccatctctcgcgcgggtcttcttttttcttcctcggattgcgcggttgttgtccttcactctctcgcgattatatacatggacactctcctctctctctttttgtgggtctggcggtctcttttttctctctcgtgcgaggcgtgccctcacccccgccccgcgctatttgtcttttctgtttcttgggtgtgtcgtccccccccgcggggtggcttctgtcttgttttgttcttttgttggtgcgcccgcgcgcagacgttctctctccactcctcgctgcgttgcgtcgtcacggtgccgcccgccccgcccgtcgcggagcttggttgtgtgcatggctgtcctttcttctttttttcttctagtgacgtgttgttcttttgtattagcatgaggttctttcttcttgctggcgccgcccaccaccctccgcgcttactgctactaccatgcatctaataaccagaggactgagcgccgcctccccctcccccctcccccccccccccctctctttttcatgttttctctctctctctaaca

SEQ ID NO: 502069 - DNA, 352 bp, Homo sapiens
gcgtcgacaaacaccatctctgggactcatgatcatgtctgcaggctttggtcattgcctgggcatcctgaagcctccttagcagggtgagggggtagaatcaggccggttggacagagccttcctaagataactgctttggaacaactgatgagcctccagttacaaaaccctgcttgagttctccactgtaacttccccaagcaccaagctgcctgtccctccttcctccagcaaaggttctgacatctgcagaccccagggatatgcacaccatcaaacagcctgctctgtcctctgcaaaccaccatcaccctgtcacctcatcaggtgcagccaccagccatcccca

SEQ ID NO: 502070 - DNA, 180 bp, Homo sapiens
  misc_feature (117)..(117): n is a, c, g, or t
  misc_feature (126)..(126): n is a, c, g, or t
aggcaggcagctgcaggtgtgagctgcagttcccataatctgggcacaccccaggcgcagctagagactgagtagaggaggtggctcgcaggctagccgggaagcaggagcagaccncgtgctgtngaacgatgagttggcgctgtctggctcttccacatctagcttcttggtcatggt

SEQ ID NO: 502071 - DNA, 120 bp, Homo sapiens
ccctgtgatgtgaagagggtgttgagatgttgatgtgggtaggtttgcggaagggtagggagtgggtgtgggaagttgtggagggtggaaggtgtgaggatgatgtagtgggtgatgtgg

SEQ ID NO: 502072 - DNA, 132 bp, Homo sapiens
ggggcagacttgcactgaatcttcaatcccagtcatttccagtaaaggacatcacaggtaaactgaaggaccctgctgaactttcagtagtcctgccgagtctgttctaggcttataccagaatggccatct

SEQ ID NO: 502073 - DNA, 249 bp, Homo sapiens
ccacaaccctggacaacatcccacaaatcagtacataggactaagtgcccagttatgccaggagtcttgctaccatgaagtgagctatgatctctggccagtgacaatcgtctagcgagtccttcctgccattctgcagacctgttagccacatgcatgcaggacaggcggtatcttactgcaaagccattcacagcaaagcagctgaggcgcttcagaactcctagtgagacaacagctgattcctat

SEQ ID NO: 502074 - DNA, 1699 bp, Homo sapiens
  misc_feature (1449)..(1449): n is a, c, g, or t
gggcagggcacattcaagttggtggagctcgcaaacatcccattcaatcatgtcatctgtctcaccaacatgtcatggaggatcacattatcaacatattgcaacacctcaagatacatcatcatcagttatgggccaaggcctcttcattccaatcatttcaccacatcacatcagagcatgcatcatcaccaagcacacacatcacagttttctcttatatgtgcgcacattctcttcatccatccactccaaagcttggtctcgttatgtcaaatttcaagccaatactatcttcacacacactcaagcgcacatctcaagtctcccaggatgttcaacgcgttcacacacacaccacgtgcttgtaatataagcgctgtgagcccatctcccattattgggccgccacattttttcacactacaccaaggtcgttatacgcaacgatggggatctcgctcgcgcggttcaaacacaggttcacttccaagggttgagcgttacacaccccactgttacaccgccaacagcaccacatagtcgcccaacccaccgacagaaccccaatatcccgttgtggcgctacacaccattgtccttcaatttcaaagcgcaaaaacacctctgatacacccatatctacacagcagtggcgggcaatatatttccacaacaaacaatgtactcctataagacattccgcaacagcagagcaccgatacagccagaaaggattctccctcaggaggaccgtgttcttcccactctatcaagcaccacgtattctatagtatacgaccacactactattcccacattcaaggataaaaagggaacatacgccacctcatacggagaggctcattcacccgcaactacacttcacagacgcagggactacacacacaggggccgcacacaaattctcacagtcgcaccacacgcttaccacccaacaagtgctgacatcttccaaattgacaatcgaaagagcggtagcaactttcttgatacgtgggcagacggcatctcacgctacactagtacacatttcgtcgtgaaaacaacacaccacaacagtatcattgcggacacaagacaaatgtcagggcaaactcacttatattcaacggaggacaactaacctatacttagctcaccaccacatcttgatttcatccacacacgccctcacttctcttcacaagcaacagacgggctatcttaacagccaagcactagaatacaacaacacacgtcggtgtggggcaaacaacacaagcggagtaatctatcaattacagtggcacactcgtggatgcacaacgaaacgcaattccccttactatgataggccaccaaaagatcacgtcagaacaagcgaaaagccacatatatgataaagccattaaccaatcaaacaccaccagaggaaactttacaaanaattccaactagtatatcacctgtgcacagggaagagagacacaataatgcaacataatgacacaacactatgtaatcacatgaactatacatctaacaacccccacatggaaaccacagaaatgaaagacattgaataactctctatcccacatcctacaaccaacgcgcaccacgaccctgtggaacagccacttgtagtaagtacaccgcaacactgtcgtcctcagggcatcacactaagcaggac

SEQ ID NO: 502075 - DNA, 1493 bp, Homo sapiens
ggtcgtcctctagtggtgcccctcgttgtgttggaaggcagggtcttctttttctccggggggggggacacgacacatagtggggggtcgtttcacacagatgtgttcaacgaagaagattgtgtgcgttggtgtctcacaagaagaggagttttttgtcgcttctgatggtggacacacaacaacgtttgttgttgggggtggataccacagcccctcccaagtgtgtggggtcgccctcccccccccctctgtggggggaagacgacacacgcgcttggggggtgttttgtgccatcacggtgctgctgtcactagagcggtgtgggagttttttttttctcttctgttgcgtggtgcctccctctgtctccctgcctggggtccccctcttaatatttttgtgccgcgcctccccgcgggcgtttttgttgcccccccccccctgtgtgtttatttgtgtgggagggtgttgtgccccaacacgaccccggcgggcgttgtcactccaactgggtggggcaacgatcggcccacaacagggtgttggtggtctctctgtagagtccttccgtagtatgagggtgattaaatagatgtggtttgttgttttccccgccccgcgtgtctgtgtggggtgtacaagatgctgctgcggagaaatgagtatgggggccgcgcctcctccaagtattgtctcttgaagacagtattctctgcggtgatgattattgtctcctccccccactctcctgtgttgagaatagaatatgggtgtttccctctggcgcacacagcgccacactctcgtgtgtgttctctagaagagctctttctccacagagcctattttccacccctctctcgggggttcgcctcttttgtctctgttgtctgtgagataatatgggacgcccgaccccacttttccgcgtgtggggtgtgtgtctactctcacacacaccacgcggggagacacaagagagagggtgtgcctggggagagcctgcgcacacagagtctctcccacatgtgtctctcgccccgaaatagcctctcagagaaggggtaaaatgagagatatatatatatctccctctaatatctcctgtccacccccaacctctcttataactcaccgtggggtggggatagaaccgggtgttccacgagacacttgttttgtttttccaattgtgggcccatctctataagtgttatagtatggtgtaaaagagctgtggtgtataatagaatataccaacagcgcgctcttgttaaaccctctctcacagagagaggagaaaggaggaatttgtttttggagcccactcttggtgttttttttttgcgtgtggcacggtctttataagttatttatagttttttaaaatgcacgtacactttttatatatgggaacacacacacttggcccacaaaatttgttcaccacagaattttggggccccctttaaaaagatttaatggagga

SEQ ID NO: 502076 - DNA, 85 bp, Homo sapiens
ttcggcacgaggtcatttgtcaacagatctttttttttccccctatcagttgatttttcttatttacagataacttctttagggg

SEQ ID NO: 502077 - DNA, 1046 bp, Homo sapiens
ctagaaattatataagaaagtcttgaaagattaaatgagttcacatcccactcctaagaaattatctgggatcctggagaaatacaaagtgaaaagatctgtggcttatagtatcttgggcttaacaaccaaatttaatatgcaaacaggatcataaattaactaatatctaacaaagttgggtcagaaaattttcaaaactagaagatgaatgagctaaactgtaatgcttagttatgccttttttttcttttccccttttttttattttttttgggggaagaggggggccccccttttgggcgcccagggggggggggtggcgggggggggccaaacctcggggcccaaagggaaaggccccgcctcccagggttcaggccaattcccgggtgccagggggcgcacccaaataaaggcgtgcgacagtgggggggttcccggacaaaaacttccgggaaaaacttagcgggggaacttgggcgggcaacagggggggcgactcacaccggatgttgcggaccagaggatgtggcctaaaatactcgggcagacacaggagaccacaccagggccaggggcctccccaaagggtgcgtgggctataaacaagcggtggagcccacacgggcaaagtggggcctaagagtaagtcatgacaaaccaggggagaggagaggccaaaaaaaacccgggggaattgtacgaagcttgcagcacacaaaaggttgtggccccccaattggtgtgcccaacggtgggggagctcaaagggaacacattggggccaggtcaagcggtaaaggccacaacaaaacgttccatgggaaagccacaaatataccggggggcgggtgcgaacacaaacacaacgtggacgtcgcaactgacaggcccagagaagcacgagcgcacacggggtaaccacaactgcctcaggaaggagcagaaactaacaggaggagacaggcgtgcgccaaacaaccatcgtgctcacaaacaacagaacgcgtagtgcagcactgcacacaagcaacacgcgctcg

SEQ ID NO: 502078 - DNA, 174 bp, Homo sapiens
tgagaatcagattgagtccaaggcagcctatgtccttttttaccaacgccaggacgtggggcgacgcctgctgtccccggccgggttatttggggccccagcctcccctgcctgcagctccccccccagctttgagttcatggatgttaatttagagccctgggtcctgcccca

SEQ ID NO: 502079 - DNA, 457 bp, Homo sapiens
  misc_feature (16)..(16): n is a, c, g, or t
  misc_feature (42)..(42): n is a, c, g, or t
  misc_feature (44)..(44): n is a, c, g, or t
  misc_feature (353)..(353): n is a, c, g, or t
  misc_feature (360)..(360): n is a, c, g, or t
aagttcggaacgaggntgcgtgccttggaggactgctctgancnctgtgcagattggtgctgatgattcttaccagttgtgtgcaagaaaagaaatcagagacgctgcctgcctgctcccatctctcgcgcgctctctctctcttctgctctctccctccctttgcaaacattggatttaaacctgctcagaattcagcacagaggaaggcagcagcggtagagcaagcagaagcagtagcaagcccggcagctgagagcaccgcagcgtcgagatgtaccatcctgcctactgggtcgtcttctcggcgacaactgccctgctcttcatcccatggagtgccccgtgcgcanggacgantgccaccttccccaaagctatggacaacgtgacggtccggcaggggggagagcgccaccctcaggtgtaccataagatgaccgggtaaccgggtggc

SEQ ID NO: 502080 - DNA, 130 bp, Homo sapiens
gagtgtgtacaagatctctgttacaaaaccactttcctggtggatacaaaaaggtctttggaactcatctcatgctatacatggtgaaagatgcacttcggtcttttgtcagatcctccgagtgctttcc

SEQ ID NO: 502081 - DNA, 364 bp, Homo sapiens
cctggtgaaagcacaccccacagagtaggagtaggccggcacaagcagctcaaacgcctagttacagaattttctggggtttaaataccttctcgaggtttcccactggttattttgtgtacaccctaagtaaatgaagtacctgcaatcagtctgattggttgcagaaagcaaccaatcagaggcttaagtgaagttacaaagttacaccccatccaatgtcttattggttgcagaaagtgaccaatcagaggcaaaagtgaagttacaaagttatactcctttgcaaatgaagacttggcccatgaccagcctgattggttgcaggaggggaccagaggtactttcagtttttcatctgcca

SEQ ID NO: 502082 - DNA, 444 bp, Homo sapiens
  misc_feature (289)..(289): n is a, c, g, or t
  misc_feature (335)..(335): n is a, c, g, or t
  misc_feature (390)..(390): n is a, c, g, or t
  misc_feature (417)..(417): n is a, c, g, or t
  misc_feature (438)..(438): n is a, c, g, or t
agggctcggcgtggtggctcatacccataataccagcactttgggaggccaaggtgtgcagagctcacctgtagtcttagctacgcgtgaggctgaagtgggagaatggcttgagcccaggaagtggagggtgtagtgagcggagatcatgccactgcactccagcctgggtgacagaaccagaccctgtctcaaaaaaaataaagttatatgatttacactacctgacttcaagccttgctagaaatgtccaacacttaagaggtaggcaaggtgtcctcagacactncagacagaacacagaaagcaattaaccataacagaaattattgatnaaattcggacttcattcaaaattggaaaacctctgattatttatttattgagatnggagtctgggattcacacccgtttttnctaggcctctttgtggagggnccaggg

SEQ ID NO: 502083 - DNA, 101 bp, Homo sapiens
  misc_feature (12)..(12): n is a, c, g, or t
  misc_feature (82)..(82): n is a, c, g, or t
ggcctattcctnctgctttcattgcacagtattcagcattcttgagcgtaacaagcctacattgcctgcggccctgcctttnttgtgatcctgaagacttt

SEQ ID NO: 502084 - DNA, 1010 bp, Homo sapiens
agccaacctgagggcgttcctgtctggggctgcagcgtggcgggaggtaatggcatgtgccagtgcctggctggtgctgcagagcgcctgtgcacctggtgtccacgcctcgtggtgacgggcttccaggatgttctgggcgctggggcggcccatccgcatcccccaagacccacacctcctggcctgatgcctcccagctgcctgtgggaaccacctcctgtcctgctgttgcttggccctgcatcctaggcagctggccatgactgccctccccagcctggcatgccccccttgacctgggacgatgagcatacgactggtgtaaggtgcaaggctcgatgccccgttgccctactggaccacgagggagtagggttcgcatcataccctttgtcccctcgtgatacgagacctcaatgcgaagcctgggtcgcctggacccttggggccaatcaggcggtgcaaacttgcccccaaggaacgatcatcttctgcttcatgctacgagtggctgactgacccttctcccaccctactgacatgctcagctacagtgccacgcgaaggggggcagggaccctgggccggaagcccaccgaggatggagacaaacgagcgacaggggtggaccaattccacctcctttgcaaacggagttaccaaagttccaggactattaacccccacatctgatgttccgaggcgcttgtggtgagcaactgaaagtaaccagcaattgggggcgaagaacggcgtcgttaatcggggcccctgcaaacatggtacataggagagggtctgcagcaccccgacgggagacaccgagtgcgtgtccaattaggcaccagcactcaccgagtgggcacattgtgtgattggccccaccagttactgccgttgaaacgacctggggggacatgtgggaaccccaatgggaacatgcagaacgtccgggtgtcaatcccgctaacagggcatgtgttcccgccgattctgtacaagctccg

SEQ ID NO: 502085 - DNA, 273 bp, Homo sapiens
cgtcgacccacgagcgtgagatatgtgacttcgggtgagctcgaattggttatacacccgaagttgaacagcatgaatgccttcatgccgttcaccattacttctgcacatagggtgcattgaagttctgaggaacatttcggctgtcctgtcgagtccattatctgatggactcacaggtcatacagccatgcgttgcacacagtttgtgtgggcagtccggtggtcaattgaaaggcttggaccaattggtctatccttccttttgtcgac

SEQ ID NO: 502086 - DNA, 599 bp, Homo sapiens
  misc_feature (496)..(496): n is a, c, g, or t
  misc_feature (501)..(501): n is a, c, g, or t
  misc_feature (508)..(508): n is a, c, g, or t
  misc_feature (561)..(561): n is a, c, g, or t
  misc_feature (599)..(599): n is a, c, g, or t
tgaaaccctgtctctactaaaaatacaaaaattagctgggcgtggtggcaggcacctgtaatcccagctacttgggatgctgaggcaggataatcgtttgaacctgggaggcagaggttgcagtgagctgagatcacaccactacactctagcctggacaacagagtgagactccatctcaaaaaaaaaaaaagtagacatctatttatacatatatatacacacacatatatacacatacgtacatatatatatacacacagacatatatatatatacacacacatacatatatatatacacacatgtatatatataatttacacataattacacagcttttttaaagagaagtaggttatctcaagcatttcaaggccagacacggtgtctcacgcctgtaatcccagcactttgggtggccgaggcaggtggatcacctgaggtcagttcaagaccagcctggcttaacgtgtgaaactccgtctctactaanaacanaggtggngagaattgcttgactaggaagttgaggttgagtgagccaagatggtgccacgnacttcagcctgagcaatgagcgaaactctgtccaaaan

SEQ ID NO: 502087 - DNA, 1247 bp, Homo sapiens
caactcattgagttgtataagtcgtcgaggttgtgctggaaacctaataatgatcatgctggttcaagtcgtcttatggtaaatgacttatagtgaagcttatttataggctatcataatctgtacgattattcatccaaaccgatgtctagagaagtcgggggataagatgttcttatatattctcctaggaatttgttctaaatccttgccctatgatacgttaaacgggatgtggtctaccttatctgaaaggatatatcccttctctgaggatgtcttgggtggcatgcacttaggagaataacaagaggaaagttatctaatagcgttaaacagcttcatggtagccgacactcgctcaggagtgcagtacatgccagtatagtcatgcattgttagaatagtagggagccaatttatagcattagcgattacagctgcttctcttctcttctcctcgtgcatgttctctacactgctctcatgcacctctgtgctctctcctcgtcttcttctcctcttctactacaaagacagcacaacacagaacacaggaacacagacacaggactacatagagatggtgtaccgctgtcattgtcgttgaagaggtgggacgtggagacactaagaaaaataaacgagacaaatatgtagatgaagagataggtaactttgaggttcgcataaaagtagaagtaatataagaagtggagagcataagtgtggtaataaagtgtggggagaaaatcacggagtggtataaatgaaaccgatgtcatcgcaagaagaagggtgtggacccgcgtgggcacagcacatcactgggagtagcgagctggtgaatcagaagccaggaggataatcgcaagacgtgcggagacaattaggtggcagcacaaaaaacaaggaggtcggtaggagcatacacaaagcagaagagaaagccaagccagacgtctgcaacaaatatgacaacgaacaatagcagcagacaccacaaggagtagggagaaaacacgcacaaaggatggggcaaccccacaaaagagtaagagagcggcgacacacgaagaatgggggaagaccaaaaggatggcgagagagagaggagagacaaccaaaagatacagagaaaaagagaggacaaacacaagacaacacaaggaccaccccgggcaaagaaagtaagaacacaaaaacaggacaataaaaaaggaaaaagaaaagacaagccacagaaa

SEQ ID NO: 502088 - DNA, 395 bp, Homo sapiens
cgatggaatcatatggcgcgattacttgtggtccactcagctgctctcagacaaaactccttccaagaaacgtgcgcgtactgcaggcccaggaagcctgtaaggaggatcaaggcgcctgaaggcgactctcatgccaatgactgaagtggatctctacatttctacccagagaatcaaagtgctgaacgccgacacacaggagacaatgatggaccaccctctgagtaccatttcctacattgcggacattgggaacatcgttgtgctgctggcccgccggcggatgcctcgctccaactcaccaggagaacgtggaagcgtcccacccatcccaggatgggaaaaggcagtacaagatgatctgccacgtcttcgggtcgatagggtcccga

SEQ ID NO: 502089 - DNA, 407 bp, Homo sapiens
cgaggtgactctaaatccgtctactcgccagtgcattgttgcagtcttgttgctgccaccaagcgggcagaaagggttgaatgtaaaaggaacgtaagggctgagagcaggggctcacccctgtaatcccagcactgtgggaggctgaggcaggtgggtcacccctgtaatcccagcactgtgggaggccgaggtgggcggatcacctgaggtcaggagttcgagaccagcctggccaacacagagaaatcccgtctctactaaaaatacaaaattagccaggcgtggtggcacatgcctgtaatccctgctactcggaaggctgaggcaggaagatctcttgagctcaggcatttgaggctgcagtgagctaggactgcaccactgcactctagcccaggtggcag

SEQ ID NO: 502090 - DNA, 302 bp, Homo sapiens
tgatctcgtgttgtgcctaagtcttcttcctcctcgtgttgtttctgatgttggctgtgcattgtgcgcaagattatatctaggatctgtgtaaggacttggtgtttccaatagattttagcagtcctattttactgattttggcctgtaacccctgagaaaaccgattttacacggttgggtagaatttgtagtaatgatccacagggcatgcatgttgtgtatcagattgcgtttagcaccattcttcttaattgtctgatcaagcttcacagcaattattaaagattatttaaatttga

SEQ ID NO: 502091 - DNA, 216 bp, Homo sapiens
  misc_feature (27)..(27): n is a, c, g, or t
  misc_feature (70)..(70): n is a, c, g, or t
  misc_feature (97)..(97): n is a, c, g, or t
  misc_feature (149)..(149): n is a, c, g, or t
agatacggaaaatgaaaaagaaataantccccactttcagtttttaatttccagttaactgacacaaganttcttttaaaacaaaggttaataaaangaagcataggccaggcgcggtggctcacacctgtaatcccagcactttgggnagccgaggtgggcggttcatgaggtcaagagatcaagaccatcctggccaacatggcgaaaccccgt

SEQ ID NO: 502092 - DNA, 314 bp, Homo sapiens
tgggccaaatctcggggtgttccgcaaaaaaaaatccaaaaaattccaaatgcagtgatatccttttaaaatgcagatttccaaaacatatttttttccaggtggccttttggtgtctggctggctgagtgtaaaagttgtttatctggacgatctgtctctctgcttccaaagaaatttgggagtgagtggcagctcctgcgccagcctcgcgggacacgtgttgtacataagcctctgcagtgctcctctttgtaaaggggggggtacctgcttggtttttatttaagaagaaataaccacgactttttttc

SEQ ID NO: 502093 - DNA, 137 bp, Homo sapiens
ccccgggggcccctttttttttgggggaaaaaaccgggtgttcctcccccccgaaaaaaaaagaaataaaaattttttccaacacaaatgaatcggttttcttaaatcaaagtttaatgtataaagttaaaaaaaaa

SEQ ID NO: 502094 - DNA, 227 bp, Homo sapiens
gtccgacaggtgggcgactcgcggtcgatgtggtgatcgtggtgctgaacaccacggtgctgcgtcctgcgccggctcggcgacgatccgccagcgaccgtcccccgagacggcccggacggtggctggggccggtcggcaggctcctgggcagctgcggcgacgggtcccgggtcgggatctccgccttgttcccgaacccgtcctgcagcgggaccccgttcggg

SEQ ID NO: 502095 - DNA, 252 bp, Homo sapiens
cgatctagaggatccctgagagaccgtgtgcatgggggagtccctggtgctcagtgagttgaggattcagagttgtcactactgtggctcaggttgctgctgtcgcaaaggtttgaacacagacctaggaatttttacatgccaaagacacagccaaacacacacacacacaggcacacgcacacatatacacacacatatagaaggggtttcctatcaccaagcatgggaccattgcaacacggtctctca

SEQ ID NO: 502096 - DNA, 552 bp, Homo sapiens
ctgggactgcgggtgcacgccaccatgcccagctaatttttgtatttcttgtagagatggagttttaccatgttgcccagactgtcctcgaaccccttggactcaagtgatccacccgtctcagccttccaaggtgctgggattacaggtgtgagccaccgcacccggcccactactcccccaacattttatttaagcgttagctgggcatatgtggcgcacacctttggtcctagctaccagaggggttgaggtgggaggatcacttgagcccaggagtttgaggctgcagtgagccatgatcatgccactgtgctgcagcctgggtgacagaactagaccctgtctcctaaaaaattaaggctgggcacggtggctcacacctgtgatcccagcgctttgggaggccaaggcaggtggatcatttgagatcaggagttccgagaccagtctgaccaatatggtgaaaccctgtctctgctaaaaatgcaaaaattagctgggcatggtggcgggcatctgtggtcccagctactggggaggctgagacgg

SEQ ID NO: 502097 - DNA, 904 bp, Homo sapiens
agcggggtcgccgccgcgccggcgcctagcccgccgggtcaggcggccaggcctcgccgccgcatgaaaaagagcctctcagcccccttgacccggaatttgaagaggtctacatgattctggggctagagagcaggaaaactccgttagtgctgaggaaccagtggatgcgtttgccctgattcccaaaccaccagtttcatgctgcgctagaggagtcctgacagaagtccaatctcaatcaaaagccagaggccccctcgatcatcgctcactccagtcgccagtccagaccgaagacggcgaatgacaggaaacatgcccgagcaccgcgaaaagcccgcaacaaaggcacccaacgatcagggaggtgggacaacaattcgaggagtcacaaccaacagacagagccgacagcactgtcaaggacctccaggtgaccccgtagggatagagcagaagcctagggacaaggaacgagaccaatgagagtggcaaaacgaagagaacagcacgaaaggggatgggcgaccgcaaggcaacagcaacaacgtccaagaagagaaacaggagaaaccgaaggaagaacacttggttggattggaaatgatgcacccaggacactgagtgtggaacgcacacgaaacagctcggtgcgaggcgccatgagtaccagtattgggcataactcatggttggatagagtaagcacaaactcgtggtgggtgaattatacatcctattcaaacagagctaatcaagaacgacatatataaactattgaagattatgtaagtgtcacacccaattattggacaatttgggtcacacgaaataagcaagctttttatgtcgagacgagcgccaattaaccctgacacgcgcgacattatctgttcacaat

SEQ ID NO: 502098 - DNA, 1291 bp, Homo sapiens
atccggccacaatattttaaattacgtacaaagatctgacgatgtgttcacccagggaacccattttcacccacgtggtcgtggttgggccgccaggtctttgtggtcttcgtctctttcagcaatgtgggtgaggcggatacccttttcctcggggaagagaaatccagtggttgtggtgtgcccttgggccaattaacaaaaagtgtgtggaaagtctcgagtgtggcaacagcgtgtgtgccagtgggccactcttttcagcggtaaaccagcgttcaaagagaactccagggtgtgccctcttcttcgtggtgggtggactcacaccaatattcttttccataggtgtatagcacctctccagtgtcacccatatacaacaggtttatccacggtggtcgaaactttgtatgtgaaattcgagaaaaatcttgggcaaggtcctctataaattcaaactcgtgaagtgggtattcatctccaccttgggagtgcaggcggcactcggggaataaggcggaagtgggtggcgggccatctcagtggagtctcaccgagaagtgagagcggaattccttcttgtggtgccccaccaagaggactcttttcttcaacttttgggcaaacaaacgtggggtaccttggggccctcacctcgagggggtgtaaatacggaagtgttacacagaaaaaggcagacccgtgggggtgctcacataaaaatcaaacaccgggcaaaaatccctctctaccccgcggaccttgggctccaaagtggggaggatgtgaaaattctcagtgaaaattcccaacgcaccagggggctaacgccgtatacatacctcccacgttaccgggcacacttttgtgccacaattcccgaacatcttcttaacaatgggaacacccggttttgcctatcggcaaaaagctcccactgcctgtaacaaaccttgtccaatcccatcccacgaggatcacaagggggcccataacctcaccaacacttcgggtgtccccccccaggcggacaccctctcgacccgagcgcgggaggaacaaacatctcacgtaccacaactctttgtgcggcggcacacccgggcggaattcgaccagcaagggaggcaacaaaccaccaccccgggccccaatctcatacacaggagcaaatccaaccaagggtttagggcagacactgcgccaccccggctaccaacatgcgctcctgggggaaccacgggtcagtctacaaaaaataggcacgaagcagcgagacacaacagaa

SEQ ID NO: 502099 - DNA, 161 bp, Homo sapiens
aaacattgcggacggactgatcagagggaactaggggtcggctgaaaggattatgggtggaaaacattggctcttccttggggagtgatgctgggtgaaatgggaacgatgagtggctcagacctgacagagtaaaatagagctagtaaatagccaacggc

SEQ ID NO: 502100 - DNA, 362 bp, Homo sapiens
caggaaagtaaaacaggattcaaccctaattagaaaatgtggatattaactgtcatgcaaatgtttattagcctctagaattaacttttttttagccggatgcggtggctcgcgcctgtaatccagcactttgggaggctgaggtgtgtggatcacttgagatcagagttcagggccggcctggtgaaaccctctctctactaaaaatacaaaaattggccaggtgtggtggcgtgcgcctgtggtcccggctactcgggaggctgaggcaggagagttgcctgaacccgggaggcagaggtgcagtgagccgagatcacgccaactgcactccagcctgggtgacagagggagactgtctc

SEQ ID NO: 502101 - DNA, 255 bp, Homo sapiens
agctcggtacccgatcattttcttcttccggctggcttgtctgactgggaggctgcttatctcctcttggccacccaggttgaggtcattgtttaaagggccctagcaaaccaacatagcagctgacagatgaggcaacagagtctcctcaaggccaatggcttacccaagattgcccatgcattcggtgagtatttttgagctctgaccatgtacctgacttcttctgggcacccaccggaagaagaaaatgat

SEQ ID NO: 502102 - DNA, 316 bp, Homo sapiens
ttttccccccaaattttttccccgggggcccccccctttgttttttttaaaaaccccccttggaaatttaaaaattggggggggggccccctttcctggggtttgtttgttcccaaggttttgtgggggggggccccctttttttccaaagggggccctcttttttttgcccctttcccaatggggggcccttgggggccctttgggggggccaaaaatggggttttttttttttttaataacccccccgggtttttccttttgttttcttgggtttttttttgggcccccgggaaataaattttgtttttggtta

SEQ ID NO: 502103 - DNA, 332 bp, Homo sapiens
caggatccccttgtccctggagtagggactaactatagcacaaagtcatatgtgtctttgctatttgtgaaatgtttggtctttctaatcttctataggttttgttgggtttttgcttaagttttgatccaaatcctattttcagctgataatatttaattatctattgttttttataatgatgtaccaatgagtggagattcctccttataatgtatgataggttatggaaaaatgtaaaatattcaactttttcatcctttttttgaaatttgtattaaaaaagcaatgttttattcatttttaatcaataaaaagtaaaatgtaaaaaa

SEQ ID NO: 502104 - DNA, 379 bp, Homo sapiens
atgaagtctcctcagcaacagtgagaagcctttctataccctcctctcttcctcctctcctgcacttttgagaacagtgaaactttgctctgggaggcaggaggtggaaaagccacacgaagaggaagaatggaagccagtgactcagtttaacaggagacactagagtcaatgtgataccacaccttccccaaacataaggtccaaaaagcttctctcctgttgccaaaaattcttctatcaccccgttgtactcctccttggcagcatcaatcaggcagggctcagcccacacccggctcctaaagacaagagagcagagaaagcagaatggtgtttagagaccatcgcagtgacctgatcctgaaagcacctgtag

SEQ ID NO: 502105 - DNA, 239 bp, Homo sapiens
cttagaggatccccacaattattcgggctatgtggagcaagctgtcttgcattatgaagctatattgggctctagagaaagtgagaatggaaagaatgtgagagatacgttagaccataccaaacaaaccacagatttccataatttttaaaccaaacacatgcaatataagcccttcccaaggcattaactgctctgaggcccgggcttacttggccattagcactgcaatacgatat

SEQ ID NO: 502106 - DNA, 406 bp, Homo sapiens
gctgtctagaggatcccggaatgccggcggcacagtattcctgattgggagcgtgcagggggcctggaaagcatcacggcgaggccagaaagtcattagcgagcataagaacgggcgcttctaccagttgtgaagtggtcaggctcaccaccgatgaccttctatgaagtcaacttggatgatggctccttcagcgacaatctttatcctgaggacatagtgagccaggactgtctccagttgggtcctcctgctgaaggggaagtggtccaagtgagatggacagacggccaagtctatggagccaagttggtggcctcccaccctatccaaatgtaccaggtggagttggaggatggctcacaactggtggttaagagagatgatgtatacacactggatgaag

SEQ ID NO: 502107 - DNA, 1616 bp, Homo sapiens
  misc_feature (302)..(302): n is a, c, g, or t
  misc_feature (311)..(311): n is a, c, g, or t
  misc_feature (702)..(702): n is a, c, g, or t
ctgtgcgcgcgcggcgcggggtcattgtaggccgcctttgtggctagagaggtgctcgtctactgagcttgctaggtccggcgcatccggctgcgcgcgccctaccgtactggcatatgctccctgaaataccaccacggtgggctatcgtgtatcagatgcacgtatgctagtgaggccctaggggtggttggagcgaaatgggcgcgattccagcgcgtgcatcctggcagcctggattagaacatcttgcatcccgtgatggtctaggacacggcactccgacactagtggtgtcctgnagatcatcnaagagagtagattgggtctgtacgaaggatgaccttggagtcgagtcggtggtgatggacatctgtcgccacgagatggtcaagcgtctgtcgaaagagtcgggagtgggcagggtcccctttttcaccctgggacgtccactacgattgggaaaccctcttataacacaggggcggaaaggacttgacagtgctcgtggggcagcgaacacgcttgcaagagtaaaggcgccggtcaagccccaggagctaagccctacacattgcgaaactcgaggtgacaattcgaggaggccttccgggtcaaaaatcataccttcctacctggcggacgcaatatatggttactgtataccctgcggtgaaaaccgcggggagactgattccctcntttgcaaatatgttggcccgaatggcaaattatcgtaagggaatttgccacaaatacaaaaaacgccaaaagaacataaagccgtgagaaccatgggcattgggggggtataatcctgatttgccccttcccgggtgtagctggaagaattccacgtgggtactataccaatagtgtgcgcatccgcctgtgggttggaaaaacgaaggtactaaataggcaaggaattagcaacgtggttggcgacgagccagacagaccgggccgggaaaaaaccgggggccaccaacgtatctacgacagtcctggaggggggagacccccggagaagctcgggccaatccactggttgggcaagacacgggggaaagaaaacccggggccccaggaaataccctgggcccgtccggaagagccgacacgaaggggtgtgaaccagaatatcactccagggcggccagaggacgaaggcccagctggcagggtacctgggcgcacgggccaggggtaaaaggctgaaaagactatacggaaaaccaggggtggcagctcgtgaccaccacattactgtggcacatccacacgactcacggcaatcgtggccgtacaaccagtaaggttaacgctcgcgctttcccaacatgtggtccagtggctcatcacaaatactaagtaggcctccaccaactgtggagtgtaccaccagtgtggtccagcacccggaggtataatgacacccagaccgccccgcgaagtaactacaaccatgtaggagcgataccaactaagcagtcgctattgaagaccaacaaaataatagctgcgacgacggaacacatactgatccaaaatagacgatcagacaccgtagtcactttcgcctttcgtgatatcttctccgtcgctctatagga

SEQ ID NO: 502108 - DNA, 174 bp, Homo sapiens
agcgcaaaccgttcatcatttggtgcttagtctatagtaagggctctctgtggttggactatactccagctaccgttaaatgaggacagatcaccttaaaacatgtacatttgattcataacaaggaaaattgggtctatgatttattgccaatcttggcctaaaagaaattgc

SEQ ID NO: 502109 - DNA, 386 bp, Homo sapiens
agtaaaataagaaattgatagatttcagcctttttgtagctgttctcagtcatttttgcaatatacagtatacttagattggagccatggcatcttcagttgaaaagaacctggtagcatctagtccaggcatcatgaatggccatacctatggagccaggtgggtgacatatagcagtaggattgtggccagtggaaagtgactccttgtctaaacgtggctactgcaactctcttccaggcatcgggtgtcatgtcaaaatgaaagattagtttttcaaggtgttttgagcagtattagatctatatgttatataaaatcttctgacttttcaatgttgtcaacatatccagttttttgaaacaaataaatatgccaaaacaaa

SEQ ID NO: 502110 - DNA, 364 bp, Homo sapiens
aaagccatttctaagctatatacagtaggtagcttttttgttttttcttttaggcggagtttcactctggttggcccaggatagagtgcaagggtgcgatctgggctcaccgcaacctcggcctccggggttcaagtgattctccggcctcagcctcccaagtagctggattacaggcatgcgccaccatgcccagctaatttggtatttcaagtagagacagggtttctccatgtgggtcaggcgggactcgaactcctaacctcaggtgatctgtctgcctcggcctcccaaagtgtggggataacaggcgtgagccatggcgccgggccgggacggtccatccttaaaggcagaggcctaa

SEQ ID NO: 502111 - DNA, 953 bp, Homo sapiens
  misc_feature (745)..(745): n is a, c, g, or t
gtaccagtgtgctgctgcatcaaagtgagaaaaagcttgggagaagtgatatcagtacctgatttcagacaatcaggttttagttgtcctgaaaagcagtgtccttactctcactacgtttgtgagtgtctgcatggcatcggtgtgcagggattggcatcgcgtctttgacgtcctatgtgggcctgttgccccgctgcgatagcggcgcatttgagtttttggcctttctgctccgtgcgtgtgggtgccactttagactgcctgggtgtgccgttgcgggaaatgggcgccaaaggttaagctccgcatatctggcaccgtaggtgatgcttgcgtcccttggattacatgacaggaagtcgatcagccttgaaagatcccaagtggcagtgctgcatttctggccgacgttgaatcacgggtgggcaagtgcgtagataagggacagaaaagtgggaggtagggacggtatggccagggggaacgccgacggattgaatggaacgtgatcctctgttttccttttgtcaactgggtcgagcatgaagactgtccgagatggctgcgaggggtggtagtccatcaccagaggtccagcgtttctgttaggggtaacccagttacagggggccacgaagggtgatcatgacgcgctgaatcacgatgacccgtaagtgcaatgtgtcgttcacatagacattggcggagctcaggcagtctggtgtccctgacgggaattctnaggcaagtttcactgttaacggcccttacgtggaaattagtccccagcccagatgctcgtggaatctcggaaaatgaacgcaaggccttggagtgacactgaaggagagagacgcgtaaagggcgaacacaatattagggggggaaaaaaaaaatgcgccccaaaaaattgcgcgaatgtcttcactctgtgtaacggcacaatatta

SEQ ID NO: 502112 - DNA, 151 bp, Homo sapiens
cttgatgtatcccagtcactgtgagacttccatgtgcccgttgtctccttgccgcgggtcccgcacgctctcctccaggccctccagctgggacttgatctatctcatactctcgctcggccatgctggctcattcctccagctcgcagta

SEQ ID NO: 502113 - DNA, 490 bp, Homo sapiens
  misc_feature (99)..(100): n is a, c, g, or t
  misc_feature (466)..(466): n is a, c, g, or t
ttcggatgcgaagtgtcagaaaggatcgcaagtaaaagaggtgtgctacttgactaagtgacccctaagggtgagttagaacaaacaggtagaagtgtnnggagacagatatgggctcagcataaggaagagctttgtcataattgcctgaagagcaatcggccaatcctggagaagatggcaatgagtttatgaacaggatgagttcaaatagactggttcttaacatggagggactgtcatagacagggttcaagtattggatgaggctgggactaggtaacttttggagcctctgcttatagtctcatattctttgatacttgtctgaaatgtaaaactttttgaaggtaggtgttatttaaactctgatttcaatgtgagggaaacgttatgataatgatataaggttgaaaaactttcaaagaaagaaaactattcttgcccagatgtctacctggagtanccacttgacactttgcatccagag

SEQ ID NO: 502114 - DNA, 209 bp, Homo sapiens
ccagaggtgtattggtaccagtgggcaattcttaacacggacatttacaaatgctgctttctgtattacaacaaaatgatatgcaataacagaaattggaaaaagggagcaaaggcagagtgccaagtatgtactagaggtctttctacgcggtgcctgacagcaatgcagattcagcataacaaatgtagactttgcaacatgtggcc

SEQ ID NO: 502115 - DNA, 269 bp, Homo sapiens
ctatccctctaaattcttcacttcctgaacatgacaaacaaacaaaaagagccactgcagggcccttggactaaatccaggcctgagttgctgggcagtaggtcagtcttgtccagacatgggatataaataactcgagtcagacaggtgggtcatcacatgaactaatccagcctgcaaagtggcctgtgcaatcttcagtctctgtccagcacctgcctccctctggaataggccggaatatattgcggtaccgtagctcagaattc

SEQ ID NO: 502116 - DNA, 80 bp, Homo sapiens
  misc_feature (66)..(66): n is a, c, g, or t
gggctgcaggattcggcacgaggatgatcagacagaggaggaacctattttgcttcttgaatctgnagatgagctacttg

SEQ ID NO: 502117 - DNA, 790 bp, Homo sapiens
  misc_feature (5)..(5): n is a, c, g, or t
  misc_feature (19)..(19): n is a, c, g, or t
  misc_feature (25)..(25): n is a, c, g, or t
  misc_feature (32)..(32): n is a, c, g, or t
  misc_feature (41)..(41): n is a, c, g, or t
  misc_feature (47)..(48): n is a, c, g, or t
  misc_feature (53)..(54): n is a, c, g, or t
  misc_feature (59)..(59): n is a, c, g, or t
  misc_feature (61)..(61): n is a, c, g, or t
  misc_feature (64)..(64): n is a, c, g, or t
  misc_feature (95)..(96): n is a, c, g, or t
  misc_feature (104)..(104): n is a, c, g, or t
  misc_feature (112)..(112): n is a, c, g, or t
  misc_feature (120)..(120): n is a, c, g, or t
  misc_feature (128)..(128): n is a, c, g, or t
  misc_feature (132)..(132): n is a, c, g, or t
  misc_feature (134)..(134): n is a, c, g, or t
  misc_feature (136)..(136): n is a, c, g, or t
  misc_feature (138)..(138): n is a, c, g, or t
  misc_feature (148)..(148): n is a, c, g, or t
  misc_feature (178)..(178): n is a, c, g, or t
  misc_feature (186)..(186): n is a, c, g, or t
  misc_feature (189)..(189): n is a, c, g, or t
  misc_feature (193)..(193): n is a, c, g, or t
  misc_feature (196)..(196): n is a, c, g, or t
  misc_feature (199)..(199): n is a, c, g, or t
  misc_feature (204)..(204): n is a, c, g, or t
  misc_feature (208)..(208): n is a, c, g, or t
  misc_feature (210)..(210): n is a, c, g, or t
  misc_feature (214)..(214): n is a, c, g, or t
  misc_feature (225)..(225): n is a, c, g, or t
  misc_feature (230)..(230): n is a, c, g, or t
  misc_feature (233)..(233): n is a, c, g, or t
  misc_feature (236)..(236): n is a, c, g, or t
  misc_feature (243)..(243): n is a, c, g, or t
  misc_feature (263)..(263): n is a, c, g, or t
  misc_feature (265)..(265): n is a, c, g, or t
  misc_feature (268)..(268): n is a, c, g, or t
  misc_feature (288)..(288): n is a, c, g, or t
  misc_feature (290)..(290): n is a, c, g, or t
  misc_feature (296)..(297): n is a, c, g, or t
  misc_feature (301)..(301): n is a, c, g, or t
  misc_feature (307)..(307): n is a, c, g, or t
  misc_feature (325)..(326): n is a, c, g, or t
  misc_feature (330)..(330): n is a, c, g, or t
  misc_feature (332)..(332): n is a, c, g, or t
  misc_feature (344)..(344): n is a, c, g, or t
  misc_feature (368)..(368): n is a, c, g, or t
  misc_feature (387)..(387): n is a, c, g, or t
  misc_feature (389)..(389): n is a, c, g, or t
  misc_feature (398)..(398): n is a, c, g, or t
  misc_feature (402)..(402): n is a, c, g, or t
  misc_feature (419)..(419): n is a, c, g, or t
  misc_feature (424)..(425): n is a, c, g, or t
  misc_feature (427)..(427): n is a, c, g, or t
  misc_feature (435)..(435): n is a, c, g, or t
  misc_feature (437)..(437): n is a, c, g, or t
  misc_feature (446)..(446): n is a, c, g, or t
  misc_feature (451)..(451): n is a, c, g, or t
  misc_feature (460)..(460): n is a, c, g, or t
  misc_feature (467)..(467): n is a, c, g, or t
  misc_feature (475)..(475): n is a, c, g, or t
  misc_feature (478)..(478): n is a, c, g, or t
  misc_feature (489)..(489): n is a, c, g, or t
  misc_feature (500)..(501): n is a, c, g, or t
  misc_feature (543)..(543): n is a, c, g, or t
  misc_feature (546)..(546): n is a, c, g, or t
  misc_feature (579)..(579): n is a, c, g, or t
  misc_feature (581)..(581): n is a, c, g, or t
  misc_feature (592)..(592): n is a, c, g, or t
  misc_feature (636)..(636): n is a, c, g, or t
  misc_feature (658)..(658): n is a, c, g, or t
  misc_feature (679)..(679): n is a, c, g, or t
  misc_feature (684)..(684): n is a, c, g, or t
  misc_feature (686)..(686): n is a, c, g, or t
  misc_feature (692)..(692): n is a, c, g, or t
  misc_feature (741)..(741): n is a, c, g, or t
taaanctcttgtgctgcancaatanaaaaaanttcggttanttttannaaaannaaaancnaancccttgttttctgggaaaaaaaaaatgcaannaattgaanttgaaaangtggaaancgcctcantcanananantcattctcanaatgtaaaaaaaacctgaacctccttctanctggcaancanaaantancangtggnaaangnaaancgaaggtgggnttganaancangctccanctttctcctcaatagcaaangncangctgccttttaaaaaaaaanancaaaanngaanccaatncctcctcctcccccaaannaagnantccaatcggcantggccaaaaaaaaaaaaaaaaaantctaacctctcctgggaananaaaaatttntttntttttttttaaaaaaanaaatnnantgtttttntnttttccaanaaggncgaagttanggttttntaagaagnaantgcttaattanctcaataaaanngctgctgttggggggtgcgggtgctgctgtgggaggattttnaangtggtgtgttttcaagcctcactcactcatccncncattcccaaanattcagcatccgtgcacactcctcacttccaggtttttcaaaanatgggagatttccagtgggggncctcaggttatcatcccaatngtaananatcaancttggttcttcagtttcctcagttcttttgttgcccatgtagcaagggnttttgctttgttagtcttcgatctccgcccttcagttaaaaattcatgg

SEQ ID NO: 502118 - DNA, 161 bp, Homo sapiens
agacttagaggatccagcggtcactggctaccggggatcggtgtgcatggcctcaaggtcggtgtcgatgatcgctgagaccatcgtcgaaggaggttcgcgtaggagccgttgcacgtgcaaccgttcccaggtaacggccggtagggagttcggtggga

SEQ ID NO: 502119 - DNA, 422 bp, Homo sapiens
cctagctgtgatacttataatacattgctctgtatatgacgtctcacttggattcttcctcctttacttaattcgagctcttactctgtcatcgcttccaccggatgcttatcgcacaaatgcctcctattttgtactcatccttattacgatcctatagctttcttactgtatgtaagtttgttctggttttttaaacggagtctcactcagttgcccaggctggtgtacagtggtatgatgttggctcaccgcaacctccacctcccaggtgcaagcaattgtcctgtctcagcttcccgagtaactgagactacaggtgtgccaccacgcccagctaatttttgtatttttagtagagatgtggtttcactatgttggctgggctggtctcaatctcctggcctcaagtgatccacctg

SEQ ID NO: 502120 - DNA, 142 bp, Homo sapiens
cagggagcctggggtaattccttttactccacaaagcatccggtctcactttcagcatgtctttgtcatcgtcaaagtgcataatccatgtaccgaaaatgtgtgttatcgtgttggagtttccactgatctaaagatgtgc

SEQ ID NO: 502121 - DNA, 166 bp, Homo sapiens
  misc_feature (2)..(2): n is a, c, g, or t
  misc_feature (87)..(87): n is a, c, g, or t
  misc_feature (105)..(105): n is a, c, g, or t
  misc_feature (112)..(112): n is a, c, g, or t
  misc_feature (137)..(138): n is a, c, g, or t
  misc_feature (145)..(145): n is a, c, g, or t
  misc_feature (148)..(149): n is a, c, g, or t
  misc_feature (156)..(156): n is a, c, g, or t
  misc_feature (158)..(159): n is a, c, g, or t
  misc_feature (163)..(163): n is a, c, g, or t
tntaaacattaccagtcaagtatatacaaaattgaagtatgccattcaagccagattgtaattttaaaataacaaacctctaaatanctaagtaatgtacaatgngtaaaantccaattaaacacaggtataaatcnnatataantcnnggccctntnntgcnggg

SEQ ID NO: 502122 - DNA, 549 bp, Homo sapiens
  misc_feature (508)..(508): n is a, c, g, or t
ggcgtctggctcccgctctcacagccatgggcagtacattgagctccatagagacagctgccggggcaagtgagagccgggactgggcactgggcgactctgttgcctcgctgaggaaacataacttaaacatgggctaaaggagatcctaagaagccgagaggcaagaatgtcatcatatgcatttttggtgcaaactttgtcgggaggagcataaggaatgaagcaccgcagatgcgttcagtcaagcttctcagagtttactaagaagtgctcgagatgatggtggaatgaccatgtactgcttaaagagaagaggaggactttgagagatatgggagatagcggacgataggctccgtctattgacacacgagcaaatgaaagagctataatcccttcccaaatgtggggacgacaagagaagacgaaaggttcgaacggacttcccaaattgcaagcactcacagaaggaccttgcctattcgggacctttcctttcccgtcntacgtggcttcttgacggtattcggcctcaaagaaattcga

SEQ ID NO: 502123 - DNA, 275 bp, Homo sapiens
ggactgttggatacaggcttagcactgtgctggtcttgggctttaaagagacttattggttgtccacgattgaaacatggacaaccatatcaaaatgttattggacaaaaagggtctgatcaaaacccagcaaagcctgtctgtttagattcttattggcctctctctgcggcattccttcctccggggtatgagtcaggaccttctctggaatgagggtcttatgacccacaatcagattagagtgctactctggggaggtgggaggagaggaa

SEQ ID NO: 502124 - DNA, 535 bp, Homo sapiens
  misc_feature (535)..(535): n is a, c, g, or t
tttaagcaaatcatttaaccataagccacccagtaacaatgtagctaaggggccctctcaattaaaattaaatactaaccctgattttataagttcctaaatccaaggtcttatgagttttaaaataacagttggggaaatgttttgattatctgattcgaaatataaattaagtgtatgcaaattttggcagaatatggggggaactatttgaatctttggggggtaacagactgtaaaactgaagtgtttctggggaattcttaagttaaggtgtgaaaaagagagccagcctcgggagttggagctgacccgggtgtctcattggataacagaacagggcctgtgtccaaagtgggggcagggcacattttggtcccacaatgagttgatcaacctggggactgggggtaacacacaagtgcgcccctggataggccctctcacaccccctaggcaactctgggggaagtttaaagccagctggagagggaatcccgtttcagggtcaacaagccatacgttttccaggagn

SEQ ID NO: 502125 - DNA, 124 bp, Homo sapiens
acacccagcagacatgctttccctcaatctcggtcttgcactgcggcgcgcgcacacacacacacacacacacacacacacacacaaagtttgtttcctgtggcatttaaaaaaaaacaaaaaa

SEQ ID NO: 502126 - DNA, 818 bp, Homo sapiens
agcggagaccgcaggaagccgggaggggaggccggccggggagacctcaggaagccgggaggggaggccggcccgggagaccgcaggaagccggaagccgggtctctaggaagccgagggagtgtgtgagcccagcaggccgggaaactgggacccgagacccccgagggacagcatgagagggaagaggaagagtggctggacgtctttcggggagcagttaggcgctggcatggtcttccaacccttgctccggccgacgacgagggcattggtttcgggagaaattgaaccagaaacgctctgtcctgggagcagcagtcacgggaccggggttcagggtagggcccaggctgaaagtggggattcggggaaagtctacccactgagtgaggccagcacacgcggggtgaagaaccccaaaagtcttgctccggccctgaagtggccttgagcttccgcaacaagcgacactgcaggtattgacagtaggcaggagcatctggaggattactggcaaggccccattctccaacaggtcagacaggacggggtcgcagcgcaagacacctgaagccacttacgtgtcatccctggtctcaaagccttcattttcaggcaatctaggaagaacaagccccaaagtccctgtctcttgtaaccttcagtgaagtacattggctgaaaggctccgtactaagtgtgtatacagcttgagggaccgaccatgcgacgtataacgtctgcatttcccaggagacgaaattccaagtgccttgtgccttgaaagggagtgcccagccagggtaaccaaacac

SEQ ID NO: 502127 - DNA, 393 bp, Homo sapiens
cacagagcgagatcgcgccactgtactctagactgtgcgacagggcacgactccatctcacaaaaaaaaaaaacaaaaactttgtgaatatttggtaatttcatctatttccagacctttttgaatacctttagataacgcgaggtattaattttggaagaatcatttttttcaatttttaatttcaatggaaagagatttagaaaccctttggctggaattaataaatgattatagtaagggtgcaggatataagggtaccatacaaaaatcaagcgctctcctgtataccagtaatgagacaagtagaatttgaaattaaaagccattccatttacattagcaccggaagtggaatacttaaggataaatccactatgtaagagctattgg

SEQ ID NO: 502128 - DNA, 194 bp, Homo sapiens
gctttgaaaccaaattaaaaaccccttccttgggaaggcaaagttttttggggcttgatcaaaccttttatatggttggggcttctctcttcgggagatgatattttgtttaaggagccctcttttcagttcatcaagttcatcaaaaatttgagggccccctctgggcccaaataaatatgagctgggggtta

SEQ ID NO: 502129 - DNA, 499 bp, Homo sapiens
  misc_feature (109)..(109): n is a, c, g, or t
ctgtaactgttaacacagaaaaacatgaaaagctcaggcccaagaaaggccttggagccagccaaacagaatgtgttctaatggacatggatgatgttgaacagaaaanagtttacaagtgctttgtggttgcactaatgtatactcactgccattttaagagggggaagtacattttaaaatatatttgaatgtcatgtactgatatgcagtagcttattgtttttctagttgcagagaatgtgaagtttaatctcttaaaatatttagatggtctactttttcattgaatttgtcaatatgtaattgcgttgtaaaatattatatatatatatatatatatatatatatatatatatatatatatatatatatatgcttaacttcccaagtgttctgcattgaaccacttagggaaaattttgtttgtttttatgttttgtaatttttaaaattaagtaaagactggatcaaaataattgcatccaacctggaccgt

SEQ ID NO: 502130 - DNA, 553 bp, Homo sapiens
tgtatattatattataattgagaaataccatttgactacattccactatcccagggtgacataatgcatttaaattcgggatttcggggtggagtatcattgtttaagctcggagttgtcaagtatgagtccctcaggaaaaaaaaaaaaattctgtgtcaaaaaccaacctgattcttagctcttaaaactattgctacttaaatttccaactaattaataacattctcaaaaaatctctataaagttcagacattcgccacagtacttcttacaattttgagaactgtttcctccaaaaattacattgatgtaaattccccaagcacataactctaacatttaaaccttttttctttaaaaccatggtttttgctgcttaactttcacacagttctgatactgttaatatctgggaagagtattcttgagatatcagtggtaaaagctaaactagtctaaattatactatgagaataccttcattgttgatgtgcagaagaataacaagtcagatttgtcttcagaagtcgtaacaataaacaataaagag

SEQ ID NO: 502131 - DNA, 1019 bp, Homo sapiens
tattacccccccctcctcctccatatatgggggaccctcccccacaaactctattccccccccctctctctccacaacacacgccccctctctctgtgcggggtgggggcttcctccacccccactcgtgtgtgttgttggtgggtgctaccagagaggactactctattgtagtgtagtggtggattgccgcccacactgttgtagatgacacacatgttggcacaacaccacaagctgccaggacactaccactgatgacgtcgccgctggtgtggacgtcccacacaccacgtgtgttgtgcgcccacatcactcccgcccgccgcgtgcacagctgtgttgagtgtcagtgtgtgagtcactacctccacagacatactctcgcgcgtgcgtgtaggtagtggagtgagtgtgtgtgcatcacacacacagcactcatccccccgccacatcacgcatcgtgttgtagtcatcatatcacgcagcgcagggtgtgttttgacacatctaattcgttagtgggcgcgcgggtgtgtgtgttcctttctcatctcatcacccgctcagtgtgtgtgtcgacaccctgcgagtagtgtgtagtgtgtctacttcactcactcgctgtgctgtgatgggagagacactcacacacgcgcagtgtgtgtgtgtatgatgatgagagagagagatgagacgctctctctcatgtgagaggagtaatactccagcgaggggtgggtagcatctcaccctgctgagtgatgttgggttgggcgacctactgggttcccccccctctcctactatgttgtgtgagggtgggtgggagagctgtggtctcgtcatctctgctggtgtgctggtcgttgtgttttatcaatggggcgctccctagtaacaaactcatctttttgttggtgaccgatcaacacaaccaccctcgttgttttgatgggggtagttcctacactcaccattgataagtattatatcctcccccctaacattttatactg

SEQ ID NO: 502132 - DNA, 246 bp, Homo sapiens
aaaacaaagaacaacaacaacaaaacaaaggccaggtttggtgactgacacctgtaaaactagcactttgagaggctgaagcgggacgattgcttgaggccaggagttggagatcagcctgggcaaaaaagcgagaccccatctctaccaaaaaaaaaaaaaaagatggctggatgtggtggcacatacctgtggttcccagctacttggggaggctgaggtggggaggattcacgtgagcccagg

SEQ ID NO: 502133 - DNA, 170 bp, Homo sapiens
caaatgaacagcaagaagcgattgaacacattgatgaatgtacaaaatgaaatagacatgactataatgaacaagccagtgagtgagatatttgaaatgtcgaacagtaaatatacacaaactacctgccaacccatttttcacatgcaagatgtgtccgcaatttgatc

SEQ ID NO: 502134 - DNA, 119 bp, Homo sapiens
  misc_feature (17)..(17): n is a, c, g, or t
  misc_feature (72)..(72): n is a, c, g, or t
cgcacgggcgcataggnggtctcagtctgcagttgcgcttatcagtatctagctgagtgtgttggaggagtnaaggggctgtcgcaaacgcctctgccgcgtaatgggccggcatcgga

SEQ ID NO: 502135 - DNA, 135 bp, Homo sapiens
ctgagtatctaagatccgtctactgcagtgtgagcaagtacactatttgcacacacatcttaggacacagtgattgtgtacaacgcagctccacagtacatgttacatgaagtacctccattcttccatgtatgt

SEQ ID NO: 502136 - DNA, 823 bp, Homo sapiens
  misc_feature (574)..(574): n is a, c, g, or t
  misc_feature (577)..(577): n is a, c, g, or t
  misc_feature (597)..(597): n is a, c, g, or t
gagcgggtcaacgaccatgatctctggacccacactacagtaacaagtttgtcagtcattttcagataaggtgcaaatcaagggatggctttgtccccacttcggcgcagggaaaatatgccagtcattgttatgatgtaaacaaccgaaggggtggacggtgaggataagaagaaccgagataatatttggccagagctacgtgtagcacaggcagccagggcggcagctgcacctgcgagcagcgcatggcggcaggcgcggcctccgggcgtggtggtgggcgtggccgggcggcgggggcgtggccgggcggcggggctgggcggtgccgccggttggaagtgggtggagttgcccttggaggcggcaccggacctgggcccgaggcccgacgagcctgtcgggctgagccgagtggccccacagagccggcgcgctcccgcctgcagggggagagcagacggggcgcggggaccggccaggccgcggcgggtgctgtttctgtttcactttccttcactctgaggccggcgcgctggcgggcgaggagcggcggcggtggcggtcgtgnacntgggaaagcggaaccaccanaaggagtgatgatcaacgatctcattgatcattctggatgctagttcctcatgcctcaggacatcctactgggaacgaccacaccagctcctgggcattcagacttgcctctacttagcgaccctctttggccagactactaaagccagtcttacttagccacgaatggctaccaaggaaaccttggtgaacagattcaattcttccattactggctatacactga

SEQ ID NO: 502137 - DNA, 494 bp, Homo sapiens
  misc_feature (40)..(40): n is a, c, g, or t
tttgtcaatgatctggtctgagtacacactatttataagntttttttaaactataaaatacacattacatgggcgggcgtggtgctcatgcctgtcacctttttacagtacagttaaagctttggtacttccacaccatcacagaagtgctgtcctttgttagagcttgcccattctacctccctgagtgtccagtgtgtctattagaggagcagtctgtaggctgaattgagaagctagcggtctagggtctgatttggctgacaattacagacttgaacagtatgaaatgtacatgcctttctgtagatgaaatagtttgataaagctaactttcatacatggattcatgaaaggaaaggatggagaccattacccagcttcgtaattaccgtgtctaggacatcaggcttcaatgtacataggttttagagctcaggaatgaaatattaatatgagatatacttaaacgactttacacctagaattcattc

SEQ ID NO: 502138 - DNA, 336 bp, Homo sapiens
tgtctgcagctgacgactcggggtggagctgactgctgtagtttgagggtcatgcagttgaggacttcgggaggagctgatgttgttcgcgtggagggcctctcagagtggagcctcagggatgcgctgtcgatcttgactgaggttcatggaggctggtgactcggacaggcgcggatgttctagctagtggatcttccagctgcagaccaagagaggagctgatgtactaattttaggttcttgcaggtgcagacctggagaggagctgatgttctagatagagggtcatgcagctgaagactcggggaggagctgatgttgtaatttgagggt

SEQ ID NO: 502139 - DNA, 212 bp, Homo sapiens
ttctcccgatgcatatcaccggggttcaaataaagcccttctgagggatgcccgattccatagctgaaagtcagtgctgacgaggactgtcgtgtaaatccaatggaggtgtgtcccagagcagggctgtatatattcgtgctccgagggctgcgcggctccgcgacgggtcagcggcggggcgcgggcgctgcccatgcagcccgcggccg

SEQ ID NO: 502140 - DNA, 246 bp, Homo sapiens
aaaaaaagaaccttttaaaacccccccccttaaaccccccccttttttgttttttgcccaggggttttttccttttttggggggttttttttttgggggaaaaaaattttttccccccaaaagcccccccttttttccccccccctttttttggtggggggggggggggggggccccctttttttttttttttttttagggggggggggccccaagggaaaaaaaccggggggggggcccctttta

SEQ ID NO: 502141 - DNA, 1199 bp, Homo sapiens
  misc_feature (385)..(385): n is a, c, g, or t
  misc_feature (452)..(452): n is a, c, g, or t
  misc_feature (636)..(636): n is a, c, g, or t
  misc_feature (793)..(793): n is a, c, g, or t
  misc_feature (958)..(958): n is a, c, g, or t
  misc_feature (1054)..(1054): n is a, c, g, or t
ggaaaaaggaaaataggaaatctgtaaaaataatagaagacttggaggatgcaagaaacacatgaaaaagaggctttgcagaagctttggccacagatgttcattgagcttgttagggatgcagtcatataaattcccaatacaacaccctatatgaagctccgcctacagcagataacagaccaaaaacaaaaatgggctctagttaaacgccaaaacgagaaaagagtgggcgtggttcttttgagggggcggaggtcgtgcgccccgctctccttcgcgggagggttagttaatgatcatcggctcgacgaccttctgtgcctgctcgtctcggtcgctgtccgcagcgcctcctccctccacaggcggtcgtacggccccnccatcgagtatggccgccacccccttcaccccgcccccgcgcccgcccgccgcgttccatcaccttnacggagcgcaagagaattaagagcaccgtcggcaagcagcgcgcccgccgcgcgagggatccccacgcgggcgacgctgggtcgtgcggtgcgagacgcgcggggggcgtgtggaggtcgcgccgtcgcgccgtgcggcgctgatccttgtcgcggcgccgcagtcaccgctcgctattaattntatataatccaacgttattactacgtatttcaccgtcatttcacctattattccaccaccatatccaacgaatatcaacgataacaccaccaaaataaatcacacccacacatccaccgtatactatcacaatatccaccctcaccattcaattaantcctacaactcactccacccaaatataacacacatcctccgcattccaacacgccataccaaccatccatcacacccacatagcatccaaacaagaacgaacctaaacgacgcgctccataatacacctccattaacccgccgataatcgcgcacttctccgccntcccgaccagttgttcgcccccgcgacaataggtccaaacacacacaatacacgggctggtgccgcgccaactcgagcgcctacagctcgcgattngtcgaccggtaccgaacagtccagccaataccacgaccccaataaccacatccacaacaaacgaataataaatatattccaaccaccacacataattctatctccctcccacacatctaacatcacaacacacctccaaacgaat

SEQ ID NO: 502142 - DNA, 935 bp, Homo sapiens
gtgggcatttgagttgtgcggctgaagcagtctggggagaggcaaaaagcaatggcaggaggtgggacagaggaatgtgggccccaaactatgggggcagctgctactcagtgccagctgtacgtcgccatggggggaagcgggacagagccgcgggtcttcggatttcccccaatggcaggaggtgggacagaggacatgtgggccccaaactatgggggcagctgctactcagtgccagctgttcgtcagccatggggggaagcgaggaccagagaccgacgggtctacgggctttttcaagaggacgcataactccggattgtacatatgaactgtaccatgactttggtaaagacaatctgtgacggatgacagtgaaggagggacgactcatcgtcaatttcacacacgatactcgacacggagtcctcgagctggacacggggcagcaccaggcggaggacagtgtcttccttctgcaggacgcagcgccggggactactccaccaacatcactctccatccttggtccagcagcaactctgcacagagccggcataactcacaggtcaacaacacacgctacgacggcgcactggtgccaatacaccttgacgctgggatacacagatcacacgaggacaatctgtgatggtgacaggaagagaccactactctccagggacagaggacacaagacccgacggaaggcaggactggccgacagacacggagaaaagggacccacactaaacagaaccaggactaaaagtcacacgcagccggctggtcccacgccagggagcacctaccaacaacgcacacatacaaccacaatggaagaaacaatgacaggagacaaaggacgcagacaacagagcacacaaaacagaggagaaacacacaggacagaagcaacaaaccaacaacaa

SEQ ID NO: 502143 - DNA, 380 bp, Homo sapiens
ctgcctgcggccagacggagtctcactctgtcaccaggctggagtacagtggtgtgatctcggctcactgcaacctccgcctcccaggttcaagcgattctcctgcctcagcctctcaagtagctgagattacagacgtgtgtcaccatgccctgttaatttttgtttgtttgttttgttttttgtcttgttttgtttcgttttttgtttttttttttttgagacggaagctctgctctgtcgcccaggctgaattgcaggggccccgttctcggctctcaccgcgagttccgcctcgcggttgcatgccatctccggcctcacctcccgattgctggacctagggcttcgccccacacccattattttggtattttcag

SEQ ID NO: 502144 - DNA, 1110 bp, Homo sapiens
  misc_feature (89)..(90): n is a, c, g, or t
  misc_feature (113)..(113): n is a, c, g, or t
  misc_feature (143)..(143): n is a, c, g, or t
  misc_feature (161)..(161): n is a, c, g, or t
  misc_feature (172)..(172): n is a, c, g, or t
  misc_feature (174)..(174): n is a, c, g, or t
  misc_feature (181)..(181): n is a, c, g, or t
  misc_feature (186)..(186): n is a, c, g, or t
  misc_feature (194)..(194): n is a, c, g, or t
  misc_feature (203)..(204): n is a, c, g, or t
  misc_feature (206)..(206): n is a, c, g, or t
  misc_feature (213)..(213): n is a, c, g, or t
  misc_feature (216)..(216): n is a, c, g, or t
  misc_feature (223)..(223): n is a, c, g, or t
  misc_feature (234)..(235): n is a, c, g, or t
  misc_feature (244)..(244): n is a, c, g, or t
  misc_feature (251)..(251): n is a, c, g, or t
  misc_feature (253)..(253): n is a, c, g, or t
  misc_feature (255)..(255): n is a, c, g, or t
  misc_feature (257)..(257): n is a, c, g, or t
  misc_feature (262)..(262): n is a, c, g, or t
  misc_feature (272)..(272): n is a, c, g, or t
  misc_feature (276)..(276): n is a, c, g, or t
  misc_feature (278)..(278): n is a, c, g, or t
  misc_feature (281)..(281): n is a, c, g, or t
  misc_feature (284)..(284): n is a, c, g, or t
  misc_feature (296)..(296): n is a, c, g, or t
  misc_feature (307)..(308): n is a, c, g, or t
  misc_feature (318)..(318): n is a, c, g, or t
  misc_feature (403)..(403): n is a, c, g, or t
  misc_feature (405)..(405): n is a, c, g, or t
  misc_feature (1110)..(1110): n is a, c, g, or t
tatttgggaacgctgcaaggcctttaatcagccttctgtgacataggtagcagcccacggagatcctaagctggctgtcttgtgtgcannctgagtggggtggtgcaggccgntagtctgcccgtcactttggatcatagccntgggcctggcggcacacnagcacttgcgntntcgggcntgtcnatttcctnccacttggnnanataactnganatttccnccttttctttnnagcttgatngcattgncnanantttancagccagtantgangnttncangttaatatgtgncaaaatatttnngtaattattntctaatccctttctgagtactctggggccctgcatttatgaggcacctaccttcattttgctaacgcttattctgaataaaagtntntgattccttaaagacgaaaaaaagaaatcgtaaaccaagaagcaaagaggagcgaggaggagcgcccataaacagcaataaccacgggcgtgcgaggcccacaatcggttcggctggcactgctaccagagggagggaatcccaggaggaggccccgcttacaaagtggcgcaaggctaacccaaggatgacattgaccgggggcccgcaccccattgttaccagatcggtccccgaaattggagcaaaagagggggcctgcctgtgggcgaacaaccatcgggataggaaggaactccgcgtaatcgaaggcaggacggggagataccaaccttagcgctagagatgcgccccacacaaatgcgaggattcaaatgagacgctgaaaagtgggggcgaaaactaagtcccacagcatctgttgggaaaaggtgcacaatagacaagcgcatttgaagagaaacagttagcggggccacaaaatttggccccattcccaattggcctttggtagaaaagaggtttgccccgtccattgcaccgatgtgcaacatatagtattggcctgtaaaagcagatccaaatctataacgtcgaagcggatggtagtacactcgacaaaagaaaagcgagtagtccgaccatagcaataccgccccaacacatcggacgctgcaaccacgggacaaaatcaggagatacacn

SEQ ID NO: 502145 - DNA, 165 bp, Homo sapiens
actcctaccgtgtctctgaaagatattccatcagctgtgttaaagccagggcagttctgctagcagctgtttcacctctgtttcagagaagactccctactggagaacagagctgtttagacttttctgcatgatgagaacttagcagttgttgatttccagaaa

SEQ ID NO: 502146 - DNA, 242 bp, Homo sapiens
gagtcggaccccggtacgctttggtctgcattgttgtgcctgagcactatcaccacctaacatcctgtgcatttccgcttagttatctctttgttcatgctggagctcagaaaatgataacccaaaatcaaggtcccagaagcaaaagtttttctccgaccttctcctgccctcctatctctcacccctcatcctcccccaggctagccataaaatctggaatacctcttcccaaagggggt

SEQ ID NO: 502147 - DNA, 85 bp, Homo sapiens
agatttattttatgtatatgagtacactttagctgtacagatggttgttggtcgacgcggccgcgaatttagtagtagtaggcgg

SEQ ID NO: 502148 - DNA, 515 bp, Homo sapiens
ctatgttcctatcgttgatccctttctctcgctctttgtcgttcccgttctcgccatctcgtgtcgtcgtctcccgttctcgtctctctctcctccgtctctcttttctctttctcgttcccgttctttgtccctgtgtcgttccctctctctttcccgttctcgttcgtggtctcggtctctatccctttcacgattctctctcgttgtgcgtctttctctcatgccgtgccctaacacgctctctttctagttctctctctttttctctttcccgtagtgcccgttcaggtcccctcgtctctcatcgcgctccgcgtctcgttctcggttcccgatctctctcactagccctttcatctctcctataatccagtctgtcgactcaacgttcctctcttctttcatcacgctcaagctcgtcattccttccctgatgtcgaattggtgagcttggtctttgatctctctctctttcaggatatctatctctttcaggatagctacttcgagtt

SEQ ID NO: 502149 - DNA, 305 bp, Homo sapiens
acttctcgatgaaattaatcccacagccacagtaacatcaatgcagcaggagtcggggactacggttcttcgacctggaagggatattctcccaatctgtgtagttagcagccccacagcacttaaaatctgcctgcatcctgtccaggatcgaagcagtgtggttatttttcgggtaattctccatctgctgccggacgttgttattaaactctgacatcaccttatctctaaacacatagccagcaatggctgcggacacctccaccaacatgatacgagacagaacgatggcaaacgtgatc

SEQ ID NO: 502150 - DNA, 348 bp, Homo sapiens
  misc_feature (42)..(42): n is a, c, g, or t
cttgaggatcccgtagcagcgcagcacataatgaaaactccntaatcatctttggagctccatgctgcagtggcagtggctctgtgatcgagtgatgatccattcatggaacacactggacttgtcagctgaacagaatgagcagctttagtgtgctgtgtgcggtttccaacactggtgagactgctatgtgctgtgggtgtggcaaggacctgatactaaacccccgatcttgggcagggggcttcgtctatacttacaagcttgtgaacatggggaaaaactgggggttttggacaagactccttttggaagagtgtcctgttgctattgccccattccagggga

SEQ ID NO: 502151 - DNA, 276 bp, Homo sapiens
acatcttctgggtggccgaagaatcagaataggtgttgataaagaattgggtctccacctccagcggggtcgaagaaagtagtatttagatttcggtctgtaaggagtatagtgatacctgctgctaatactggcagtgagagaagtagtaggacggctgtaattagtacctcggccgcgaccacgctacagtcacatcaaaccgaccaggtctattctatggccaatgctctgaaatttgcggctcaaatcacagcttcatacccattgtacctg

SEQ ID NO: 502152 - DNA, 964 bp, Homo sapiens
atctcttccggttctaatgccgcttcggtgatacctgaggacttaatggtgctaggacatgtgaccaagggtccaccgtaatccacacctacatactgactatgtcgccgataaatggttcgtagaaatggtatcaataaatcccgatcatacatgatacgaactctctttaacgaggggtggtaacccatagtttccatgagagagagcatcgcagcgtttgccagaaggaagctgcaactacacaagggcctacaagaaagactgccgggtcccacagatgcgccaatggcgcaattgcagtgctaacgttgctcagtagtgcttatcaataggcaccatcgttaaaaagctccagagagaggagtttacagctcgcaggcattcccaaaacaaggggtcgtcgacgtcagctaaggcttacgagtcgaactttgcgcgtaacgagttaggcgcgagcccccgaatagctgtggggtaaagcgtggcttcgatgtccccgtaatagcgctaacgggggtctcaaagggcctaggtagtccccggtgcactctataagggcgcaaatgtgcgcgaatgagccacatgggaattctagaaggcagagggccacctcaagatgcttgcattggacaccaagatttgcaggtttaccaagcattcaaggggctacccgcaaatcggtaacacctgagggcccctaaccaaagagggtcttcaagaagggttaagacactatttcattgtattggcaaggcgccaaattggaaggtgacacacggaccggggaacttttgcacgcgcagacccactcaatcccggcccggggcccttgtgggcggtgaaccaatcgatgccattggagggaataagaggcgttcatacttggatgagtaagtttggtgagaacaataaacgccgctgagagccattatacgaacacatacacatatgaatacaacag

SEQ ID NO: 502153 - DNA, 81 bp, Homo sapiens
cccagccccaaccagacctctctgtacttctgtgccagcagccctcgtgggactagcggtatgaacgagcagtacttcggg

SEQ ID NO: 502154 - DNA, 204 bp, Homo sapiens
tctagaggtatccccagatcgagcgaggagacaaactcatctgcctcagtccctctggacacgcctcatgccaggtgcatatgtggacaggggccatgctcctgtgcgtttccaaagttggaggagagctcgccaggctcacggtactcgaaggccacgaattctacagtgaagtcctcacggagtaccacggtgggagccagg

SEQ ID NO: 502155 - DNA, 101 bp, Homo sapiens
gcggccgcctactactactactgctcgaattcaagcttctaacgatgtacggggacatgtggaatgctggacaataaagcgagtgctgccaccctccaaaa

SEQ ID NO: 502156 - DNA, 139 bp, Homo sapiens
aatgcagcggactcggattagcgagcagagtgtcttctcttctgctaacagctgggtcaaacttcttctgcttcttctccaagttggaggcgacctggcgcgtggtggtccagtgtccacctgtgaggctcgtccagct

SEQ ID NO: 502157 - DNA, 909 bp, Homo sapiens
  misc_feature (1)..(1): n is a, c, g, or t
nccttatatttgtccttctgatggtgtaacaacgtatcccctaattgccctcttaaaagtcccccctctaaagcaaatccccttttaacgaaatgtttggttcaaaaagaaaaccctcctcttccgaacctagaacgctccctccagtgctacgggatcgtgtccctctcaatcaaagatccgtccaccccaggtgacaccttcgcgtcgaccccaaggatccctgaaatgggttctcctccccacactttttcaaaaacgtcgtctttccgtattccccccctacccttatgattattatggaagaggtgaacacccgatcacaagatgtcccttaaagaattttttggttaaaatagcccccctaataccgctttcttttctatgagacacccctccccgacgcaccgtcttggtcgctgctataggaccacccccacttatttttctcagggactccgccccaaatacctccgcccccccaaacttgaatacccactgccctcacctacagtgaataattactccccgcccgcgggctattatctcctttgtaccatccttatgcgcccccacttcaaaaaattctgtgaggaggctcccacaattcagctccatagaccttcttgtcaagacccctgtcaaccgcactaattgagctataagcctcccctttaataagaaaacatcaaacgaagacgtcaatggtacaaaaacaatggtgttaccaccgagaagtcaaccattcttcgtctttcatggaagaacaatacaccacaattccccttcaattacaaataaattaagccctatatttgttgtatattatttcgagcacccggtaataacatttgaccattataatcgaccccccccttttcagggaatgagaaaacatcccacataaca

SEQ ID NO: 502158 - DNA, 297 bp, Homo sapiens
aagactgaataatccacgtactaatctataataatatactcaacttacgaagtgctacatctctctataccacgtcgctctgtcacatgactgcactgagttgaaagactggttctggttcaagaggaaatcctgatcaaaatggatatcaaagctccactaagaaacacaagcatgtttcaaagagaaatctgaatccccaaatcattattcacaatctattattaattacaatttgagatatatcaccagttactactaggtagtaaatatgtctcactaatgacaatctagtac

SEQ ID NO: 502159 - DNA, 541 bp, Homo sapiens
gcacgaggtctcaactatagaaattgtgggctgggctttatttaccactacacattatcaggtgttagaaaatgtagactgggttagacaaattatcttctaagttctagaaggggtttgtaatcaaaacatatttgataggaggctacgggagagttgtctagaagaggtaagacctgaaactgtttgttctctcccactagaattaaatggatgtttagactggctactttgccctaaaccagcacttgggggaggtctactgggtggatgggtgggatttggggggctgatagtctgaacattatatttgactgtaatgaaacctacaaagtagggtcagaatcataaagggagaatattcccctctgggacctattctgcagggtctaataaaaagattaattggaatgtaaaaataataaaatggaagaaaactctaggggagggcccgggaaccaaaaatcggacatatatgagggtgaataaccaaatgaatggggcgtgagtttaacaacgattgagaaatggtgaaaaaccc

SEQ ID NO: 502160 - DNA, 237 bp, Homo sapiens
ccccccatcaagtacccaaaaaagatagagtttgtttttaacctggcccaaactgtcccagggaaaatttcacgagcccagcttttaaacaaagagtggaaaatgtcccgaaaaacccgggcccagttaaacatttaaaaaacattcctttgggttccccccttttttttcttttttttccccttggggccctggccctcctaaaataaaatgagatttttttttaaaaaaccttga

SEQ ID NO: 502161 - DNA, 205 bp, Homo sapiens
  misc_feature (28)..(28): n is a, c, g, or t
  misc_feature (61)..(61): n is a, c, g, or t
  misc_feature (74)..(74): n is a, c, g, or t
  misc_feature (120)..(120): n is a, c, g, or t
  misc_feature (165)..(165): n is a, c, g, or t
  misc_feature (175)..(175): n is a, c, g, or t
ccagcccgacctgttcaaggacattttnaatatgctcatgcaccatgaccggtttaaagtnttcgcagattatnaagactacattaaatgccaggagaaagtcagcgccttgtacaagancccaagagagtggacgcggatggtgatccggaacatagccacctntggcaagtcntccagtgaccgtaccattgcccagtatgcc

SEQ ID NO: 502162 - DNA, 453 bp, Homo sapiens
agtaaaagccaaggcccaaaatgtggcaaggcaaaggttaaaaaaaaaggaagagcaagtttttttttgcctagcaagctcccttcaaagccaattataagataattttttcgagaagtcgaaaccaaaggaataggctccaaacatcccccgtttggagcaagggtgaaggaaaaaaaaaaaaggccaaatgtctgtttgtatttagccagtttttgttttttttttccacgcagctacaaggcccccagttatgcaaagccccaagttatgccaagtcatcagttatcctataaattatttaccctgtcattaaataattaacccccttttttgcttctgtaaccctccttataaaaatcctgcccagtttttgttcaatcctcacctttttgaatgtaaatcccctaaactaatcccccccttaaaataaacatctcccttttttccata

SEQ ID NO: 502163 - DNA, 848 bp, Homo sapiens
tatgaaaccaagttttgctctgtggccaggctgaattgcaggggtgcaatctcggctcactgcaacctctgcctcctcggtcacaagtgattcttctgcctcggcctcccgattagctggaactacggcgcgtgccccacgcccagctaattttcggtgttttaagcagaaatagggtttcactattttggccaggatggtctccatctcttaaccttgtgatccatcgcttcccaaagtgctgggattataggcatgagctaccgtgctgggcccttattttctctttaacctccagcctcctactggtccttccttacttctggtctgtgtggggtatgacatacgttggccccgtgtatagccatttcaaagggcaaaagaagggcctgcactttctttattttaagtgtgctgacattttggtggcccgtggtctacattaattagtaaagtcctggccaactcagttttctctaaaatccaaagcaggcctaaaaattctgccagggttaaaaactaaacctaccgggaagggaacaaaactcatagcatttcctaatctccatctccccaaaggttgtggacatcctccccaaagtgtcctttcccagctcgtggaacctccttccagaacgtcagaactctggctgtatacgggctactggcccattcctttttccgctgtctctataggccccaagaactaggtttgcagggcagctcgtggtggatttcccccctccaagggtatccccctctctgaaaacatctcgttgttctatcgctaaaacctcggataacctcatacccgttctcacccggatccggtcagaataccattccgt

SEQ ID NO: 502164 - DNA, 368 bp, Homo sapiens
ccaagggtattaagaggttcctgtggccaatttaaagtcgcctccccatataattcttcccatatattttgctacatagccgggtgcgctctttaacctgtcctaagaacgctggccgggttccggggtgtctaaccttggcctccccttgcaaggttattccaagtaaatccattatccagaaggtatagggttaagcccttgctattatacgctgggtatataattttccctctttcccttgcggccatatatattgtgcccaggttccatttctctatcgcatacactatatgggggtatatggtgtgtctaagtgtgtctgatagtaatgtagagtgtctcgcgtgcagtactcgcacagcccg

SEQ ID NO: 502165 - DNA, 674 bp, Homo sapiens
tggaaatatcattactttacttatagggtcccaggcatttaaaatattcattcacaggggaggctacatcaagcaaggggaggtccagccctctggcaaggtggggatgagaggctcatactagcaaagacagtgggcaccggagtaggctcccgggttagcagtgcgggtgcgtgtagagaaaattcaggtgacgtacagtggcctcgggtctcgggacacaaaatcgtgtacgggagaggaacagtgcacggcgtgaaattaaggcgactggtagtgaactacttcacaaatggccgggaaacacttaaacgctaaagtcaagtgactacttcccacaacagaaaaacaaaaacaaagacagaaaccaaacagacacagaagacaccaacacaagccaacgaccacacacgcccactcaacaacacacctccaccaacacacaagacaaacgacacgaacagaacaaagaaacacacacaccaccgaagcacaaccaacgcaactcaccgcaccaccgagcagacgcgcgtgctcagaccagacgccgacacaacaaacacacccgacgaccccgataagcaacaaggcaccactgcggagcaccgcaacacgcatctcgcgccaccaggagcgccagacacacagcaagagaggggagggaatcaaaaggg

SEQ ID NO: 502166 - DNA, 283 bp, Homo sapiens
aatgaagcaacatgaagacatttcctagtgaaccaggttggagagactcagctgtgagttgacctgcagaaaaaacaaaaaagaaaaaaccaacgaacaaacaaaaaacaataaagagaggcttcagacagaagggagataacgtcagttagaaacaaagaaaaaaaagcattgagtgaaagcaacagagagggcaaatgtgcaggtggatctaagtcaacatggattgcacagacaatggttacttttaaaatacatgccaaattcagatgaataacaaaaa

SEQ ID NO: 502167 - DNA, 834 bp, Homo sapiens
  misc_feature (181)..(181): n is a, c, g, or t
  misc_feature (212)..(212): n is a, c, g, or t
  misc_feature (224)..(224): n is a, c, g, or t
  misc_feature (278)..(278): n is a, c, g, or t
  misc_feature (310)..(310): n is a, c, g, or t
  misc_feature (322)..(323): n is a, c, g, or t
  misc_feature (325)..(325): n is a, c, g, or t
  misc_feature (328)..(330): n is a, c, g, or t
  misc_feature (339)..(340): n is a, c, g, or t
  misc_feature (345)..(347): n is a, c, g, or t
  misc_feature (357)..(357): n is a, c, g, or t
  misc_feature (364)..(366): n is a, c, g, or t
  misc_feature (369)..(369): n is a, c, g, or t
  misc_feature (377)..(377): n is a, c, g, or t
  misc_feature (385)..(386): n is a, c, g, or t
  misc_feature (409)..(409): n is a, c, g, or t
  misc_feature (425)..(425): n is a, c, g, or t
  misc_feature (427)..(427): n is a, c, g, or t
  misc_feature (508)..(508): n is a, c, g, or t
  misc_feature (522)..(522): n is a, c, g, or t
  misc_feature (531)..(531): n is a, c, g, or t
  misc_feature (550)..(550): n is a, c, g, or t
  misc_feature (574)..(574): n is a, c, g, or t
  misc_feature (586)..(586): n is a, c, g, or t
  misc_feature (673)..(673): n is a, c, g, or t
  misc_feature (680)..(680): n is a, c, g, or t
  misc_feature (682)..(682): n is a, c, g, or t
  misc_feature (687)..(687): n is a, c, g, or t
  misc_feature (706)..(706): n is a, c, g, or t
  misc_feature (710)..(710): n is a, c, g, or t
  misc_feature (780)..(780): n is a, c, g, or t
acagtgatcatcacccacaaggacaggttgctgggatgaggcaccctttcctttcatgtttaggttcttctcacctgcatttcactttcctaaaggtcccagccacacagcgttcttttagggattaaagtagtaggaaaaaaataaagagaacacaacatccatccttaaagaaaaaaantaaatccactttatggtggacttcagctatngacaaatttggnatcagtgttctccagtctgaacatagtcttctgttacctgggagagagtggtcnggtactgccagctcagggcagccaaaagcatnacaaacgacagnnanatnnnggattattnncttcnnnaaatcatctnacatttnnnaanattcttcntccggatnntggagattatcttcctttttttnctagaagatgggtctnantcggggattctatgataaatctcttccatatactgatatatgatggctttgacagctggcatattggtggcatccatcatnagggtcactgcttnccctttccnaatcttcactgcccctttnaacacctgctggttattataacangcagccaaagtngcaatggccatcacctgtggaatagcacagaagttaaacacactctggtttctgagtctcgaaaggtaggtgatgacatctgggatntggtgantncattngttataagttcattcaggnactnacggccaagtcaatattctccggcttagcaaaatccctaacttcttaacatacctgctccaaacctcttnaggccagaactctcttcctccttgctggtcttcagatagtcacggatgatgttt

SEQ ID NO: 502168 - DNA, 251 bp, Homo sapiens
agcctgggcaacaaagcaagactctgtctaaaaacaaaaaaaaagaaagaaagaaagaagggggagggaaagaggaaagaaagaaggaagcaagcaaggaaagaaggaaggaaggaaggaaagaaagagagagagaaagaaagagagaaagaaggaaagaaagaaaaagaaagaatgaaagaaagaaagaaagaaagaaagaatgaaagaaagaaagaaagaaagaaagaaagaaagaaagaaagagaaag

SEQ ID NO: 502169 - DNA, 685 bp, Homo sapiens
  misc_feature (181)..(181): n is a, c, g, or t
  misc_feature (212)..(212): n is a, c, g, or t
  misc_feature (224)..(224): n is a, c, g, or t
  misc_feature (278)..(278): n is a, c, g, or t
  misc_feature (359)..(359): n is a, c, g, or t
  misc_feature (373)..(373): n is a, c, g, or t
  misc_feature (382)..(382): n is a, c, g, or t
  misc_feature (401)..(401): n is a, c, g, or t
  misc_feature (425)..(425): n is a, c, g, or t
  misc_feature (437)..(437): n is a, c, g, or t
  misc_feature (524)..(524): n is a, c, g, or t
  misc_feature (531)..(531): n is a, c, g, or t
  misc_feature (533)..(533): n is a, c, g, or t
  misc_feature (538)..(538): n is a, c, g, or t
  misc_feature (557)..(557): n is a, c, g, or t
  misc_feature (561)..(561): n is a, c, g, or t
  misc_feature (631)..(631): n is a, c, g, or t
acagtgatcatcacccacaaggacaggttgctgggatgaggcaccctttcctttcatgtttaggttcttctcacctgcatttcactttcctaaaggtcccagccacacagcgttcttttagggattaaagtagtaggaaaaaaataaagagaacacaacatccatccttaaagaaaaaaantaaatccactttatggtggacttcagctatngacaaatttggnatcagtgttctccagtctgaacatagtcttctgttacctgggagagagtggtcnggtaggattctatgataaatctcttccatatactgatatatgatggctttgacagctggcatattggtggcatccatcatnagggtcactgcttnccctttccnaatcttcactgcccctttnaacacctgctggttattataacangcagccaaagtngcaatggccatcacctgtggaatagcacagaagttaaacacactctggtttctgagtctcgaaaggtaggtgatgacatctgggatntggtgantncattngttataagttcattcaggnactnacggccaagtcaatattctccggcttagcaaaatccctaacttcttaacatacctgctccaaacctcttnaggccagaactctcttcctccttgctggtcttcagatagtcacggatgatgttt

SEQ ID NO: 502170 - DNA, 81 bp, Homo sapiens
  misc_feature (3)..(3): n is a, c, g, or t
agngcgcaggagcaaggggaaaaggagaaccccaggcgggaacggtgcagccgcaaacgcgcgcgcaacagcgcgcggccc

SEQ ID NO: 502171 - DNA, 105 bp, Homo sapiens
actggactgccggaagaggagacccagctggcttcacttctcgagaagatacgccctgtaccgccaaaccccgtttccagtatcacccgttaactgctcgagaac

SEQ ID NO: 502172 - DNA, 107 bp, Homo sapiens
ttgcgtaagacgtgttagtctacaacaatacatcttgtaaaaactcaataaattatatatatagatatatataacttgtaacatctaataacatcggaacctgcaca

SEQ ID NO: 502173 - DNA, 510 bp, Homo sapiens
cttttttttaatagtatgtaaaacatcatatatttttagttttgtgggtattaggcctgtatataaacggggaacatgaaattttcagatagaaacatgcgccgcattttgaatacatcacctagtgcgggttgttcatccccttaatcatttatgccagatgcaaacaatacatcacacccttttagtgatatttataggtacaatgaaattgctgaggactatactatccctggtgctctatgacataccaggtatcattcatcctttactaaggtgcctacggtcatgaagtatcacggtacatagtcaggaggtgcatgcaagatacgtgcgggaacttgtaccatgtgggtagactgaacagatcacgttatctgctagctattaaggcgaccatgcatcagccatcttatctaatgctcagtctatgcctactctctgctctttttatgacactaacgagagttgatccgcatcatatgtgcatccacactgatcatccagctt

SEQ ID NO: 502174 - DNA, 457 bp, Homo sapiens
gccgcctactactactaaattcgcggccgcgtcgacacgcgacgtgccctgctggaagaacaggaacgcttgaagactggcagcgttacggaaccaatccagttgatctactgagcgcttgggaacatcggcagttggagctcatgctcgccaatctttgagaccccatcacccttcttcgtcatccaaaatgctactggttaaagcgctactctgtccaggctggaagctgaagtatcagacctatgtagtgcttccctgaaggatcacctgtcagaaaaaacgcccgatcaaaagggaaaagcacgcgccagttgtgaggaggcctctttctctaggagtgcgcccaaattcactcagctttccagcagagagcagatcatctgcacgcgtcaaacgaagtatatccctacaatcacccgagaaatggctggctatctcagtcaatgggtttggc

SEQ ID NO: 502175 - DNA, 176 bp, Homo sapiens
aagacaaaacgaaatgttggtcactcggcgtgtgccagcaacttcgtccactatgactttctgcgagtttggttactcggcgtgtgcatcggactcgcggcgttttggaccctaagtctggatggacgaagttgttgcaggtcaggatggacaaatctcagtggacgaagttgttg

SEQ ID NO: 502176 - DNA, 372 bp, Homo sapiens
  misc_feature (30)..(30): n is a, c, g, or t
  misc_feature (149)..(149): n is a, c, g, or t
  misc_feature (155)..(155): n is a, c, g, or t
  misc_feature (170)..(171): n is a, c, g, or t
  misc_feature (174)..(174): n is a, c, g, or t
  misc_feature (204)..(204): n is a, c, g, or t
  misc_feature (208)..(208): n is a, c, g, or t
  misc_feature (222)..(222): n is a, c, g, or t
  misc_feature (318)..(318): n is a, c, g, or t
atagacgacaccagatccttctgaggcagnttcaacttggccatcatcggcttgcttttgacgccctgattgaccaaacaaccccgcaaaaccatctggggtttgggccgcattcttttgcaagttttgcacggtgaccacccattttnttactntgttataggccgaanngcncaatcttggctcacataggcggtcgagcantcgncgcttgcccggcantatttaccacttttttggtttcaggttggcgctggaaccaagaatttggttgtgtaccagaataaacgacgccaccaccaactacggcagcgactnccccactattatagagaatgtttcatcacgtgccctccattttaatcaacgtgg

SEQ ID NO: 502177 - DNA, 494 bp, Homo sapiens
ccgaccgcaggtacaattttaacaattggggtgggtgttatgggggcacaggcaccaaagtccgccaaggccccttgaagagggggggttacaaggttcagggccaggagcccttcggggtcaccaagcctggcccccccaagtccaaagcaagggccaaagccaagaaagggaggggaaggggttagaggccaagcttggatgccaaggggccctgggggtcaaatggggctgggcccaggccttccttttccagggccggaaatgtgacccaccagggcctttggttgggtggttgggtttaatcaatcaggccgcgcctggtccttttcattccccggccccccccttaggggcccaaaggggggggggacaggggatttggggaggtttgggcctcccccaaagcaaggggggtcccagggccgggtttggtttttccccacaattccattattaagaaacacatcaaataaatgggttttttcccccca

SEQ ID NO: 502178 - DNA, 1365 bp, Homo sapiens
  misc_feature (1088)..(1088): n is a, c, g, or t
  misc_feature (1156)..(1156): n is a, c, g, or t
  misc_feature (1237)..(1237): n is a, c, g, or t
ggcccccttctacacagggccccttatttttgggggtttatacaccacaatgtggggacgaaatatatatcgccccaccatttttgtgaagaagcgcccctttcctcacgggccgtttttttgttagcacccacaacgtgtgttaaaacaccaaagtccggcccccactaggggtttttgtacacacaaggcaacttttctacgacgcgactttttcctatattgggggttgttataaggaacacccccggttttttttcgccccacgtatatttttacctccccgagttttcttcgtagataataaatctccacatgttcccaccgctgttaatatgttagaaaactttggggtataaaaaataagagatatgataatttggggggaaatgtcggttttttttccttctggggggcctcctcttaaaaaagtgtccccccacaccgtcggagaaattatattaaaaacaacctcattatggagaaaaatgtggcacacactctttgggtggtctacaaccccacattctccacacttattaggaggatatagagatatatcccccgagatatattctctgtgtggacaacattgtcacactaataatattataggagagagattattgggcgccccccacaacttgtgtcacacacccacaatactgtgctgtgtatagtttttattaatggcaacgactctgctgctgggctcttaattattattataaaaaatataatatggtgtgtacaacacactactggcacactctgtgttgtggtgttgtattatgagatataattatagagagtagtgtgtggtctctgtgcggtgtttctacggaagcgacacaagagtatagaacacactctgtttggtctgcacacagattggtgttacacacatcttataagagggtgtttcttctcgcggagagagaaatgttattatgagaacacgccacgggctcgtgtgtgtctatatttgagacacatccacagagaaattttccacctcttataacccacacaaatataatataagagaacacttttataattctgtgatataatttgacacacacacnctcttgttgtgagagtacacacactcttccccctctatattatatataacgcttctgcacattgtccnttctcgaggcttctaccactctttcttataaaatgcacgcttgggttgtttataaaatataaaagagacacattcactttntgtgagatttttaacaccaggcttcacgtaaaatatccacccacgtaataagtaactggtgaatttttcagcatataaatcgacataccttaaaaggttaataaaattcagctcttttcccatttcca

SEQ ID NO: 502179 - DNA, 124 bp, Homo sapiens
gaataatagcagttctaccggacaaccctaacataaccattcttaattgaactatttatattatcctaactactaccgaggtcctactactcaacttaaactccagcaccacgaccctactact

SEQ ID NO: 502180 - DNA, 118 bp, Homo sapiens
caggacatttcagtatcgtgataggtatatgaatggcactgcccagaatggaaacgctgtaaatttgcacatggagatgccgaaacttcatgcaatgtggaagacaagaagagaatgc

SEQ ID NO: 502181 - DNA, 813 bp, Homo sapiens
  misc_feature (134)..(134): n is a, c, g, or t
  misc_feature (391)..(391): n is a, c, g, or t
  misc_feature (416)..(416): n is a, c, g, or t
  misc_feature (428)..(428): n is a, c, g, or t
catgcccacacccacgagcaccgtctgataggaagccttttcctctgacgctgtccgcaatctcttcaggtttcacgcatgtgtggtgcggctcccatttcatcatcaagtttgaaagaaccccacatttttcntgcgcgtcatctctgacacggcctccctctgctactccatcctgaaagccaagaacgcaggtatttgcaggtgcctggcctcagtggcagcagtgcctgcctgctggtgttagtgtgtcaggagactgagtgaatctgggcttaggaagttcttaccccttttcgcatcaggaagtggtttaacccaaccactgtcaggctcgtctgcccgccctctcgtggggtgagcagagcacctgatggaagggacaggagcngtctgggagctgccatccttcccancttgctctgccnggggaagcgctggggggcctggtctctcctgtttgccccatggtgggatttggggggcctggcctctcctgtttgccctgtggtgggattgggctgtctcccgtccatggcacttagggcccttgtgcaaacccaggccaagggcttaggaggaggccaggcccaggctaccccacccctctcaggagcagaggccgcgtatcaccacgacagagccccgcgccgtcctctgcttcccagtcaccgtcctctgcccctggacactttgtccagcatcagggaggtttctgatccgtctgaaattcaagccatgtcgaacctgcggtcctgagcttaacagcttctactttctgttcttaactgtgttgtggaagtttcacctagc

SEQ ID NO: 502182 - DNA, 120 bp, Homo sapiens
cacgcatgttgtcactactgtccagtcagatcgtggcacccaaggacagttagaggctcgtgtgcatgcccctgcctcttcaggctctccaggcttacagaataattgcttgtcccgctg

SEQ ID NO: 502183 - DNA, 573 bp, Homo sapiens
gaagagaaaatgttgtaaatgaccgacaatgactgtgcggttaagtcggcttgcatccactactagggacgggtcccagagaacgaggcaagctgatgttcagtcgaagtggctcaagagatagagagctaaaccgtatgtgcaagggcgtctatgtgcacgcgatctgaaagtattttcttgccaatatttgtcgtggtgattgatctcgttcatggaacctattcttggtcgactgtaatcaatgagagactgacgagcagatccacatacatcttacccatgctctttcaggtagactgtgctgagacgtagaactgtggtggctagttatgattgtcctatattagtggatgaaagaacttctttgcctgtagaacaccggtcatcagattcatgactcattgaggtgtgaaaaatacgtggaaaaatcccatatagccgtcgtaattggcttgaccaacatcatgaaaatcttgttacatacgacctttacttgaattccacaagaacaggagaacactaggcctgtaaatcgactggataaggtgccaaaatacagtatgtgaatac

SEQ ID NO: 502184 - DNA, 1020 bp, Homo sapiens
gctgaaacggcaacggcggcgtacatcgcgcggatgtgaggccacaggggcagcggggtccagaggaggcagcggcggcagcaggagaggccgccggcagacgccgtgggtgactgcaagagagaggagcctcctcgcatcatggcaaccagggcgggattcaatgcccagctccccaggtcggcatcgctctgacgccggaatataccgtaggacattctataagcgcattctagagtgtgcacgagtgcgagacattcgtgactcaggcatctgtcgactaggctagtttccagcatgactcaggtgagccttgcgaggttctatgtgccatcatgttaacctgtgtgccttgagaacacattgcgtgcgtatcaggcaggaatactggtccttcaacataaaatagttggcatggcggctcagcaagttgcagggcgttttgccattcatggatggacgtcgctgctacagatgtggactctattcctatttaatgcagactgggagggaaaggaaccctcaaatcttttcagagctctggtcgtccacctcattgcgctcacacaattctaagtagacagtgccgtagcatgataggctggggaccatgctatgtgcaaagtaagcagcaaaggtccgtagggctttcgatggcaggtatgaaaggtgccgcgaccgctgttgcagtctggccttcggaaggcaaaaatgaactcgagctgaggctggtgcgggcaggaaccatcgacttgtgggggaggactcacagcaagttaaagtgacaggaccagcccgatcagtagacaggttgtgtgagggggcacgggaccttcaacggcatctaagtggtctctggccaccggacttctcagacattgactcaagaacgtgttgaagcttggacgataaattctgaaatggcgggaccccagtgagccaggcacgctctggtcaaaaagcctcgccaatctggctccaaccttaacgggcgccccgggagtgccaacaacttttaaa

SEQ ID NO: 502185 - DNA, 255 bp, Homo sapiens
  misc_feature (20)..(20): n is a, c, g, or t
  misc_feature (27)..(27): n is a, c, g, or t
  misc_feature (33)..(33): n is a, c, g, or t
  misc_feature (60)..(60): n is a, c, g, or t
  misc_feature (67)..(67): n is a, c, g, or t
  misc_feature (77)..(77): n is a, c, g, or t
  misc_feature (85)..(85): n is a, c, g, or t
  misc_feature (90)..(90): n is a, c, g, or t
  misc_feature (103)..(103): n is a, c, g, or t
  misc_feature (117)..(118): n is a, c, g, or t
  misc_feature (133)..(133): n is a, c, g, or t
  misc_feature (186)..(187): n is a, c, g, or t
  misc_feature (207)..(207): n is a, c, g, or t
  misc_feature (223)..(223): n is a, c, g, or t
  misc_feature (225)..(225): n is a, c, g, or t
  misc_feature (243)..(243): n is a, c, g, or t
gaagggagggttagggtgangtttttntggttntaggaatttagtgttaaaaattagatnaaggaanaagaaggtanaggaaggnaaagntttaagtaagatnatggggtggaaggnngaaaggggttagtantggatggagatggagggttgtaggggagagatttataaattttttttgtgtanntattggagggtgaagagttnaagggtgatttgtttntnaaaggtaaaagaattggnttggaagaaagg

SEQ ID NO: 502186 - DNA, 120 bp, Homo sapiens
accaggcagacatgggacagagcggtaagggaggggagcaggatctcacatgcctgcccaacctattctgccctcaggtggagagtgtagactgcaggatccccactcaacaaccagttc

SEQ ID NO: 502187 - DNA, 304 bp, Homo sapiens
  misc_feature (257)..(257): n is a, c, g, or t
cccccccccccccccacagaatcgtatctactaaacagcttggtttcaggccaggcgcagtggctcacatttgtaatcccagcactttgggaggccaaggtgggcggatcacttgaggccagtagttcaagaccagactgcccaatacggtgaaaccccagctctactaaaaagaaaacacaaaaattagccgagtgcagtagtgcacgtctgtggcttgagcctgggaggcagaggctgcagtgagccaagactcnctgcactccagcctgggcaacagagcaagaatgtctgaaaaaaaaaa

SEQ ID NO: 502188 - DNA, 256 bp, Homo sapiens
gatggaatcaacctaagtgtccaacagatgaatagagaaagaaaatgtatatgtacacaatagaatattactcagccataaaaaataatgaaatcctgtcattggtagcaatgtgcatggaactggaggtcattaggttaagtgaaataagccaagcacagagacaaatattgcatcttctcacttatatgtgggagcttaaaaagtagatgccataaagataaagagcagactggtagttgctggaggccacgga

SEQ ID NO: 502189 - DNA, 1215 bp, Homo sapiens
  misc_feature (1046)..(1046): n is a, c, g, or t
agcgggagctagtgaaccagcggccagccccgcgcagcgcagtcgcagccctgaagaagcccggtcagcgcacgtgcccgcgagacctgcaaacttgtgccaccggctctgccctgtccccggtggatgcccgaacgcctccgcgagccctcacaccctccctgccagtctccagtccatgtggctgcgttcgaagtgctgcatcaagtgtctgggaggagtcccctacgcctccctggtggccaccatcctctgtttctcccgtgggtgtccttatatcttgcggctgtggtgcatgtggctctcgctggcaccgtggtgattcttgagcaaggacttctccaccaaagccagtgaccatgccttgttgatcgaggtgatcacctgatgcgagtcatgtgctatcctattgttaacacttcgtcgtcacccttttgaccttactcgtcattgggactcattcctgttgtacaagaaagggcgttaaaggcaccgaccaaaggtgcccgtagagaagagacttgtgcgggtggaggttggccagacataccagctttgctgggcccgaattgccatccacggtggaaattggttgccagttgttgcttctccttcaagcgcttaatttgttgccgtttgagaaccgttgggctctcggcctggagagtcgtcgttgttcgggtaatctccaccgcctggggtttggcccctggtcgttggtacttctttttattacagaaccattattggggccaggctttcggttgacacgatccgtttccacacgttcaaccccgcaagaacccattccgggggtagcccaacaaggtctctgttgagaaagggccagggactacttgcctggatgggaacttttctccagaagcaaagattaccagggcatattttgggagttcccccttggggcgcatggtcgtcattgccgcgcggtgggcacgcccctttatggtgtggtgcctgtccttgccctctgtgtcgcgagcacaccggagtccgtgcccacacatgccgacaccgagtgcttntcttaccccatgtgtgcgttcattctgagccagggtcgtgccattgactggggcccatggctggtgcggggcagtcttggggtgaggccccgccggtgttcgactctgagcccccctgtgcgtgtgattcttcacctttacgtggagtcttcggagaccttagtgacct

SEQ ID NO: 502190 - DNA, 379 bp, Homo sapiens
ctcttaccccacgggagaacgtgaacaggaagcagaaggtctagctgtccgaggtcaacgacttctggatcgtgttcttcctggggagctattacaattcctcggaacggtcctgggctccactccgggacccacccagccgcgaggagatctttctgtactacgaggctggacatctatctttctacagtgccaccgatgggacactgctattcatctttcccgagatccccttctcggggacgctgcagcccctcttctcacccctgtccagcagcccgaccccgatgactatctgccggccgaaaggtgagtccggagacaccctggctccccagtgactcggcccctcctgtaggagtcctgttgcctctcctgc

SEQ ID NO: 502191 - DNA, 134 bp, Homo sapiens
aactgccttatggccaagtcatcactattggcaatgagcgcttccgctgtgcctgagacactcttccagccctccttcatttggtatcgaatctgcttgcatcatgaacacttacaatagcagtcatgacgtgt

SEQ ID NO: 502192 - DNA, 159 bp, Homo sapiens
  misc_feature (29)..(29): n is a, c, g, or t
  misc_feature (67)..(67): n is a, c, g, or t
  misc_feature (112)..(112): n is a, c, g, or t
ttcctgtaggcctttagatacgcagcctntcccaagaattgcagaaagcatccagtcctacccaaanagccctaggggagtagaacagagcccccccccacccgccccccanaatttcactgaagcactttcatcatccttcctctccttttctgtctt

SEQ ID NO: 502193 - DNA, 458 bp, Homo sapiens
gccgttgcatgtttcattaactgacagtttgcccatttgcttctatggctaggttatgtaaactgcactgatgaactaaattaaagccttggccgatttatactataaattcattgatggctagaaccaacactgtttacttgtgagaattgtcagtgcaacttttacctcccagtattgttcagagcgattgaaactaattaaacgccctgttcttgacgatgcaaacccccaatctgtaatactttggtttaatacatagagctaacaatgaaactgttggaggtgatggcatttgtagccctgctggttgtttcaccactgggcaaatttttaccattaaattgcccttcacttctacaatcctgcgtttaagttttgagagtcaaacgccctcgtttatgtggctgtggagaatcggcctttcattacttgggcacaattttattcatgcctgg

SEQ ID NO: 502194 - DNA, 205 bp, Homo sapiens
aaccccccctttttggcccccccggggcactggggggggggggttggggttcccccccccccccccttttgccccccccccccggggggggcccgttttggcttttttgccccatttgggtttttgggggtttttcccccccccccccccccccccccgccaaaaaaaccccccaaaggggcttttttggggccccggggcccca

SEQ ID NO: 502195 - DNA, 384 bp, Homo sapiens
tcatagaggatctcacccgactagccgacagccccacgtagtacagctagtggggtagaagagtgcatagaacacaggcacctaacaggcccggggacctaagcacgaagacatacccgcagcacatatgaagaccaagccgctatctaggccgggagcagataagtcgggctattcaggaaggaggtccatttctaactgcaaggtcctacaggccgccctggtaccccctatgcacactactatgctataccgtagggaatcagacaccctagaacactaaactacatactaccacagtacacctaccgtagaatgaagaagtaagaccctgtacgggactagtacgggggggttacctgagctacgaatatcgtaatacat

SEQ ID NO: 502196 - DNA, 331 bp, Homo sapiens
tgtgatctagaggatcccgagctctctctgtgggggaaggggagagatcccaggtgttcacatttccaccacagagtcctgcaatcccagccatgggagagcctcttgaccctcagaggctctcagactaacatggtggagctgccttgagaccatgctagggaattggtccaaggagggaactcacacggggtcccacatgcatcccctgagtcctaagcagctgtagcgtggtacgatttggagagcccagccctcaccagacagcatcctttcctagggcctgacagcacctgcgtctccacatctctcaagcccccacagagagcgt

SEQ ID NO: 502197 - DNA, 179 bp, Homo sapiens
aatatttgacatgtgggaggagatgtggcaccattattgagttctgaggccatacagatggaacatagttttatgggacatacgatgatggagcaccaactcatgatgaggcacgcggctcattgctgatttggggagcacatctattactaatctgggtttggagacactgggtttct

SEQ ID NO: 502198 - DNA, 111 bp, Homo sapiens
gctgattctagagcatccccttctacggtctcatcactgtagttaaaggcaaagcaccataggtaaagctgatcaactgtccagagtactcaagcttacggaatctatgct

SEQ ID NO: 502199 - DNA, 173 bp, Homo sapiens
  misc_feature (79)..(79): n is a, c, g, or t
gcggtttgaacctcagattaatgcggaggaaagtgaaattcgttattctacatggaagaaagctgtgatgaagtcaatnggttgggttacaactcaatctccagaaagtggtattccataaaacctaccaactcatggattcccaagatgtgagctttttacataatgaaaga

SEQ ID NO: 502200 - DNA, 422 bp, Homo sapiens
  misc_feature (13)..(13): n is a, c, g, or t
  misc_feature (416)..(416): n is a, c, g, or t
gagacggagcttnactctgtcactcaggctggagcgcaatggtgtgatcttggctcactgcaacctccacctcccgggttcaagcaattctcctgcctcagcctcctgagtagctgggattacaggtgtgtaccaccacgcctgggtaattgtttttgtatttttagtagtggggggtggggtttcatcattttgaccagggctggtctcgaactcttgacctcagatgatccgcccacctcggcctcccaaagtgctggggattgcatgtgtaagccaccgttcctgggctcatatttaaattaattatatcacaacaagatctgcaagttcatactcagagtatatattttgaactattaatgggttcaaaatagtttaaggatatattttattaattttaatttctcacttantttcac

SEQ ID NO: 502201 - DNA, 103 bp, Homo sapiens
tgccttaaaggcagaagcacagagcctggctcggggcgctgcagtactggagccccatagttgaaaattatcttcctcccagctcctacccactcctgtccag

SEQ ID NO: 502202 - DNA, 518 bp, Homo sapiens
  misc_feature (136)..(136): n is a, c, g, or t
acgaacccaaagggaaaagaggaaggccccccatttatgttttttaggccttttagaaaacatggagttgttcctttggccccatatatgcgaatttataaaaaaggtgatattgtagacatcaaggggatgggtnctgttccaaaagggatgcccccccagtgtttccctggccaaactggaaaagttttcaatgtttccccgcctgctgttggccttgttgttaaccaaccagtttagggcaagatttttgcccaaaaaattaatgtgggtatttggcccctttagcccttttaaagcccagatagcttcctttaacgtgtgtagggaaatgttcccaaaaaaaaaaaagcccaaaaaaaagggtcctgggttttatttaagggccagcctgctccccccaaaaaagcccccttttttagaacccatgggaaggagccttagctgctgggacctttttccttttaatttatgggataattggtgtttaaaaaaaaaattaagggcctttggggtta

SEQ ID NO: 502203 - DNA, 240 bp, Homo sapiens
  misc_feature (1)..(1): n is a, c, g, or t
  misc_feature (10)..(10): n is a, c, g, or t
  misc_feature (15)..(15): n is a, c, g, or t
  misc_feature (69)..(69): n is a, c, g, or t
  misc_feature (114)..(114): n is a, c, g, or t
  misc_feature (206)..(206): n is a, c, g, or t
nctgcaggantcggnacgagcggatgcaacacatgctaaggaagcaaaggaagccttcctggaactcantctaggagtggctaggaaaggttttacaaaaaggaaacacttganctggatactgattgacaagtaggttcaccaggcagataagggaggaaaattttgtaacagagggaaagcactggcaaaagcaggaaattcantgtgcttcagagaggagaaagcccacatatggga

SEQ ID NO: 502204 - DNA, 768 bp, Homo sapiens
  misc_feature (14)..(14): n is a, c, g, or t
  misc_feature (33)..(33): n is a, c, g, or t
  misc_feature (51)..(51): n is a, c, g, or t
  misc_feature (61)..(61): n is a, c, g, or t
  misc_feature (88)..(88): n is a, c, g, or t
  misc_feature (105)..(105): n is a, c, g, or t
  misc_feature (128)..(128): n is a, c, g, or t
  misc_feature (327)..(327): n is a, c, g, or t
  misc_feature (462)..(462): n is a, c, g, or t
  misc_feature (536)..(536): n is a, c, g, or t
  misc_feature (542)..(542): n is a, c, g, or t
  misc_feature (549)..(549): n is a, c, g, or t
  misc_feature (557)..(557): n is a, c, g, or t
acccatagggaaancccaaggttaaaccttttngggggaattgcccatacngtctccgttnacattctccccggcgagtgccccaagngttacaatttctccaanaccctggccaacacttatttccnattttttttttttttttttataacttggatgtgaagtagtttctcattgtggctttgatttgcatttccctaatgactaatgaagttgagcatctttttgcatattttttggccgatttgtaaatcttcagagaaatgtctaaggcctttgcccatttatgaattgggttatttttgttgttgtcgagttatacaagtnctttatatgttccatgtattaatcctttatcagatgtatgatctgcagatattttctgctattctgtgggtgatgttttcactctttttaaattaattaatcggttttttagaatagagatgggatctcactatnttgctcagggtggtctcaaactcttgggcttaagtgatccacctgcatcagcctcccaaagtgttgagattacnggtatnagccacngtacccanactaactttatttttttaagttgttgttattattattttttgagatggagtctcactctgtcacctagcctggagtgcagtggcgtgatctctgctcacctcagttaacgcctcccccgttcaagtgattctcctgttttagtcccccgagtccctgggattacaggcacgtgacaccactgctggctgatgagttcgtgtatactctaga

SEQ ID NO: 502205 - DNA, 135 bp, Homo sapiens
ccctagagttaccgggtgctgctctctggcttcgctgttacgcctgagcagtgcctggtcatgatcaatatctccatctcctgtgatcataatgcgtttctcaattcttgcttcagaaattccaccttttacagt

SEQ ID NO: 502206 - DNA, 231 bp, Homo sapiens
gctgtcatagtcccagaggataagcaatacctatttttgactgagtttcccagcccagacccagggacccttggccccaagctcagctttaaaaaccgccccaacccctccagctccaaatttgagcctcccccacatagactgaaactcccctggccccagccctttcctgcctggcctggcctgggacacctcctttttgccaggaggcaataaaagccagccccggga

SEQ ID NO: 502207 - DNA, 519 bp, Homo sapiens
  misc_feature (513)..(513): n is a, c, g, or t
ggtatcgctttggtatgtttccgtgtgtggttgcctttttattacacagcttttaatattttttttccttgtagtgctgacgactgaatccagggccttgtgcatgctcaggaggtgctctcccactgagctgtgtctgcagcccttaggatttcagtataaagttgcagatgaatattttatattagacaatctactcattaccttaatattttataactaccctagacctagttccttttatctttgacttatcccactggtttgtcactttaggagaaatacaaaggtgagaataggtgtcagataacgtggtatggttacttttcgtagacgaggtaaaagtattgggtttatatttccctaccatatgcatgcaaaagtttaagttgacaagtcataatgtctgcagcttattttaaattgaaactgatcagtgactgttgaattgtgatcaccccttaaacttgtctgtacctatgtttaaatgtaataaaaattgaggcaaaaatnatttaa

SEQ ID NO: 502208 - DNA, 420 bp, Homo sapiens
tgagatagagtctcactctttcacccaggctggagtgcagtggtgcaatgtcagctcactgcaacctctatctccgaggttcaagcgattctcgtgcctcagcctccagagtagctgggattacaaggcatgtatcaccatacccagctaatttgtatttttagtagagacagggcttcaccacgttagccaggctggtctcgaactcctggcttcaagtgatccacccatctcagcctcccaaagtgccggaattacagatgtgagccaccgtgccctgcccaaagaaatttttaatattaaaatttattacaggaatgtgatactgattagaactgactataagagtaacctcagttaaacacgttttctaacttctatcaaaaatcgctttcggccaggcgcagtggctcacgcctg

SEQ ID NO: 502209 - DNA, 455 bp, Homo sapiens
  misc_feature (449)..(449): n is a, c, g, or t
ctgcttacaaagaattgagagtaacatgttagattatatggtaatctagagtttgagacattggagatgataattaagttgtacttttcaaatagccaatatgttggaacaaaaagatgcctgagacagccacatgcaaggtgtgatcttttattgagaaataaagtcagaaaaaaaaaaaaaaccctgtaagacgtttgagggatctttaggagaaatacaaaggtgagaataggtgtcagataacgtggtatggttacttttcgtagacgaggtaaaagtattgggtttatatttccctaccatatgcatgcaaaagtttaagttgacaagtcataatgtctgcagcttattttaaattgaaactgatcagtgactgttgaattgtgatcaccccttaaacttgtctgtacctatgtttaaatgtaataaaaattgaggcaaaaatnatttaa

SEQ ID NO: 502210 - DNA, 747 bp, Homo sapiens
agcggagtctgcgctcgggctgcaggagaagatggcgcgtctccataggagttaaagtccctcgtccttgtcgcttgtcggaagaacttgtaagacggacaggaacaaggagtacgcgcctgcacggtacacgttaccgctggggccttgtagagatgatgaaggatagtagacactatacaagggtggacgatggccgatgagtatcattcggtgcctagcccaaggcacgaacattatgagaagaccagtaatgatactaagccgtgaataggttatggaatgatgtgtaccctagaattaccgcaaggaagcatcgcttccggtcaggttagcatttatggtgacaataatagtgtatagtatcgaactggaatacatagtatagtgtccaagtggggactaggtgagatagccccggaggcatacctatgtgttatgcgcaatattggcatatcatttttcatactaagggcatacacatatgtcccgtaccttccaatgacgctatagaaccgtcttagttgattgttccaaaagtagaaacgagactacagttgaaagccttcccgagcatgtcccaaccctagggagaagggaaccaaaagcagttggcacaacccaaattattagatttccctcatgatgtgaattcttccaagaactttgttcctatagaaattccaaaacaacccctttcgtaccgtccatgttcaattggttctttggattttaaagtaattcaca

SEQ ID NO: 502211 - DNA, 259 bp, Homo sapiens
aaaagattaatatgggtgtttatttgggggcattttaagttttaaaaaaagggaggcagatggagattatcccccacaaatatatttaaatggttttttgttaatttgaatttaaaaccccccccctatttaaagtaattagttacgcatttagttccatggccagtttttttttttaatcaatttcagtaagacaaaatattctaaaatgtttaaatagcctcattcaatcttacattttgacattccagcaatcatt

SEQ ID NO: 502212 - DNA, 735 bp, Homo sapiens
cttctgcgtcctgctgaagctctgtgctctccaggcacttccaacaccactaggtgcctggttctcttgactccaccaggtaaacagagccaccatgtctcgtccagtcgagatgtgtccttccggagcgggggcagtcgtagcttcagcagccgtctctgccatcatcccgtgctgtctcccgcaccagacttacatctccgtgatgccggtccgggggtaggacggtaggatggtggcttcgagcaaggtcagccttgtcgggtgcttgtggagtgggtggctatgcgtcagtcgcggagcactctacaatctgagggaggcctccaagaggatatccatcagacactagttggtgtgcagcttcaggaaccggttcggtgctggtgctggaggcggctatggctttggaggtggtgccggctagtggactctgggcttgtcggcggtggagcatggctggtggctttgggctcggtggcggagcgtggcgttggaggtggcttcggtggcgcctggcgtttccgtgtctgacctcctggaaggtatccaagaggtcactgtcaaccagagtctcctgactcccctcaacctgcgaatcgaccccagcatccagagggtgaggaccgaggagcgcggagcagatcaagagcctcaacaatcagtttgcctccttcatcgacaaggctgcggttcctggagcagcagaacaaggttctggacacaagtggaccc

SEQ ID NO: 502213 - DNA, 679 bp, Homo sapiens
caggattatatacggagttctttggaccttctttcatgtatagactaaaatagtggtgctatcaatcgatgtgcatcatgagtactactccaatagaaagtatggggcatgtcaaagtatacagtacaccactttcatacatgtacaacataggtggatgaagaatgtctcttagcagtaatactggatgtagcctctggttttaccagctgcaaactctaggactattatataagtaaaaatctctcttgtgatactggaaagtgattagaatgtgcaaactgatatagtagctatcatccgcctcttaaagggtaccaccacaggaaagtccatttaagatgttggtaggtttaacaaagttggaatgctggcactgttgaattgggcaacagttcttcagacctggctcagagctacaatgcatttagtatattaaagcagctgacatgatgactttttgcgagccttcccaggcactggagtttatctgttaatttgccgcactaggtcataaaagatctcattaacatttatttttgattttgcagaagattctaagaatgcacagttgtaccattgtcttgctagattttgaccttgttccttccctacaactctttcatcttccaagtcacacttatttaccacaaggatcattggacctcctcagtgtctt

SEQ ID NO: 502214 - DNA, 313 bp, Homo sapiens
gactctagattatcccaatcgcacgacaaggagtgagaccactgacgcgcaccaccacgcccagctagttttttgtattttttttttgagatgaggttttgccatgttgcgcaggctgatctcaaacttctgggctaaagcaatctgcctacctcagcctcccagaatgctggggtaacaggtttgagccattggccctagcctaagtttggctaagtccctgtttactacattctaaaattttaaattgaatttctgtttttgggtcactaagggtttttggttggttggtctgttttggttttggtttaag

SEQ ID NO: 502215 - DNA, 185 bp, Homo sapiens
cgaactgggggtacacttggcttactagaacgtaacacctttggtttaacaccgactctttaaacactgtgaaaagaccaacacagactgggaggagaaccacgttatgcacatagccaacaaacgctccttttatgtctgtgtgtctatatatatgcgtgtgtgtgtgtgtgtgtgtgtgtgtg

SEQ ID NO: 502216 - DNA, 524 bp, Homo sapiens
cgggacctgccagttgcattgggggaatgttgacatttgaggtgggcaggcaggatgcctgcgttttaaaatatttgggtgagtaactgatccaaccaagggaaggttgattgattaaatctgaagtgggattcttggtaaaatgaagacttttatttgggaatgaaaaaccttaaaaaaatgttgtcatcgttgaagtgtgcattttccctgcattttttcccaacaaaattttgttgggggttatgttactgaagaatgaacagatgagtaagtggaggtgttatgtaaaggcatattgtactcgaaatctgaagacctgcagcagatgtaaattacaactcttgttttaactttttaaaagtgtgtgaaaatgtcaaaatataaatgagtcaagtgttattttactgtgtgatgggtggatgaggctgtccaatgtaccatttgaatgaattctcacgcatggtttgacagtgcaagaattctgtatcatttacaaactcaataaaaagtgagtatatgga

SEQ ID NO: 502217 - DNA, 393 bp, Homo sapiens
tagaggtaagaaaataagtttatgtttgaccaggcacggtggctcacgcctgtaatcctagcacttagggaggctgaggcgggcagatcaggaggtcaagagatcggaccatcctagccaacatggtgaagcctcgtctctactaaaaattcaaaacttagctggccatgatgacacacgcctgtagtcccagctactcaggaggctgaggcaggagaatcacttgaacccaggaggcagaggttgcggtggaccgagatcatgccactgcattccaacccggcgacagaacaaagactccatctcaggagggtccgtggcttcattcttgaagtcagtgagaccaagaacccaccaattccagacacacttatacacttggcactgggaggt

SEQ ID NO: 502218 - DNA, 469 bp, Homo sapiens
tgtgcgtcctgcgacacctgggccaggtccatccctgctgtcagtgcctatccggggccatatcctcccccaggccccacacaggagagggctgggccagataggttgacgcagctcccacccgcagaacttggcgagctacgacgtctgcagcatcctcctgggcacctcgacgctgctggtgtgggtgggcgtgatccgttacctgaccttcttccacaactacaatatcctcatcgccacactgcggtgtggccctgcccagcgtcatgcgcttctgctgctgctgtggctgtcatctacctgggctactgcttctgtggctggatcgtgctggggccctatcatgtgaagttccgctcactctccatggtgtctgagtgcctgttctcgctcatcaatggggacgacatgtttgtgacgttcgccgccatgcaggcgcagcagggccgcagcagcctggtgtggc

SEQ ID NO: 502219 - DNA, 303 bp, Homo sapiens
ccgtaccgatggccatgcattgctgtctgcacactccatcaggaggaagggcatgaaagtcacatgcagtacagtgaaactcatctggtgtcacacactgcccagcagtgagggtgagagctcgtgctccacactgctgtgctgtgccttgtgcttgctccgagatgcaatcctgcttgctccagacttcatgccatgtggccatctgggactgtgcatggtgccatctgggacgggttgggtgatccctctagatgtcgaccctgcagtgcattgcaatgctttggcaacttggcccgtcgg

SEQ ID NO: 502220 - DNA, 713 bp, Homo sapiens
  misc_feature (43)..(43): n is a, c, g, or t
  misc_feature (46)..(46): n is a, c, g, or t
  misc_feature (48)..(48): n is a, c, g, or t
  misc_feature (54)..(54): n is a, c, g, or t
  misc_feature (69)..(69): n is a, c, g, or t
  misc_feature (85)..(85): n is a, c, g, or t
  misc_feature (92)..(92): n is a, c, g, or t
  misc_feature (95)..(95): n is a, c, g, or t
  misc_feature (101)..(101): n is a, c, g, or t
  misc_feature (105)..(105): n is a, c, g, or t
  misc_feature (109)..(111): n is a, c, g, or t
  misc_feature (119)..(119): n is a, c, g, or t
  misc_feature (127)..(127): n is a, c, g, or t
  misc_feature (129)..(130): n is a, c, g, or t
  misc_feature (140)..(140): n is a, c, g, or t
  misc_feature (146)..(146): n is a, c, g, or t
  misc_feature (151)..(151): n is a, c, g, or t
  misc_feature (160)..(161): n is a, c, g, or t
  misc_feature (167)..(167): n is a, c, g, or t
  misc_feature (170)..(170): n is a, c, g, or t
  misc_feature (182)..(182): n is a, c, g, or t
  misc_feature (184)..(185): n is a, c, g, or t
  misc_feature (187)..(187): n is a, c, g, or t
  misc_feature (189)..(189): n is a, c, g, or t
  misc_feature (198)..(198): n is a, c, g, or t
  misc_feature (218)..(218): n is a, c, g, or t
  misc_feature (223)..(223): n is a, c, g, or t
  misc_feature (226)..(226): n is a, c, g, or t
  misc_feature (230)..(230): n is a, c, g, or t
  misc_feature (234)..(234): n is a, c, g, or t
  misc_feature (242)..(242): n is a, c, g, or t
  misc_feature (269)..(269): n is a, c, g, or t
  misc_feature (281)..(281): n is a, c, g, or t
  misc_feature (283)..(283): n is a, c, g, or t
  misc_feature (287)..(287): n is a, c, g, or t
  misc_feature (293)..(293): n is a, c, g, or t
  misc_feature (296)..(297): n is a, c, g, or t
  misc_feature (299)..(299): n is a, c, g, or t
  misc_feature (305)..(305): n is a, c, g, or t
  misc_feature (315)..(318): n is a, c, g, or t
  misc_feature (323)..(323): n is a, c, g, or t
  misc_feature (331)..(332): n is a, c, g, or t
  misc_feature (336)..(336): n is a, c, g, or t
  misc_feature (338)..(338): n is a, c, g, or t
  misc_feature (344)..(344): n is a, c, g, or t
  misc_feature (346)..(346): n is a, c, g, or t
  misc_feature (348)..(348): n is a, c, g, or t
  misc_feature (357)..(357): n is a, c, g, or t
  misc_feature (363)..(363): n is a, c, g, or t
  misc_feature (369)..(370): n is a, c, g, or t
  misc_feature (382)..(382): n is a, c, g, or t
  misc_feature (384)..(384): n is a, c, g, or t
  misc_feature (386)..(386): n is a, c, g, or t
  misc_feature (404)..(404): n is a, c, g, or t
  misc_feature (412)..(412): n is a, c, g, or t
  misc_feature (415)..(415): n is a, c, g, or t
  misc_feature (419)..(419): n is a, c, g, or t
  misc_feature (421)..(421): n is a, c, g, or t
  misc_feature (426)..(426): n is a, c, g, or t
  misc_feature (433)..(433): n is a, c, g, or t
  misc_feature (437)..(437): n is a, c, g, or t
  misc_feature (439)..(441): n is a, c, g, or t
  misc_feature (444)..(444): n is a, c, g, or t
  misc_feature (448)..(448): n is a, c, g, or t
  misc_feature (451)..(451): n is a, c, g, or t
  misc_feature (455)..(455): n is a, c, g, or t
  misc_feature (460)..(460): n is a, c, g, or t
  misc_feature (464)..(464): n is a, c, g, or t
  misc_feature (483)..(483): n is a, c, g, or t
  misc_feature (497)..(497): n is a, c, g, or t
  misc_feature (509)..(509): n is a, c, g, or t
  misc_feature (544)..(545): n is a, c, g, or t
  misc_feature (562)..(562): n is a, c, g, or t
  misc_feature (692)..(692): n is a, c, g, or t
gcaccctccccactgggctcctggttgcagagctccaagtccncananagaaangcctgtttgagaagnagcgggaaagaaagangcaagcncanaggccntganattnnngtgggctnaggtcccnannggctcaggcncctgcntcccnaggaaaggnnaaaaanaanaggggagtcccntnnangnacttgcttnaggtgctgaaacaggcgcanctccnagnagcnactnagggaaanaaagtggtgctgggaaaaaaagggganaaagtggaaaananaagnaaagcntcnnanaaaaanaaaaaaaaannnnacagnaaaaacannaaananaaaaanantntgggaaaanagggcnccttcnnaaaaaaaggtcnancnaagcagaaaaaaagcgcngactcaanaanaagnanttggnacaaaanaaantnnnacntganaanaaanaatcnaaanaaaaaaaaaaaaaaaactnaaatctgtgaaatngaggaacaaaangaggaggtgcaattgaaagagttcggattgaccgnnaaaacagaaacccaccngcatcaagggaagagcatagaaacatgaacttggagagaaccccagggtagtagcccctcagtgcaatgtaggagtccaaggggtaaaaacatacagggggggaagacctctccgtgttcagctggagtncaggatagtggactggacatg

SEQ ID NO: 502221 - DNA, 848 bp, Homo sapiens
  misc_feature (15)..(15): n is a, c, g, or t
  misc_feature (80)..(80): n is a, c, g, or t
  misc_feature (84)..(84): n is a, c, g, or t
  misc_feature (100)..(100): n is a, c, g, or t
  misc_feature (103)..(103): n is a, c, g, or t
  misc_feature (105)..(105): n is a, c, g, or t
  misc_feature (116)..(116): n is a, c, g, or t
  misc_feature (147)..(147): n is a, c, g, or t
  misc_feature (162)..(162): n is a, c, g, or t
  misc_feature (177)..(177): n is a, c, g, or t
  misc_feature (181)..(181): n is a, c, g, or t
  misc_feature (192)..(192): n is a, c, g, or t
  misc_feature (226)..(226): n is a, c, g, or t
  misc_feature (236)..(236): n is a, c, g, or t
  misc_feature (241)..(241): n is a, c, g, or t
  misc_feature (248)..(248): n is a, c, g, or t
  misc_feature (271)..(273): n is a, c, g, or t
  misc_feature (276)..(277): n is a, c, g, or t
  misc_feature (345)..(345): n is a, c, g, or t
  misc_feature (348)..(350): n is a, c, g, or t
  misc_feature (357)..(357): n is a, c, g, or t
  misc_feature (367)..(368): n is a, c, g, or t
  misc_feature (410)..(410): n is a, c, g, or t
  misc_feature (441)..(441): n is a, c, g, or t
  misc_feature (447)..(447): n is a, c, g, or t
  misc_feature (452)..(453): n is a, c, g, or t
  misc_feature (474)..(474): n is a, c, g, or t
  misc_feature (495)..(495): n is a, c, g, or t
  misc_feature (535)..(535): n is a, c, g, or t
  misc_feature (589)..(589): n is a, c, g, or t
actggatgatttttnttttgaacatttgccccactacactgttttggggatagctggttaagcaagttaaagatatttanattnatattggaattttagnaantntttttcaggtnaaatatataatttcaagtgcttttaatgaanttatttttaattggntagggagcaaaaaanaagngagctctgctnttagttagttaaccttgttcttctcttaaatagnacagcggcanggtanttaaaantccaggaagcatgggattttatnnngcnngattttgggcacatgaaataatagctctaggaaaatgcgcatcttaatgactctttgtaaagagaggnatnnnttacaantgtgatgttnncttacataaaagttaccccataagttaatcctaacttttatncttgaattttatttcatcccaatagcttgtntcattngcacnnctttgtattttgattgacctntagaatggatgttaggaaacncaaaattgaacacagtgaaacaaatggtatttgaagaaangtaataccctttatattctatttatgatacccataatcaaatgagattattttnccacataaatgttttaaatatcagatttttagtttgcagttttaggaaaatgctttagatagaaaaggttcttatgcattgaatttggagtactaccaacaatgaatgaatttattttttatattcttacacattttattggtcattgtcacagatagtaaatactaaaaatttcaggtcagtttgttttgaaactgaaattggaaataaatctggaaatgttttgttgccctaaaataataaaatgaatttttctgga

SEQ ID NO: 502222 - DNA, 716 bp, Homo sapiens
  misc_feature (339)..(339): n is a, c, g, or t
  misc_feature (425)..(425): n is a, c, g, or t
  misc_feature (476)..(476): n is a, c, g, or t
  misc_feature (483)..(483): n is a, c, g, or t
  misc_feature (525)..(525): n is a, c, g, or t
  misc_feature (542)..(542): n is a, c, g, or t
  misc_feature (556)..(556): n is a, c, g, or t
  misc_feature (563)..(563): n is a, c, g, or t
  misc_feature (570)..(570): n is a, c, g, or t
  misc_feature (585)..(585): n is a, c, g, or t
ctgatagtctttttccacattagatcatctctagaaattggttgttttacaatacataagatgtcaatagttaattggtagtgtttttacttgagacaggttctggctctattacccaggctggcatgcagtgatatgatctcagcttgctataacctctgcctcccaggctcaagtgctcctcccacctcagcctcagaagtggttggaaatacaggtgtgtgccacagacacccagctaattgtcatctacccgcctcagcttcccaaactgttgggattgcaggtatgagccactgtgcccagcagaaattacatttacaaattaatatgaagacntggtgataactaacatatttataacatgaaatctgctcatccaggaacatagaatgcaaatctttcattccactcagcaaaatttngtcctgtccttgataaaagtcctgcacatctaagtttattcctaggtattnaattttngctgaaatacctgaaaaaatacttcatcactatatcttctangtgattatagctaacantggggaaggctatngattttnatataanagaacttttaaccantaatcttaaaaattgtttttctcagttggttcctttggatatttttaggtaaacaatcatgtcaactgaaaataatgataaattttctataaagactatgacatcacaggaaaatacagtaaatacttttt

SEQ ID NO: 502223 - DNA, 242 bp, Homo sapiens
ggggggggcccccccccccccgggggggggtttttttccccccaaaaaaaaaaaattttttttttggggcccgcgccaatttttttaaaaggggggggggccccccttttttcccaaaaaaaaaggtttttcccccccccgggggccccccccgtttggggttttttttggggggggggtttttcccccccccgggggggttttttttttttttggccccctttttaaggggggccccccca

SEQ ID NO: 502224 - DNA, 299 bp, Homo sapiens
  misc_feature (2)..(2): n is a, c, g, or t
  misc_feature (57)..(57): n is a, c, g, or t
  misc_feature (72)..(72): n is a, c, g, or t
  misc_feature (135)..(135): n is a, c, g, or t
  misc_feature (275)..(275): n is a, c, g, or t
antcaaagagtcccagaaggcctctcaattctctgtccatcaagactagcagcgggnctggagtcggctaangcagtgccacacactcgcagccctcacccacccccagcaatgagagtacagacacggcctctnagatcggcagtgctttcaactcgccactggctcgcctatccgctcagccaacccgacgcggccctccagccctgtcaccttccacatctccaaggtgctttttggagaggatgacagcctgctgcgtgttgactgcatanggtacaaccgtgctgttcgtgatt

SEQ ID NO: 502225 - DNA, 150 bp, Homo sapiens
  misc_feature (92)..(92): n is a, c, g, or t
gacctgggcaccttcacgggctactaagccctggccctggcctggcgctgcccgcggacggcggcgtggtgacctgcgaggtggacgcgcanccccggagctgggacggcccctgtggaggcaggccgaggcggacgacaagatcgacct

SEQ ID NO: 502226 - DNA, 228 bp, Homo sapiens
agggtttttttttgggggttgggggtttttcccccaaacaatttcccgggccccccttttggggggggggtgattttgggcccaaaaattggggtttgggggccctttggtttgttggggtccccccccccccgggggggggggggcctttggaaacaaaaaaattttgggggcccccccttctttttttttcccccccggtttttaaaatatttttttaaaagccca

SEQ ID NO: 502227 - DNA, 110 bp, Homo sapiens
gggctcccctgtgtaactgacacttagggagatttggaagctgggtgtgggctttgggttcatcaccaagtttgaggcagagtctgcactccctaaaagcaaagggggaa

SEQ ID NO: 502228 - DNA, 370 bp, Homo sapiens
tgactaatatacactcccaccaacgataatgtgtactgatgtctgccacatcctctccagcatctgttgtatcctaacattgataagtaatcgccattctaactggtgtgccttggcatctcattgaagttttgatttgcatgtctctagtgaccagtgatgatgagcttatcttcatgttggtagctagcataaatgtcttcttatgaaactgttcatatccttagcccactttttgatagggttgtatttttcttgtaaatttaagttccttgtagattctggatattagccctttgtcagatggatagattccagaaattttccccattctgtaggtggcctgttgattctgatggtagaaccgact

SEQ ID NO: 502229 - DNA, 410 bp, Homo sapiens
ggacctaaaagcttagctgcccctcttacgtgtcgaactacgattcagtcctgaactccgatcctctcctgtctctggtaggcatgcagccttctcgaaagtgtcttcccatttctttgatacataactctgtgttctttcttcctgtggctagcatgcacgtcggatatattgaagtataagcatagtctctccgggctgagagatttctagctacttcatcaggcaccagtattaagtaatagtccttgacataaactgtttgagtaatcatttccatcataccctatcggatagagacacatagctcctagtacctgtacatcgagcctagtctgagataccgtgtgtagagtgagctaagatctctggtagtaagcctgcgctactcgttcatgaattgatattag

SEQ ID NO: 502230 - DNA, 592 bp, Homo sapiens
  misc_feature (24)..(24): n is a, c, g, or t
  misc_feature (49)..(49): n is a, c, g, or t
  misc_feature (135)..(135): n is a, c, g, or t
tggagaaatatcaaaaggtttatngaaacatactcagctcagacgtacnggcttatgaagcggtcagtcctcccccggcccccaaacactaacctttttcatttttctttaagggttaagggcttagtgggtagntttatatagaaacaagcaagtgtaggtgattagagttatcgtgcagagggacccaccctcatttatacattccagtgccgctcgaggttaaaactcgtgcttgtgaactcgagtgctagaaggttagtgcgtggccaaacaggtgcagagaaacagtgggggccttggaagtggccgagaagtgttcgaaagtgctaaatacacaaaggaagtgactgtgctcaggacagagtggaaaccatgtgacagaaacaaggggctgggaaaagggcgtgtttccagggaaccgtgcagaaaaaccaaaacaaaatatcccccacaccgctccaaagagcaacaagaaaccctcagtggtgatccattccatccaggaattttcaccatagcacgggaaaggacccgaggggtcacggctgggtgaggcacgcgagaggtcatctctgaatcctagggggac

SEQ ID NO: 502231 - DNA, 218 bp, Homo sapiens
gtaaagtttaccacaaccaccaccccatcatactctttcaccccacagcacccaatcctaccctccattcgctaacctcacctaaaatcactcaccaagacctcaaccctgacctccatgcctagatactcctcaatagccatcgctgtagtatatccacagacaaccatcattccccctaaataaattaaaaaactattaaacccatatacctcccc

SEQ ID NO: 502232 - DNA, 763 bp, Homo sapiens
gctatcaggggctgggtcgggaaatcggagcgggtttgaggaaggagtcggggctgagggagagaggaggatggagagcggtggtgtgcgtcttctctctccgtcgacggtggggcgctcatcgttcctcctcggtctacttgcataatccaccagttgtcttgatttagaattgtggattacattgaagtgctagatcatggtgtgtcaaacatcagacaagtggagtaatcccaggacattgacttggccactcaccatggtcacctgtattacggctcagtgtcatgcgcccctggttcatcttccttctccaagttacctgtgggccacctgtggaatatatatcgtggtagccaagtggccctgtgctaattcaccggtgaaccctcggctgagaacagacggaggaagcgaaattccaagatgcagctcagtgcatcaaagcctagcaggtcccttcagtctgccttttcatggcctgccacgggatctacagtaggacaaaagcgtgacactggtctttgacagttaagagctaaagaaagctgcctataggaagtatctcccatgcacttaccaacattctatcgtggtattacaacttattgggtatgcaatgaatcacttcttagaatggtattgtcctggagggcagaatatgccattcctatttgactcactctgcgttcggtctgggacctaaacaagtgcttgacgcaacaataatggtgtgatgatactaaagggtgaccgcgacatg

SEQ ID NO: 502233 - DNA, 347 bp, Homo sapiens
tccccacctcgtaccccagaagctgtgtggagcagaaatataaaatctcatcgtggaagtgtacatgaacaatacaatgaaatgatgttgagaaattggggtgtggggtgggtgttaagttgtaaggatcagtttccttttttaaagaatggtataagactatctttggagccgctttttttttctttttcatttttttaaaagattgagtggtacactaataaatgagagtttgaaattagaggtaatttatgttttatatacagatttcaagacatttgctaattttgtagtttcatgtgattagtttccaaaggttacagataataaagaaatcagaaatggtg

SEQ ID NO: 502234 - DNA, 179 bp, Homo sapiens
gtatcgaattgagctggtacccccatcaagaggactcgggatggtgcttctactgcccggactgcaaagccaggaatgagttgatgtttgtcgacatggccggcggcgccgtcgagctggttcagccggagcgagcgagcccgccgcacaaggtcgttgcaacggcccgagcgctggag

SEQ ID NO: 502235 - DNA, 1040 bp, Homo sapiens
  misc_feature (2)..(3): n is a, c, g, or t
  misc_feature (505)..(505): n is a, c, g, or t
  misc_feature (526)..(526): n is a, c, g, or t
  misc_feature (585)..(585): n is a, c, g, or t
  misc_feature (596)..(596): n is a, c, g, or t
  misc_feature (638)..(638): n is a, c, g, or t
  misc_feature (640)..(640): n is a, c, g, or t
  misc_feature (650)..(650): n is a, c, g, or t
  misc_feature (657)..(657): n is a, c, g, or t
  misc_feature (695)..(695): n is a, c, g, or t
  misc_feature (732)..(733): n is a, c, g, or t
  misc_feature (737)..(737): n is a, c, g, or t
  misc_feature (740)..(740): n is a, c, g, or t
  misc_feature (779)..(780): n is a, c, g, or t
  misc_feature (821)..(821): n is a, c, g, or t
  misc_feature (936)..(937): n is a, c, g, or t
  misc_feature (1006)..(1006): n is a, c, g, or t
  misc_feature (1010)..(1010): n is a, c, g, or t
  misc_feature (1034)..(1034): n is a, c, g, or t
cnnccggctgcaggaattcggcacgagattacaggcatgagtcactgcacctggcctgggaataacagtttaaggccagcctcttaaaatgaaagttattgtggcaacttctaaaagatgggttgaaaagagaggaaactggggataacatcataaatagattattatattatccctggtgaaagaaaatgaaggcctgaaacaaggcagagaaggcaaagataaacttgatatctaatggaatatgggtaagtaaccatataagttatcagccaaaatgggacatgcttaagagtcaaagaaggcactattaataattactccagcatatcaaaataccacattataccccataaatacatacaatttgtcaactaataattttttttttaattcatgagggggataagaagaagaaaaacattcctgcaggactagtctgggcagaagaggagttgtggaactagatatgaggagaaagagaggaaggaggcacagagcagtnggagcttgctgcctggaagantgacggtatgataaagagatgggatgatgtgaaataatcacattggtaatatgaagtgngtttgatcacntcagtgtacccagaacgacactcgtatcatgtcagatagggncnaatgtgtttnagtatgnatgaggaagggtgcagctaaggagtgcatctgatcatnatagacagactgcagattggatatgacttctgtgcanngtgngtnatggcattatagcatatgatatgactataaatactgatnngatgtgactagctgatgaaaaaggcaagtttgcactgcaangatagatctctgcttgcagcaccatatatattatatattattttttagtagcagtctgtcagtgtatcacagactgcgccagtgcaggcaacttcataagtgataatatacaaannttacattactttttatctatttttcggggggaatattgtgacattcttttgccggtgttatcactcttncttncattatggtccgtctttctcgctncttccc

SEQ ID NO: 502236 - DNA, 172 bp, Homo sapiens
agttagaggatcctgttattacagtgtgttgagtcagaattctaggagtggtggacatggttgttgtagtccagcatttggaggtgaggtggaggattgctgagacaggagtttgagaacagaggaaagaaaatgacaatgtggaactgtaaaaaaaaaaaatttttttttt

SEQ ID NO: 502237 - DNA, 965 bp, Homo sapiens
  misc_feature (2)..(3): n is a, c, g, or t
  misc_feature (505)..(505): n is a, c, g, or t
  misc_feature (526)..(526): n is a, c, g, or t
  misc_feature (585)..(585): n is a, c, g, or t
  misc_feature (596)..(596): n is a, c, g, or t
  misc_feature (638)..(638): n is a, c, g, or t
  misc_feature (640)..(640): n is a, c, g, or t
  misc_feature (650)..(650): n is a, c, g, or t
  misc_feature (657)..(657): n is a, c, g, or t
  misc_feature (695)..(695): n is a, c, g, or t
  misc_feature (732)..(733): n is a, c, g, or t
  misc_feature (737)..(737): n is a, c, g, or t
  misc_feature (740)..(740): n is a, c, g, or t
  misc_feature (779)..(780): n is a, c, g, or t
  misc_feature (886)..(886): n is a, c, g, or t
cnnccggctgcaggaattcggcacgagattacaggcatgagtcactgcacctggcctgggaataacagtttaaggccagcctcttaaaatgaaagttattgtggcaacttctaaaagatgggttgaaaagagaggaaactggggataacatcataaatagattattatattatccctggtgaaagaaaatgaaggcctgaaacaaggcagagaaggcaaagataaacttgatatctaatggaatatgggtaagtaaccatataagttatcagccaaaatgggacatgcttaagagtcaaagaaggcactattaataattactccagcatatcaaaataccacattataccccataaatacatacaatttgtcaactaataattttttttttaattcatgagggggataagaagaagaaaaacattcctgcaggactagtctgggcagaagaggagttgtggaactagatatgaggagaaagagaggaaggaggcacagagcagtnggagcttgctgcctggaagantgacggtatgataaagagatgggatgatgtgaaataatcacattggtaatatgaagtgngtttgatcacntcagtgtacccagaacgacactcgtatcatgtcagatagggncnaatgtgtttnagtatgnatgaggaagggtgcagctaaggagtgcatctgatcatnatagacagactgcagattggatatgacttctgtgcanngtgngtnatggcattatagcatatgatatgactataaatactgatnngatgtgactagctgatgattttgtagcagtctgtcagtgtaacataagctgcaccgattgcagtacacgttcatagagtaatagagttacatgcaatgttctcacnaaacccatccttttttagggggaattttacagggtcttccttttgacccgtttaactttttggagacaacctttgatat

SEQ ID NO: 502238 - DNA, 204 bp, Homo sapiens
gggccccccgggcccgggtaaaaaaatttttttggattttgttccccgggaaccaaagaaaaaaatggccgttgtagccaaagttgccgaattaaaaaaaaaaattggctttttattttttttttttggtttaaaaatttggaaaggatttttcccttttgccaaacaggggtgtccccccttattaaagccttttccaaatga

SEQ ID NO: 502239 - DNA, 241 bp, Homo sapiens
tccatgatggagagatgactttaatggggtggcaggaagagaacctcaagcagagcaaggctgcagcagcaaaagagcaggtttttgggtatgatagatcaggcgataagcacaggtggaaaagggttgggtgccaggccctcaagccaggctaagaacattggcaacaggatgcgggattccctcattgacaggctcaactgagtcacctttcaagttggtcccatgggctcctggctct

SEQ ID NO: 502240 - DNA, 686 bp, Homo sapiens
  misc_feature (619)..(619): n is a, c, g, or t
agcggggcatgctgtccgccgtgctgctccggcgccggcgggacttggccgcactcgtccgtcacgcccgtgcctatgtccgaggccgcgcgcacggcaccggctgccgcctctgggccctaaccagatgtccttcaccttccgcctctcccacgctgggtgattcttcaacggtgccaagcgtccggcaggtggacgtgcccacgctgaccgggagtcttcggcatcctggcggcccacgtgcgccacagctgcaggtcctagcggccggggctggtcgtggtgcatgcagaggacggcaccacacgtccaatatactttcgtgagcagcggttccgatcgacagtgaacgccgactcttcgagtgcagcttgttggccgaagtaggccgctgaggcttggaccatgtaggacctgggggcagccaaggcaaactatggagaaggtcccaggcggagctaggtggggacagctgatcgaggctcatcgcggagtcagacgatccagatccgaatacgaggtccaacgaggccctggtgaaggccctggagtaggcgagccagccgccaaggttgacctcgagcttctggagctcgacgtcgtggatgaacgtgaccancagtcgcgcgcccctattgagaagagccgtgaagcacgaaaacatgaagaagacctccggaggaggg

SEQ ID NO: 502241 - DNA, 144 bp, Homo sapiens
cgccaaactggatttcactggcctgtgacacatgtttaacggccgcggtaccctataccgtgcagcggttgcataatcacttgttccttaaatagggacatgtataactggctccacgatggttcaactgtctcttacttttat

SEQ ID NO: 502242 - DNA, 609 bp, Homo sapiens
  misc_feature (595)..(595): n is a, c, g, or t
  misc_feature (602)..(603): n is a, c, g, or t
ttttgggggtgggggggggaacccctccccccccccccccccccccccccccccgcgggtggttttttttaaaaaaaaaccccttcccccccccccaccaaaaaggaggggggggggttcaccccaccccctctcttttttttttttgtggtgggaagacccacccctcttttttttttttacacccccctttttttttttggggggggggggtttccccgcgggggggggggaaaatttttttttccccaaaaccagcggggtggtaaaaataagggcccgctggggggttttttttttggtccccaaacacggttttttttccccccccggggaaaaaaaaaaaaagggggggtggtgtttcccccgcgggggaaaaatattttggggggggggctttccccccggggggggggggaaaaaaagtttccccccccctttgcggccccccccctttaataaaaaacccccggtagaaattaggtgggtgggggggcgcccttttggggccccccaatagaggaggttaaacccccgggcttttgttaaaaacgcccctgggggtggaaaccaagccccccaaaaagatggcccngctcatnnaaaggc

SEQ ID NO: 502243 - DNA, 849 bp, Homo sapiens
cccatctcagttattgcgataacctccccgaaaaaaaaaagtttgtcggcgacgactctcttatctaccacgcgctaccgatggaatctgactctgtcacccaagctggagtccagtggcatgatctgggctgactgcaatctccatctcccggcttcaacagattctactacctcagcatatatagtagctgggagtagaggtgtgtgacaccacacctgagtaatttttgtattcttcatacagacagagtgcgactatgtaggccaggctgttttaaaactcctgacctaagcatgctcccacatgcgcctagcaaactgctgaaaggacaggagtggcccactgtacccgaactactgggttattttgacaactaaatattgagtatatatcagcacaacgactccgcttgcataacagccatcataatctgaccactcttcggaccccgcgcccagaccctcatatcatagacataacaacatgcggggctcgaatcaacagccaacacaaactcgactcatgggcacaccccttgtcatctcttaatcgtgactacacgcccctacatggtagcgacactcccgaaccgctatcacaaacgagactccctgttaaacccagctccattcctcgtccgcgtgtagcgtagcttctatttcgcagttgcgcccctacccagctcaacgctcgatctcgtacagagtagttatgcctcagtctacatcgcccctgcagcctctattgcgtcggccacgcgtgcaacttcgatttttgtccccctcagattgctagcgttgtgcgctcgcacgtgactctgtgatcccgctcatataaaaagtcgtt

SEQ ID NO: 502244 - DNA, 300 bp, Homo sapiens
catacctgtctgtctgctcccagctatcttgggtgttcttgcgacggcctggggcctcgctaaggatgtccttttccctcacggccacggctttaacggtgtctgttgcgagttcttcgctagtacatcttaaagctgtcaagatgggtctagcagaccttgcaagagaaataacatcagcattactctccttgagcaatgccaccattatcaatgacaaggtctcgaatgctatgctaaaagaagactgtaccgctttgatggaagcagatgctatattaaactagtgaagcaactaag

SEQ ID NO: 502245 - DNA, 151 bp, Homo sapiens
  misc_feature (46)..(46): n is a, c, g, or t
  misc_feature (94)..(94): n is a, c, g, or t
  misc_feature (122)..(122): n is a, c, g, or t
atgtgaaataatgaggatctgactgctcagatttccccaacttgtncttactttatcatgaatgtaagaaatagagcacagtggaatgaatacntgctagatcacactagcaaagaaacagnttggtttaaaaaatgcttcatttgggcca

SEQ ID NO: 502246 - DNA, 268 bp, Homo sapiens
tcccagcctggcgacagagcaagactccatctcaaaaaaaaatacatataaataaagtagaaggaaccagtcctggttctggtgaggttctggagggccagttatcatgtttggagctggttaagggtttggaggagatgggtgggatttagaatgaatgcttatggcaccacagttgaatgtgtgcctggatagagaaacgctgtcatcagtgtgtatcactgattctcacccggtgcagttttgctctccctaggagtgcttgcaa

SEQ ID NO: 502247 - DNA, 328 bp, Homo sapiens
acgatgacgaggaccacgaacagccagaggaacaggcgaccgcggcgggagagtgcctggacgttctcgtcctcctccgggtcgtccagctccgaggcggcggcgtatgcgcgctggctgcggagcgagaggagcgagaggatgaagaagacgagggcgagggcgaggagcacgtagcccacgaaggcgaacggtgcgatggcggtgaacatgggcgttatgcccctttcggtttgatgcgctcggatgggtgccacccgcactctgctcggagatcatgagaaatgtccgcgagtggtgcacggggggtttgcagcatcttctgttt

SEQ ID NO: 502248 - DNA, 104 bp, Homo sapiens
actcgtccataaaaaataaaggcatatggcatattctaacttaggaagccacaatgtactatggaccatcatgacattgggtcgcattaactagtaagtaaaga

SEQ ID NO: 502249 - DNA, 248 bp, Homo sapiens
gtcgctcaatattcatcaacaacgactaatcaccacacaacaatgactaatcacactaacctcaaaacaaataataagccatacacaacactaaaggacgaacctgatctcttatactagatatccttaatcattatatattgccacaacataacctccatcggactcactgcctcactctctttacaccaagccacccaaactatctataaaccatagccatggcacatccccattatgacgcgggc

SEQ ID NO: 502250 - DNA, 90 bp, Homo sapiens
tggagacggagtcgtgctctgactccaaggctggagtgcagtggcacgagcttggcttactgaccctgtgcctgatgggttcaagcaaga

SEQ ID NO: 502251 - DNA, 301 bp, Homo sapiens
ttcctgacgtcaggtgatctgccgcctctgcctcccaaagtgcggggattacatgcgtgagccagtgctcccggccaaaagttcatattttactaactatgacttgtcaatcagagtttagcagattactttaagtacctccaggctgaggcaggagaatcacttgaacccgggaggcagaggttgcggtgcagcccgagcatggcacctattgcactccgagcctgggcgcacaagatgtgaaactccgatctacagcaaaacggcaagcaagcaagcaagcaggaagcaggaggcaagc

SEQ ID NO: 502252 - DNA, 174 bp, Homo sapiens
cccagcgatgtcattcttactctattgcgtgctctgactctgtttgagattgttatgctactaaatttatgtgtcaactggagtttttacaactcaggtgagttttagctttactggggagggggtgatctaaaacaccctttacgccggcttctattgacttggcttatcgag

SEQ ID NO: 502253 - DNA, 337 bp, Homo sapiens
  misc_feature (166)..(166): n is a, c, g, or t
ctgtggttggtgtatggaccgcctgtactgagatatcgtgctgacaaaatcttcataataagctcttcggatacccaagaggaaatgatactttgagggttgcaccccaaccacgcacatctcccagacctgggcctccctggcgctattacctctcatatagatnaggcccaggatcatcattaacagacccaatctggggccatctcctcccagatcctcctcctcctcctcctccagaggttttagtttgttgatcaggatgtaagtttggtgcttgcggtcaaactgtttcagctcaaaaccaaagacataccgcaaatcccgaaggtcacct

SEQ ID NO: 502254 - DNA, 723 bp, Homo sapiens
gggcgtattttctgttgccttccccgtgggtggagagcctgatgcatgaggttcgtggtatcgaaccactaggactagagacgctgcctgtgagcatgtggctgtaggccgttcatccagacgactcgtgatacacacatctacttcggtctacaggttcatcaccccttgatggggcagcctcttcccctcatcacagactatgctgttcagccacatgtgagcgcgggggcagtcgaaggtgagtccatgctctcatgtcctgccgatgctgagatgggggcccgacatggcttgagccccttgaatgtcattgcggaggatgggaccatgacctccctctgcggggactggttgcagggtcttcaccgtgtttgtggcccgggaacaagataatgtctgtgctgagtgaacggggcctattcctggggtcatccagataccaacccatggtactgcccatcttgcagccgttctggggatgtgatagaatacctgctgaagaaccagttggtttgtccgctgccaggaaactgggggcccgagctgccaaggctgtggagtctgggggccctggagctcagtccctccttccaccagaagaactgccagcactggttttcccatattggggactggtgtgtctcccggcagctgtggtgggggccatcagaattccagcctacctggttgtagaggaccatgcgcagggcagaagaggac

SEQ ID NO: 502255 - DNA, 173 bp, Homo sapiens
caggacgatagaagattctcatctatcgctaatacagctccagagtcatcccatcgtggatacatagtcccccagcagacacgtggtccttaaacatcgtgtaccaattcttcaggacaatctatgttccaacgggtaccagttagggctgcaatcagcttcttacggtcccc

SEQ ID NO: 502256 - DNA, 283 bp, Homo sapiens
ggaggagagcaaggagggccagaggaggagaaggagatggagtcttagggccaggttgaggcagggttccaggccttagaggtgcttctggggcgggggaattcagcaagtttccccttccctctttccacccaagttccagccttggtcttgtcttttcatccctcttcccacgacagaggaggtgtggcctgcatgtcatcgtgttctgtgtccctgcatgtacccacctccacccttctttgcgcggacccatacataatttaataaatctgaaaaaaaa

SEQ ID NO: 502257 - DNA, 204 bp, Homo sapiens
ccaacactcactactacaacacttgcaacattacaataagtatagcgatagaattgaacctgcgcaataatatagtacccaaggaaagatgaaaatttttaccagcataatttagcaaggctaaccctttacctctgcataatgaattaactagaataactttgcaaggagagcaaagctaagaccccgaaccagcgggctcct

SEQ ID NO: 502258 - DNA, 103 bp, Homo sapiens
aaaaaaaaccttttggaagctggttaaatggacccctcaggttgacctgggtttaagccccccggtccttgtggtttaagaaaaattaaaaccaaaagggtcc

SEQ ID NO: 502259 - DNA, 1545 bp, Homo sapiens
  misc_feature (1200)..(1200): n is a, c, g, or t
gacaaaacatagctgctcagtcacaggaaagacaccaggacaggagaagaggacagtgacagaggtgaggagagtgggctagggaagttgagcggagtaacgggggcattagctggtcctcgacgcaaggagggggacagggacgggcgtgtcgctgactggagacttggtaggtcttttcctcggagggtgcgggggctcgcctcgtgcgggtgcaggcatgccctgtggggtgtcgaagtacaaacgagactctaggtccagaggcgtggtgcacgctgggcgcactcgtggttgccgcgtggggcggtgacccttgtctaccttgccctgggggaggtgccctttgttcctctgtcccactcttccgtttgtcctcatgccgcccgatggctttgccggttgtgcgctttcgtagatccatcggaagaggaggcctgggtcgattttgcctggatctccccaggggtcgttgggcccgtggagtgatgccttgggtcgcttcatgagctccatcgtggtcgacgcctgtgctcattgaccaccaagacaagggggacggtgcaccaatgcttgggccttttccgacacgccaccggggttcttcgctttggaagctatcgctcgtagtggcactcgttcctccgaagcgagaccacttaagacgctgcggccacggtttgtcttatcctcccatggggaaactcgtttggacctaggtaccagtcccgccaacgggaagggggtaacccctggtcgcaagcgtgcctcccttggtgataagccaagcaggggcggtgggttgcaaagggggtgtctgccgccctgtgtggccctgtttggttggggttgctatggccgtcttcgagctcgctccgaggacaacccttgggcagttttgtgccccttgtgctgcaagttttccgtttccttgtgggggcgggttccgccttaggttaggtgttgcgtaatttgggggcccctccgtcccttggcagggacctgtagggtaaggcactcgttgttgaacaaccgcgaggttgttaggaggagctccttggccccttaaaacaggtgggggggttgccaagggctccccaatcttatcctcggtgagagcggatagggccggaaggacccggcaaattggcaccccattggttgggaagggccctccatcggcatggggcacgcctggangtgtgcccaggctgtgttttgccccgagcaaagggtgttgccagttgccattccgttaaaggccgggcacttgtgggctgccatggggttgtacttgtgcgaaaaacgtggtttggtttgaccacgggaagatactggtcgcactgtgtgggtcccttggaaaaggaaaatcacccttgttagatgagcccctttggaaaccgcagggtccctgtggtttgtcgttgtaacgagggcggaacattgtgtgtgtgaaacacaaacccacccagggacgggttgtgatgtcccaaagagcgaatccacaggcaaatattgtctgttaagtgagaagtggcccacacc

SEQ ID NO: 502260 - DNA, 1632 bp, Homo sapiens
  misc_feature (1465)..(1465): n is a, c, g, or t
ggactgattagaagcacgatttactagagtcgacttcttctcctatttcgctcgcttagcagatcataccgcgcagtctgcatctaacacggtaactagctgttaataagaggttgctgtatcgttcctgtaccctcgtcagctgcagtggtaagacgactatgcagcggcaggatgaggctgagttcttgttacacagtgagattagctgtcactcttgctgactgcatcgagccctttgacgagcgtggagcagattcctagctataaggcctgacaaatatttcaaggacgactactacgcttccacaagtcgcacttccagctatatccacaagggagagtaggcgataccgctgggatgcggactgggcacacaatgatgggcacacaagtacccatgacattcacctcctatgcgtatttcgcgccattggctcgaaaataagaccgataactatccatcagcatagcgcttgatagttctgctggagaatacacagccgtggtgcatgcttgtgactcgaattcgcgcgcgcgatgggccttctggataggtcaagcaagtgacttgcgaagctgtcgcggagaaatccacttaaactaggcaactcaggcctactcgagttagacaggggattggaggcacccagagagttcgcgagccttcctcgttgatatccgccacagggcaaataacgggcatgtagagtcaagcagtagctctcagttggagcgggcgccacaagagaaacatgtctgtgaacaacagcaagtacccgtcccagtagaagtccacatgcacacacccaggaggaaaatggaacctcataggcggcaggcgaagaaagcaggaggagctaggagcagcaaatcgtaggccccataagaattgccgacggacaggtcccacggtgaccataggggacacacaccttgaggcgccccacgcggaggaactcccgaagtgcaataggaccaatggcagatgaggccgcagagaagctgcgccatcacacccgtacttgaaagtcgtggaaacgagagcgcgcaggaagaccgcaagggcagagagaatgcaccggtggggacccaagaagccaatgggaccgaatacacagggagagataaagaccccaggtgctggaaaggagccgaagagacaacgacagggcagcggaaggccaacagtggcgaacaccagagcatgaaaaagaaagggaaacaagaagttaagggagagctaagaggcaaaccaaacacgaacagacaagccgaagacaactaacgaccagaccaaacagcaaaaaacggggccaaaacaagcagtggtcgaggattgcatgtagggatagataggggggatgatgacctgcacgcgctgctctctgtgggaacagcagaacagacaggaaaaagcgagcgactgagtagaggtgggcttgtgcgcgtcagcagggcgtgncatatggatgtatcttagatacgactgtgaactcatactagcgcacgagtcgtaactgaccgcagcggcctggaatgcgctgcagcgtgctgcttccatggtggcctgcgcgtaccatggatgctgcagtcgacgatgatagaagtaggagacagtgagtatgaatg

SEQ ID NO: 502261 - DNA, 517 bp, Homo sapiens
gctctcgccaggcgtcctcgtggaagtgacatcgtctttaaaccctgcgtggcaatccctgacgcaccgccgtgatgcccagggaacgacacgggcgacctggaagtccaactacttccttaacgatcatccaactattgggatgattatccgaacatgtttcattgtgggacgcagacaactgtgggcctccaacgccagatgccagcaagatccgcaatgtccctttcgctgggcaagcgcctgtgcgtgcctgcatggcgcaaagaacacccatgatgcctgcaaggcccatccgaggcgcacctggttacaaaccaacccaagctctggacgacaactgctgcctcatatccggggcacatgtggccctctggtgttcaccacaggaggacctcactgagcatcagggacattgttgctgggccaactaaggtgccagcatgctgcacacgtgactgggttgcccattgccaccatgttcaccgtcacactgttgcccaggcccaatgaaaca

SEQ ID NO: 502262 - DNA, 642 bp, Homo sapiens
agcggggggacctggctgggcgccgggacgggaggagtcccggcggtcgcctcggactttgctcccacaagtcctgcctcggaggcgggggagctggatccagcagccgcctggagcgtccgagtcaccgtcgccggggctcccgtgctccccagaacggtgggacgcggggctcggcgagccgccagcggaacatggcgccctggacgctgtggctgctgctggcagacgcgtcgtgggctgggtgccggtgctcttcatcaccttcgtggtcgtctggtcctactacgcgtacgtggtggagctctgcgtgtttactatttgttggacaatgaagaccacatggaaagaccgttgttgtacctgtgtggctttgccatctgtgcttggtgatgtctgtatggtcctatggatgacaattttcacatctcccgcttccccctccagagagttctactgtgtccaattctgaaaaggaacgttatgaaccagaattcaggcaagaaagacaacaagaacattgggacgaagagcagcaagagctttacctatctataccacatcagcttcgaaaagcctcatgcagtctacaaaatagaaaggagctccaatgagctggacaggggaagtcggttagcaaag

SEQ ID NO: 502263 - DNA, 540 bp, Homo sapiens
aggcgtaatcgaagaaggaagctctctgcccctcctaagctggagcccatagcgaaggcttttaaggcccagaaggccagtgttgaaaggggtcccccagccccccaaaagaagaagatcccgcacgtctaccccaccttccggcggccgaagaccactgcgactccggagacagccccaatatcctcggaagagcgctccccggagaaaccagcttgacccactatgcgtatcatcaagtttccgctgacccctgagtctgcccatgaagaagatagaagaccaaccaacacacttgtgttcattgtggatgtttaagccccaccagcacccagattaaaccaggctgtgaagaaactgtatgaccattgatgtggcccaggtccaccaccctgattcggcctgatggagagaagaaggcatatgttcgactggctcctgattacgatgctttggatgttgcccaccaaattggggtcatctaaactgagtcccgctgcctaattctgaaaaaaaaaaaatatatcttttccacccatt

SEQ ID NO: 502264 - DNA, 255 bp, Homo sapiens
gagcaaagtttttggctttttgctttttttttttagacttagccttgctttgccacccagcctggagggcaggggcgagatcttggttaactacagcctccgcctcccgggttcaagcgattcttgggcctcagtcttctgagtagctggaattacagacatgcaccaccacacctggctaatttttctgtttttttatagaattgggggcccaactttgggccccagccttggggcacagggcccaatttaagt

SEQ ID NO: 502265 - DNA, 295 bp, Homo sapiens
agcgcttctccgctaggtctcttcatctaggtcagtgtttcttattattgagttcctgcattgagggcatatggaagagcgatttatcggtggaatgtcattatctctttttgcgctctccaacgcctggttatacatgctaaccaacttgaccccacgcttaaacggtgtgttagcctgtggatcgctcgcaaacttgtagtcgataaggtcggttactaatttagttagttttctgtatgctccaccgaacgtaacctgatcgctgtctaacaaatcgtcttttatgtcgttg

SEQ ID NO: 502266 - DNA, 1117 bp, Homo sapiens
  misc_feature (317)..(317): n is a, c, g, or t
  misc_feature (373)..(373): n is a, c, g, or t
  misc_feature (448)..(448): n is a, c, g, or t
agcggggtagtggcgatctggagcggaagtggagctaccgccaccgccgccgccgattcctggagccggggtagtctgccgccgccgccgcgctgcagccactgcaggcaccgtgccgccgcctgagtagtgggcttaggaaggaagacggtcatctcgctcggaggcttcgctccggacagggtcctttggttccactgtcatgccgctccccactgtggaaattgacgaactgggactacacacatcgtgacgcttgtgtacaagcaaatgccaaagactcggctgaagccagtggcgcttgaggcggactactngactgcatcacttgcggcttgcatgccccattgacatgcgtcatgctccatcacgnacaccaccgggtgccagctgatagctccatcccaagctgagacgacgacgaaacatgcgtggtctccatcgtgtnttgcgcctaccaaaggacattgttgcgtacgggctgccccgcacggcttccttccctgggctgttgtcactcttcccagccattgacgcgaggacaacagagagggaatgacgaagaacgcaagcagaatgggcaaagaagtaccgtgacgaacgatacgaggcagaactgcaggacatcttgcaatgatgttctggagctgttggacaaatatcttattcccaatgcttacacaaacagaacagtccggtgttctacttgaaactgaccatggagattatttacgggtatctttctgaagtggcatctggacgacaacgataacaaaaccacctgtgttcgaactcccagcagggcttacccaggaacgcatttgcagattagtaccgaaagacactgccggcttacaccacccaatttcggctgggcctggccactacattttctcagtcttctactatgagactcctacactcctcctgcaaagggcccttgtagccctgggcacaaacgggccattttgattgacgcaattgctgactttggcatacgcttaattgcacaagtcttctaaagcacagcacccggctctgccgctacttagggccaactcaatctggggccatgccaaaaccgtggaaacaaggaaacctctggagtgaaacacaa

SEQ ID NO: 502267 - DNA, 256 bp, Homo sapiens
tcacgctctaatacaaaacaagggtaaatgtcatcatatcctatttttacggcctcttgctgggagagacggtgggggtgggaggtagtgttatacacatggcactttcaatttgtttattggaactcagcacatttaggggcagttggatgaaattgcaaatatagaaggggcataagcaatttactagtgctatctacacgaaatgatgatggagacggaaagccttgctttcctctttttagaatttattttc

SEQ ID NO: 502268 - DNA, 609 bp, Homo sapiens
gcaccaaagtttgaagaactactacgaacaatggggaaagcttacagactgtgtggtatctgagggatcctgcaagcaaatcgatcaagaggattggttcttgtaactttctcatccatggctgaggttgatgctgccatgggtgcgagacctcacttcaattgatgggagagtagttaagccaaaacgtgctgtagcaagagaggaatctggaccaccaggggctcatgtacctgtgacaaagctgtgagttcggcgggaattaaagaagatactgaggaacatcaccttagagattactttgaggaatatggactaattcgataccattgagataattcactgatagcgcagtctggagagaaaagaggctatggttcggttactttccgatgaccatgatcctgtggataaaatcgtattgcagaacataccataccatcaatggtcctaatgcaaaagtgggaaaggctttgtctagacaagaaatgcaggaagttcagagttctaggagtggaagaggaggcaactttggctttggggattcacgtggtggcggtaaaagctaagcttttaccgcacaacagaaagatattggaacggatggtg

SEQ ID NO: 502269 - DNA, 120 bp, Homo sapiens
ttcccagaaaaggggaggagagaatgcaagatgcacagagagaacaggagaacccacactcagggtggaaaggaagagaggaggaaagcgggcagagaaggaggagagcgcctgcagctg

SEQ ID NO: 502270 - DNA, 632 bp, Homo sapiens
tggaggcgcaatggccacctgaggacttcctggggctcttcctcgggctactccttctgaggacgagtacgttgggctactcggatgtgtgaccagcagagttccagctcgcggctccgaatctgccgtctcacggcgcgggctccttactctggatggtggccactttcgcctaggcctggcgtcttcagacttctctactgtgtgggctggcaccgacctggtaccgcctgaccacagctgccgtccctccattgacggtcttcgttttagccaggcgcttctcgtccctgaagagcgttcctctggttcctgctgccgactgcgtcttgcttgacgtgcctgacgtatggtgcttggtatttctagccctatgggctgcagactgttccaccctgctttggtttcctggtgggcagcgaagtgacagtcagtgaggcctgtgatgaggggctggtgaagcccagagactcagtcgccacgatttccgaggcttgatcagcgtgtaatgtcccgggtacacgtctctggagcggcgtctggaagctcttgctgctgaattttcctcccacttggcagaaggaggccatgctgctggcacgtcttggagctgcggcccaggggctcctggg

SEQ ID NO: 502271 - DNA, 1115 bp, Homo sapiens
gtggcgcgcaggaggaagtgcgccgctgcgggaccctggaggaccgtatccccagtcccatcgtgggctacgcaggctattccaatcaagttctctgaaaagcaacaggcttctcagctacctctatgtgatgagcacacggcgttcggacgatagggcaccgaagtcgcgacctggcctcagaagaggactcttctttggtccatcgaagtgttggcacgccgcgatagctgcagcagtaggagagcgctgttcccgcgctcactgatcacacctgtgtgcctcagtccagtctgtcacagttgcaggagaagccggagcctggcctggagaggcccacaaggacgtcaaggctcgaagttctcttgtgtcatccaaatgccatgctatccgggttctccaggtagccatacgttgggtggttccatgaacgaccaagtggggtgtcagccgtggcctgtgggccctgcaagggtcacccgcgtgtcgtggtgtccacagaaggagccatctcctgtgagagtagtgtgcagttcagcaagctggagtcagtgagcatacgacagagctctgttgctcacgagcgcgctgaggccacctgagagtgtaggcaaagttgagacgacggttcctatcgtggacggcgattattgcacgcgagtagaagattcagcctcggacgtgcacatggaaagcctccaaagtggccgagaggggacgggcatgtgcacgtgggcgtgtccccggtggacagcaagggcacgggggcttggcgtccgcatagcgttgacccgccgcgcgggggcgacccccggactgggacacccttggtgacaattccccgcgcgccgggtaaacagaggaagaggccacagacacataaaggccgattaggcacgggggattgccatgggaacgccatgggggaacggcaatgcaacaggcggaaagacgcacagccactaaaggtacgccagtaaaacatacaggaacggccatgggcacttaccaaacacccttatcataaacacgggcacccgtcgcggaccaagagacgagctccgaagagggcaaccgcacgcgccaccacaagcaatgggggaggcgcgaatact

SEQ ID NO: 502272 - DNA, 295 bp, Homo sapiens
ctgaagcctgggggatggatgccctggttgctgaagagcgaggcggacacgccaaggggaatgaagtgaggccagtggccgggtctgctgacgtccgcaccactcagactacttgcacctctgcagcacgtgcacgcccacttgtcacccctccagaacatcctccccattgagttctggcgcgtattgactcttcagagttcagcagtctgattctcctgtttgggtcctgctggcacaatcttggcacccaggtgcttcagtacgtcctggtgtaccgaggctcgaacttcgt

SEQ ID NO: 502273 - DNA, 842 bp, Homo sapiens
  misc_feature (224)..(224): n is a, c, g, or t
  misc_feature (303)..(303): n is a, c, g, or t
  misc_feature (330)..(330): n is a, c, g, or t
  misc_feature (334)..(335): n is a, c, g, or t
  misc_feature (339)..(343): n is a, c, g, or t
  misc_feature (345)..(346): n is a, c, g, or t
  misc_feature (351)..(351): n is a, c, g, or t
  misc_feature (362)..(362): n is a, c, g, or t
  misc_feature (367)..(367): n is a, c, g, or t
  misc_feature (370)..(371): n is a, c, g, or t
  misc_feature (374)..(374): n is a, c, g, or t
  misc_feature (381)..(381): n is a, c, g, or t
  misc_feature (408)..(409): n is a, c, g, or t
  misc_feature (418)..(418): n is a, c, g, or t
  misc_feature (423)..(423): n is a, c, g, or t
  misc_feature (432)..(432): n is a, c, g, or t
  misc_feature (438)..(439): n is a, c, g, or t
  misc_feature (441)..(446): n is a, c, g, or t
  misc_feature (504)..(504): n is a, c, g, or t
  misc_feature (516)..(516): n is a, c, g, or t
  misc_feature (524)..(526): n is a, c, g, or t
  misc_feature (531)..(531): n is a, c, g, or t
  misc_feature (535)..(535): n is a, c, g, or t
  misc_feature (539)..(539): n is a, c, g, or t
  misc_feature (541)..(541): n is a, c, g, or t
  misc_feature (543)..(543): n is a, c, g, or t
  misc_feature (545)..(545): n is a, c, g, or t
  misc_feature (548)..(549): n is a, c, g, or t
  misc_feature (562)..(563): n is a, c, g, or t
  misc_feature (565)..(568): n is a, c, g, or t
  misc_feature (579)..(579): n is a, c, g, or t
  misc_feature (594)..(594): n is a, c, g, or t
  misc_feature (605)..(605): n is a, c, g, or t
  misc_feature (626)..(626): n is a, c, g, or t
  misc_feature (646)..(646): n is a, c, g, or t
  misc_feature (655)..(655): n is a, c, g, or t
  misc_feature (665)..(665): n is a, c, g, or t
  misc_feature (676)..(676): n is a, c, g, or t
  misc_feature (699)..(699): n is a, c, g, or t
  misc_feature (702)..(702): n is a, c, g, or t
  misc_feature (744)..(744): n is a, c, g, or t
  misc_feature (758)..(758): n is a, c, g, or t
  misc_feature (768)..(768): n is a, c, g, or t
  misc_feature (809)..(809): n is a, c, g, or t
tacaacatatacattgttttcagttctttacattgaatctcaaagacaaactttttttataggttaccacagaacaaaagctgtgactcatgtttttatttcataaactattataagttaaagtgaatagatttttttaatattccttgtagcattttacaagtgcaacagaaaacttgaagaaccaaattaagatagctgtagttcattagataaatgtggcntgtggtcatcacgttgttcacagcaaatttttgaaaaaataagcaccaatcattcttgcaaagaacaattttatctaanagggttgagaagggttaaatgcgaggntttnnattnnnnngnnaggcnatagatgggcngtgtnggnnctnatcccanacactgctaccctcgtacatataatgnnctgaaaagngagcngtcacgtangtggtnntnnnnnntttttttaagaaaccaattctgacccccaactcaatggttttgtgatattacacaaangccactaaacantaccaccnnngccanccanacantntnanacnnatcaaaactcccnntnnnnaaacatctagnaaataaatcaaaaanccaaagatcantgctggtgatattagcatacnagaaacccttaatatgctgntactatganttgttttaanctactgtttantcacatattaaagagccagctgntgntcttacagttaaaaaaactgtgtagccacattactgttttcnacgtcctgtgtggnaagttgctancactgtacaattttgcttgagcctttattttacaacagggntttacctctaactcagaattgcacgtaagaagg

SEQ ID NO: 502274 - DNA, 267 bp, Homo sapiens
  misc_feature (3)..(3): n is a, c, g, or t
  misc_feature (11)..(11): n is a, c, g, or t
  misc_feature (45)..(45): n is a, c, g, or t
  misc_feature (126)..(126): n is a, c, g, or t
  misc_feature (138)..(138): n is a, c, g, or t
  misc_feature (167)..(167): n is a, c, g, or t
  misc_feature (263)..(264): n is a, c, g, or t
gantcggcatnggacttgtccaaaaaaattctaatcaaaagaggnaaattttggaatatgccaggaatagtggaattttattttttaaatttttttataggcccatatgctctatctcaagaaacnagatgttgtaanatgtccatgattaaacttattgggcagantatttctgtggttaatctctgtagttctatgaggttctcttgtttctgtttctgcttgcctttttacgtttttccttgtcctttccgtgttcttgnntgt

SEQ ID NO: 502275 - DNA, 292 bp, Homo sapiens
catccagtgctgcctgtatctgtgcctggtcagttctgtctgttgccaaaaatgcggttactccctgtctaactgtttacaacgtcttgctgtagatgcctgatgcagctcaaatgctggtataacaaaatgtgcacctgtgcatataatttgagcgatagattgtctgcgcgtgcgagtgcctgtactgcctgctgcctgaaagttgtgttgttccctgtgctgctgatacactccgctgcagtgtaatgacacggttttttgcggaactggttgagaaaggcgtgatcac

SEQ ID NO: 502276 - DNA, 118 bp, Homo sapiens
tgatggccaggtgttaatacagagggctcttacaactactggggtcttgacattcatccatatcaaagcactgcagtttcacaggatcatagtacgtcccttgcttacagtagcattc

SEQ ID NO: 502277 - DNA, 435 bp, Homo sapiens
  misc_feature (327)..(328): n is a, c, g, or t
  misc_feature (408)..(408): n is a, c, g, or t
  misc_feature (426)..(426): n is a, c, g, or t
tcatctccagtaaactgtaaacaggactactgcatgtactctgttgggaatggaaggccagaactccataccgtggatggatgggtacttaggaaacaactcagcatttgtagtcagaccacttgtaacttagtggtttgttgagtaaccattttgcaggaaatacttccatttaaaaacataaaagattaatgttccaattatttgtatcaatcaggaccatttttgtggggcacttgggaactatttgtttttcaaacagacatttgcaagactgaacataatagataaatcagttacctctgaaaatgtgaaagaaaggaaaannaaaagaaccaggtggtcaaacttaaattgacatcatcttgttaaagcatatttaatttcactaagagaaatttaatatcngagacttttatatactcnattacctag

SEQ ID NO: 502278 - DNA, 398 bp, Homo sapiens
cgcttaatgttaaagatgacgaaacagtcacctttagcgtttagagttctgatcaaacaaatctaaaagttaacgcacaaaattatattatcaatgttcccatcaaacaataaagaacaaaattaaacacaggtgcattgtcttaaataaataatccttggatgagacctcttaacagtgaccttcatttgacactgaaaatacaggatctcatcttttgctttatttctaaattttgaaagttaatttttcttaatactttttttcacctgttcttgtttgttatgatcatggtccctattatcttttgactgttaaaatcctctcttctgatgtgtcttttatttttttatgtcttttataatagaaaaaaatattttataaagaaagaagatgtc

SEQ ID NO: 502279 - DNA, 818 bp, Homo sapiens
aacataactgactccatcttgctttctaatctcacaagctaacttgcctttgctcaggtggcataggccaagctaactatgggaggaatttagttcatagtttagagtaaggatgggccaggcatggtggcttacacctctaatacctttgggagaccgaggcaggtgaatcacctgaggtcaggagttcgagatcggcctggtcagcatgacgaaaccctgtctctactgaaaaaaaataaaaattggctggcgtggtggcgggcacctgtggtcccggctgctcgggaggctgaggcaggagaatcgctttaacccgggatgtggcaggttgcagtgagccgttattgtgccattgtactccagcctgggtgacaagagcgaaactccatctcaaaacaaaaataagatgaatacacaataagaagaatataagtaaggatgataatagtgtcttcccaaaactactccactcccttgagagcaaagccacgctttgtaacatctatcgatagaccagaaggttagcatgcatggtaggggctggatcatcgatcgacaagagagggagtccgggcaccggacacccagggctggagttgccacgggtgccaagctatcagccgcaagtggcgagtcgtctgacccctgggggatacacagcgggcatccccgtgccgtaagcccgcaggaataggcatggggatctgaagcggcccggcgaacacagagcccgggaatcttaacagcaccgatatacaaagacaacggcgccacaacactgtggagcaactggaacacaggaacaccagagtagg

SEQ ID NO: 502280 - DNA, 282 bp, Homo sapiens
agggggggggtaaaccgggggggtttttgcccccttttccggggggaccccggggtttttgcccccccccccccccaaagggccctttcccagggggttggggggcctggggggcggggcccggggggggcccgcccgtttttggggggcccccgggggggggggtgggaaggggcccggcccctggggccccccccccccgggtttccttttttcccccgtttttttggccccccggtttttcccaaaagggggttttttttccccctttccccccttcca

SEQ ID NO: 502281 - DNA, 528 bp, Homo sapiens
  misc_feature (4)..(4): n is a, c, g, or t
  misc_feature (33)..(33): n is a, c, g, or t
  misc_feature (51)..(51): n is a, c, g, or t
  misc_feature (96)..(96): n is a, c, g, or t
  misc_feature (117)..(117): n is a, c, g, or t
  misc_feature (287)..(287): n is a, c, g, or t
  misc_feature (338)..(338): n is a, c, g, or t
  misc_feature (342)..(342): n is a, c, g, or t
  misc_feature (350)..(350): n is a, c, g, or t
  misc_feature (365)..(365): n is a, c, g, or t
  misc_feature (377)..(377): n is a, c, g, or t
  misc_feature (405)..(405): n is a, c, g, or t
  misc_feature (523)..(524): n is a, c, g, or t
tggnggtgttgaaaaaaggggtttaaaaccccngagaccctaacctaaaanacctcccctgaccccgcctgttgccccgttccatttttgtgcccnaaggaaagtagcctgcccccnagtgtaatgtccttgcccttctcccgccgtccattgttggaaagaggagagatgccatccgaagcagtccccagcctgccttttcatttattacctccttcctttcccaggaccgacagaagtccagggaggagtcccctgggttatgtcccaaacttagcacctgcaantgttgggatgtggatggatgtgtgcataagagagagagagaatatgtgtgntagntgtcgtcncgagcgacacacatnacaagtgcgaangagttgcggttgctccatgttctgactnagggcaatttgattctgcacttggggtctgtctgtacagttactcatgtcattgtaatgatttcactcctaactgtgacatttttatcaaatgtgtgaataaatacataaagattggnnaaaa

SEQ ID NO: 502282 - DNA, 1033 bp, Homo sapiens
actagtgctaggaatttaccagtctcagttctaggcatactatgtatatcgctcacagctcatatcctccctactatgcctagaaggaataatactatggcagctgtgcagtaatagcgtactctcataaccgctcaagcgacccactcccgtgcttagccaatattgtgcgctattgccatactagtcgttgccgcctgcgaatcggcggtgggcgtaggcctactagtcatgaagctccatcacatattggcctagactacgtacatggaccttattaccctagctccggaatgctggaaagctaaatcggcccaacaattagattgacgtaccgactggcgtgactttccaggatggaccacataagtttgaatcaacacaaagcgcagtcccacgaggctaattattaggcgatcgagccctctactatctctgaaccaaatcaggcaagaagcctatttgggcgtgatgtccccatactcgtttgtacgtccgacgtaccgcatgagagaatgccgcgcatcacgtagaatacgtagacgtactctggaacttgctaacaccatcgacaaatcatgtgcatggcggagggtccagagtagatgcagggaacagactatcacgaaaaaaactcgtctacctctctatggtaagtctgccctgcaatgtctccttgattgatcgacattgggcttgcaccgaaactgaatcatattgttactatcttgctttcgaataccgaagcgatatacccatcgtgggttattatcagccgatagatggctaacagtcatgaccggatgagcgtaggccgtacttcatatttacatgctaagaaagctgcgtcccttactcatggactacctgaaatgaacacgcctgggtcgactgagatttatcggtccctctggcgccgagacctaaatcctgacacacacttacgggagggataccgcgggttagtaggaacgtggaacactgaaacaaaattggccccctggatatgccggccaaaagggttacaagaaca

SEQ ID NO: 502283 - DNA, 121 bp, Homo sapiens
acgtcagatgtaacatccggttcagggtgctgagtgaggttagtgggagtgggcaatcggtactcttggaggaagaaaaactgtccttccttctccaaaaaaaggaaaaattataataata

SEQ ID NO: 502284 - DNA, 630 bp, Homo sapiens
ggtattggatctagagagagagagttattatcatagagtgcgcttgcaagagacgatatgcatgcgaaagctcgaagcaacgcatgtacttctatgacttgcaccttaagacattacattactgatgatatgatactcaaaacgcgacataacaatgactatatgcggctatcatagaactaagaggagaaattcttctctatactcaaactgaagcaagtcagacgtcacattacttattgtgaagtctaacactgaatgcctgatattaatacatgcaaggctgtataacaagaccagatagaactatagggatctcactcacatgttaaagaaacattatgcagtgttgtgccataccagtgagatcatagataaggttgctggtctagttatcacactgtgagaacagtcaggagcatatgtcattcacatactgtaggaatgagactggacataatgcactatccacaggccagatgagtctgttacgagtttgtgtgaggtactctatacactgtgacacattcagtgtctaatgctagacgttatgaccaatactgatcagtgtgtgtgacgtgccaaggattaccaagtcccaagtggaccacttgataagccacctgttat

SEQ ID NO: 502285 - DNA, 857 bp, Homo sapiens
  misc_feature (327)..(327): n is a, c, g, or t
aagtgtacgctcgctatacgggatgctgcatggctactggacacattactcgacttgtggttgctcctttcacatacgggtggcgtgatgtctgactggtcaagatcatcacagagccttcacgaagctcatcatacagctggacgagtctgtgataaccagcattgcactggtgatgagtcctgagaaccacagtctcatccagatctggtggcacccagactccttacaggaaaatctggaagggagagaaatcacacactttgatcttcgcaaaaaggaggcctggagacagtctgttcctcactgccctgagctccctgcggncacctaatgcagcttcgggagatctcaaacagcaggctccacgtcctcacttgaagtcatcctcacccagttcacctctggggagggcggccttgggactttctctacggctgcaggtgacacttgtccagctggtttctcttcctcactctaacagaaatgctttcttaaaagcttctgcaggggaggggctcatttctcggcttggagagtaagctggtggggtgggacccaagctctcacttttaatcccctttcttgggagaagacggcccgaaggaggtgttgactcaccacacaggcagtgggatgtgcgttggtcctttgcacaaagttgtgaacagtgcgtcctgggtctatctggcccaaaagaaagggcgccaagaagtgttcaccgtggtcgctttccaactgtttccccttgaaggcaacatttaaccatgctttggacttgaacaggccggaaaacagctccagggaaggtatgcacccggcagaagaagggaaagtcaagggctacaaatggggag

SEQ ID NO: 502286 - DNA, 622 bp, Homo sapiens
tggggaaatcaaaaattttttttttccccccaaaaaaaaacccaaaatttccggggaaaaaaaaaaaaaaaaccaaccccaatccccccagggggtttttaaccaaaaaaaaggggccccccttttttaaaaggagcatttttaccatataaaaaagttgctatcacaacttacatagatagtgtggtttcccccctgtgtagtaacaaattttctcccctcccccacatgaggagggccccactaaaacacgcgtagatcacgacgtctgtatcattacacagcgagagtaataatacacctcagcaccgcctctgtactcaaaaagtagaaactctgctattcaatgaagtgggaacaacaacacacggaggagtgtcgccccccgagggggagtggtgaagacgacgataacacatcacctctctctctcgaagaagaaacaggcgatcttgagctaggatctgcgccccccaaattaagaaaagaacacaacacctgtgttgtcaccagggggtgcaccgaggaaagtacttgggaccaccccgtgtagttagcgcggcgcagagttctaccgacacccaccaatggagagagggagaagtcctggggaaacacgagt

SEQ ID NO: 502287 - DNA, 300 bp, Homo sapiens
gtgtcaggctgcctccgtttttgggtactgtgttgtgttttgctctgtctaaaaacatctgcatagttttcaactggaaaaggaaaaaacttaaaaatgggatgtcctaaaatgaagctgctcaagtcacagaacaccgagggccaaggagatggatgactgggagcgctggcccggaacagccctgcaactgtggggcctgcacacagccctccacagtgggcactgcagggcaggcccaacccttaagataacaggagtcagctctccacttttacagttggcaaacagcctccggga

SEQ ID NO: 502288 - DNA, 243 bp, Homo sapiens
aactgttttggatgatctgaggtgtggagttttagacccccctgtgcaacacggggaaactctgtgtctactataaacacacaaaaactatccgggcgtgtggggtgtggggagattccttgtattccacctacttgggagggtgaggccggaaaaccgcctgaacccaagagggggaggccggaacgagccaaaattgcacctttggacttcagcccgggaaacaaaaaaaaactttgtctg

SEQ ID NO: 502289 - DNA, 355 bp, Homo sapiens
  misc_feature (5)..(5): n is a, c, g, or t
ggtantaacaactggttaaaacagctttagataagaataatgccctggcaggcttgtaaggctgcctgatgacttcttagaacttggtgttaagaagcgagtagcttatgagatggagtcttgcctgttgccaggctggagtacagtgagagaatctcggctcactgcagcctccacctcctgggttcaagcgaacctcctgccttttaatcctgagcagctgggattacgggcgcataccaccaaatctggctaattattataatttttagtagagctggggtttagccatgttggccaggttggtctcaaactcctgaccctcacagtgagaatgtgatagccggggtaccga

SEQ ID NO: 502290 - DNA, 123 bp, Homo sapiens
ggtatttctctgctgattcttctagactccacattcagtctcgcggagttgctggcaggctgtatcggagggggacgctgaaggctggtggctgacagggcgccacggcactgcgtacttctc

SEQ ID NO: 502291 - DNA, 553 bp, Homo sapiens
gtgctcaacataattaatcatcaaggaaatgcatataaaaaccactcgaagtactacctctcaccagttaggctagctgttatcaaaaaaaacaaaagacaacaaatgtgtgatggtgtggaataaaaggaactctgtgcactgtggtgggaatgtagatggtacagccattatggaaaacagaatggaagtttctaaagaaaaataaaactaccatacgatccagcaatccctcttctgggcatatactcaaagtaaatgaaatcaccaccttgtaaatatatctgcagtccgtgttcattgcagcattattcatagtagccaacatggagacaactgaagtgtccgttgacagatgaataaagaaactgtgtatatatatgcctacacacaatggaatattattcatccctaaaaaaaaaaaaaccaggatttctggccattggctacaacttggaatgggcctgaaaggacacggtgctaaatgaaataagcagacgaaaaaaagatccgtgttaaatttcacaatattttgtgggaatcctagcaaaac

SEQ ID NO: 502292 - DNA, 307 bp, Homo sapiens
  misc_feature (42)..(42): n is a, c, g, or t
  misc_feature (72)..(72): n is a, c, g, or t
catttccctcaactaccactttttcaatctcatttccttctntacaactaatttttctacatcaacttttcnttacctcattcccacattcctccaattattaataccccttaccaccatccccatcaatatcacaacattaatatatataccctcacttctttttattcccttccacactcattcccccaccacacttaatctcccctcctcacattttccatttatacccctttaatattttattttcctatttatcctcaccttttcatttaccatcaataaattacccttttctcaaaaaaaa

SEQ ID NO: 502293 - DNA, 265 bp, Homo sapiens
ggcgtgactgcacgagcggacgtcttcgagagaagaggtcggacgcgagaggctcaactatggtcacaccttggcccacgctattgaggcccacaagcatttcacgtggcgtcatggcgaggctgacgcggtgggcatggtgtttgcggccgaactgtcgcaccggtacctgggactgtccgatgaggtcgttgcgcgcacccgcactatcctgtctgagatcggattgcctgttacctgtgacgagattaagtgggcagatccg

SEQ ID NO: 502294 - DNA, 421 bp, Homo sapiens
taatcccagcactttgtggaggctgacacaggcagacaatgaggtcaggagatcaagactatctgtgctaacacagtgaaacccctgtctctactaaaaatacaaaaaactagcagggcatgtgttggcggtgcaggtactttggccagtctgaaacacgtgacgaattggtgtgcaaccgtggcgacggcggaagctttgcacgttgatgccaactgcactccaggccttgtggcgccacatggcgagaactctggtcttctaccgcattacccatttaaccaataccacgtaacaacttcaacaccaaaacttaacacacactacccacacaaggtaaccccaaaggcgcaacgccaagacacttttgtcacccacaactactttggttaccctcccattcccaaaaaattaacccata

SEQ ID NO: 502295 - DNA, 117 bp, Homo sapiens
tccgtgaatgcagcctgctgaggctgagaagagggctggggctgtctgcggcgtggtttgctgttggccagttggagtcgttggagtggcaggagtggcggaagggaggccctgttg

SEQ ID NO: 502296 - DNA, 167 bp, Homo sapiens
actcgacatgatcgcttctggggcctcagggggctcatgtccatatccatcgagtcttccatcgggtggcggcacgcacttgtggttggagagaaggcggacggagattatcgaccgctgctccagataaccaccgcggtggtcccgatctcgattccgtaatcgtg

SEQ ID NO: 502297 - DNA, 169 bp, Homo sapiens
  misc_feature (20)..(20): n is a, c, g, or t
tatacgaatcgagctggtancccctgactaggccgacagcagagtccaggcgtctgtgtcagctcccagccctggctgcctgcctgagccatctgggctgtccacggtggagagtgtggtgcttgtgactgctggtgtgtgctggtaaaaaagtaagaacaaaaaaatg

SEQ ID NO: 502298 - DNA, 163 bp, Homo sapiens
atccatgtcttgtcatagatgtagtccgggggcacagaaaacagtagatgcctccgtacatcagatcaatggccaggttgtgccggcttcgccttcgcatgctcgtgaatatgcttctgtgtgaaacagccgaagaagacacagcagcaccaggaattcgccg

SEQ ID NO: 502299 - DNA, 523 bp, Homo sapiens
aatagagggacatacagtgcatccactggtgcctgcagcgtatggtgtcaatacactgatgttaatacgaaggtacagactgctcggactattaaaagcaccaaaataaaactagttcacagatagcaagacttcatttcaggagtcggtagtgggaagtacgaagtgtttaatcccaagttttggtgccctaaaatggctagtagtatagttaattctcaattctctagctgtgatcttctgtgccttctatctcttcctaaggaaaaccacattagatgaacccagggctcagtcattttagggagagggttgagacaacactgccagcaacacagctggaatcacccgagtcgggaacattaaagttcctgagagaatatgaaacatctatcaacataatatttctccctacttttacagtaaaatattggaagtaaataaatatagggaatgcaacagctggctaggagtgttttacattcagttgtttggaagcataacacattcagctcctttgaat

SEQ ID NO: 502300 - DNA, 438 bp, Homo sapiens
  misc_feature (438)..(438): n is a, c, g, or t
tgaacttttaattccaaggtagcattctatcttaacacataactttaggtgaatatttgttatgcaagaagtacactaaaattatctgcagtgtaaaatgatagataaaagttgtgtatggtacctaagcatttagatgatggcattttctctctgttgagtttgttaatgttcacaaaagcaaacactgtgattaaggttaatgttttaatttttattactgttctctttcacctacttttaccctccaaaacatatattttaaaataatataggaatgggcattatgtcctgttttaaatctatttctatttatttctttacattcatttaatttttttttaattttttaagaaaaattaatccaaattttgagcaagttttagctcttaatatttgaagccatccatctacctggattctttgccttttatgctn

SEQ ID NO: 502301 - DNA, 512 bp, Homo sapiens
cagagcaccgttgcatatatatgagacggggcccgttaagtcctctcctctccccctacttcttctcctccggggcttactcagtgattccaggggcaaagggtcccatgagccacgtgacaggtgtgttcttgggccacatatatccaccatgtggtccagggcctcgcgggcgttggcgacactgctcacggctctgggccagaatgcttgctggacaggtcctgcaaagagttggatgctggaaaacggtggctggagggtcctcccacctggcggcggggccttgttgcacctggttcccttcacattggtggggaggccctgaattgctggacccccaggggaggtacaggtgtgcttgcagttgttgggcatttgtcccggaacatgggtgggcgcccgggactcgacctgttcttgggttgggcggctccttctctgggggcctgtgagcttgttctggttccagctgaggcacatcttggtgcagcttctcctgggcttcaaca

SEQ ID NO: 502302 - DNA, 244 bp, Homo sapiens
aaaaaattaaagacgcccctggcggccccttttcctgggcccagtgatgtttccccggggcctgtacacaaccgagcagcatttccgttgaaggacttgcatccccctttcgggcagtgctggacgtgttccggagaccccccgggagggggcccccattccttgtaccccccccgtgcaggttgtggccggttttttccccaggttgaacatggaaataaaagccaacttgtattaaaacaaa

SEQ ID NO: 502303 - DNA, 356 bp, Homo sapiens
tgggtgatacagaatggattcgccccttgctttttttctccggtgtgtgcattccggggatttatcctcaagtgcatttgtgaccataggtaattttagttcatttcaaatgttttggttattcagggtcccttgggcagtataacaaaatgtagcttttgaatattgcccacctctatgcggcatatccttcttgggatatagtagctaagacctttgtaaacggccttttggttaggtatggagtttggtctttggggagtgggccttttttagccattcctgttttttgggactgaatgttcaaagtgaaacaatgtttggattctgggcagaataagggactcttcggtcta

SEQ ID NO: 502304 - DNA, 137 bp, Homo sapiens
tagaaaggacgtcagatgtgtaatcagagtatcttgtatgcacgcccctgtaagtagtataatctcttcatgcttaacatacctacctattattatcccgacgatattgtaatatagggtacctgagactcgacctc

SEQ ID NO: 502305 - DNA, 219 bp, Homo sapiens
ggccgaggcagatcctgtgacatatacgggtacaacattcatttatgtgtgtagcaagaaaaagacatcttaaaatcttaatttatctgactattgcatttgtttttctttttttcttttttctttttttttttttttttggaaatggagtctccctctgtgtgtctccgggcggaaatgtgcaggggcgcgattcttcgagctcatgtgaaagctcca

SEQ ID NO: 502306 - DNA, 179 bp, Homo sapiens
gtttcttcataccttcttccctggccttaagctctgtgccacctttgagatgaaaggcttgtcctgtctcccgtcactgcccccaggccatgtttccctcatcattttcacttccactgcatggagggaccacaccaggtcaataccaactacagtgatcaagttcaactgcacggcgt

SEQ ID NO: 502307 - DNA, 763 bp, Homo sapiens
tcggttgggcgcaacgggttctaggctggaggcagctcgaggagccgcggttcgccgccccggctcggcctggcagatagcagaggcagcaggtccgtgccgggggggcatgttgctgttaaccagtggggccaggggatgttacggtggacagctgcacctggagggcgggccccgtctagggctgagaccatgctgcagctggctgtcgggcagtcgggctatacgtccttcgggggttacggggtctggtgagagactatgagcacgactgcgctcgagcagtagagtgtgcacaattttcaatgcaggtgtccgttggctgttggacaacagctgcccgccggtgaagtctgccatgcgtgggcagagctcggctgtggtaccgctacatgcgctatggacactcatccgtgcctcatcgacgacatcagtcctcctttggggcgggcggaatgatcgccgaaggggcctgcgaatgtgctctatgtcctttgacgtcaagtacgcacaatgtggttcagcaccgccgatgtgtcagggacagttcctggggcccggtgatggacattcaggctgtgtcctatggcagagtcctgtagcctgtttgggggctacggagcacgcaggcggtgctgtttgttccactgacgtgtcgcaagctagataccagtcgcattggcatgcctcttatctgttccggggcgcctgcggctgggggacttccttcggccatggtggaggcctggttgtgggggcggcc

SEQ ID NO: 502308 - DNA, 262 bp, Homo sapiens
gagagacactggagacattgagcagcagcagtggggatggcaggcagagatgaggacaggaacatttaccttgtgtgtctctcagcttctcagatgaccaacatggtgctgcatgatggtgctgaagatggagaacccaccaagcctcgctaggagccacctagactggatgcagagcatggccccatgcacccgcagagcagacactgcgatgacagcggacgacacagaagcgcccgctatgactctagcaccgggccac

SEQ ID NO: 502309 - DNA, 564 bp, Homo sapiens
  misc_feature (9)..(9): n is a, c, g, or t
caacgaggncctcagctactgggaggccgaagtgggaggatctctgagcccaggaggtggaggctgcagtgagccaggatcatgccactacactccagcctgggtgacagagtgagacctcatctcaaaaaacaagaaaaacattctaaaatattttaaataggtaaacgaaataaaaatttaaaacaatatcaaaattatatcaaaatcataatatatcaaaattggtggagtgcaacaaagataataattagaacaaggaagatataaaaatcaattatgcaagctacttccaccttaaaaagctagaatagtataggcaaagtaaacctgagtagaaaacaggaaatagagagtagaaacaaatgcaatagcaaacaaaaaaatagagaaaacaataaaaataatgaaactaaaagctagttctctaaaaagatcaagacggccaagacgcagtggctcacgcctgtaatctcaacacacggagaggttgaggcaggcggactgcttgagcccagatgtttgagaccagcctgggcaacatgatgaaacctgtctctacaa

SEQ ID NO: 502310 - DNA, 167 bp, Homo sapiens
tgcttccctcctctatctttaaagaacggctcagtattcaatcagtcatgaagaacctgattagcactctgtgagtgttgtaaagaaacaaagaaactctaatattgaatctcttaaatttagtgtatgtaaacagcttacaaatacgtattgtctaaatgctatca

SEQ ID NO: 502311 - DNA, 421 bp, Homo sapiens
  misc_feature (421)..(421): n is a, c, g, or t
tctctctctctctctctctctctctctctctctctctctgcctgtgccggaaccagcacgaggatgactcagacattgacatagatatggacaaagacaatgctgagatcatggtcatgctccaggaggcaatgcaggagcatgtgaatgcaaatagagacagagctaaccctgtcactgaccctgtgagtgtggctgttacattcacgttcacagagggtgaggacgtcaaccgcgcaagccttataactagcaccaacaccaacacaagctaaggtgacgcctatgcatcaccagtacagaattcaaacactaccacgttagcgacggctacagttgcagctgttgctgcagcatcagtctccatctcacactgacacacagccacagccaatgcagaggtaattagagatggcaatgn

SEQ ID NO: 502312 - DNA, 707 bp, Homo sapiens
acatggccctgctccctccctcagtctgtagcctcaggaggggactgctttgcctgtgagtgggagggagctaccgtgtgagtagttcccaacagaccatctgaagtcattttcccaggtggcaggagaaacacagagccagacgttacactgcttttcaaagagagttgcctctgctgccccagcgaggatggcgacacaaacagcggtggtgtcagcggacagcggtggtgtcagcggtgaccgaggcagggccgagactccagggtcttcgggttcaagctgtgccccctcgcgcagttcagcacctgccagcacttccaagtgtgtgattgtcacgcttgcctgattactccttcctttgggctcccatagcaatttgtacattactgtggaattgatcaaattgctttataactagctgtttatgtgtctttaatctgtgtcattttggatggcaggaaatgctctttcggtaatttttttgtccacactgactggaatactggttggcacatagtaggtattcaacagttttttatcgagggaatgaaagctctctaaaccacagcaatcatttgtagacaaagactcttagggtgtaatgtgatttaacatctgatttttggaaaatagttactgagatcattccgacaataatagagtgcaataccctacctttaataaaggatattttactcctttta

SEQ ID NO: 502313 - DNA, 200 bp, Homo sapiens
tgccagtttattcccaattactattctttcctttccttctcccttatccctctataagtatctagtgtcatagaaacatggatgttatagatttactatactcctgcaatgtacgatagatctttattctctaagttcatatccaattatttgcaggaccataaattctttctctaatacttagggcgctcgtgccgtgt

SEQ ID NO: 502314 - DNA, 106 bp, Homo sapiens
gcaggagaactggtgtgaacccccggagatggagcttgcagtgacgccgcgacctgcaccactgcactccagcctgcacgaatgagcaatgaccccatctcaaaaa

SEQ ID NO: 502315 - DNA, 161 bp, Homo sapiens
gaggagtatggttgcagatgctgctatttcatagaggaattgacaggaagagacaccaccacgtgagtggagcctgcgagcttaactttgacgtcaacactgggaaagtctcaccctggcccgtgacacggaacaggacttagatccagattgactatgct

SEQ ID NO: 502316 - DNA, 396 bp, Homo sapiens
aacggcggtccggtcgaggtgacgcagatcgtgctctcgacgcagcatcttgacgagtccctcgactcggccgacgtgcgcgccatcgtcgagccctacatcctcaaggccctgccggagggctgggtcaacgagggcaccgtctggcacgtcaatccgaccggcaagttcgtgatcggcggtcctgatggcgtatcggctcaccggccgcaagatcatcgtcgacactacggcggtgcgggccccacggcgcggtgccttctcgggcaaggaccgaccaaggtcgactcgctgcgtacgccgcccggtatctggccaagaacgtcgtcgccccgctcgcccgccgcgccacgatccagctctcctagccatcggcgtgccaagcccctgtcgatc

SEQ ID NO: 502317 - DNA, 876 bp, Homo sapiens
cgcagtggctcacgcctgtaattccagcacttgggaggccaaggtgggcagatcacgaggtcaggagttcgagaccagcctgaccaacatggcaaaaccccgtctctactaaaaatacaaaaattagccgggcttggtgatgcacgcctgtaatcccagctactcaggaggctgaggcaggagaatcgctttggaccctggaggtggaggttgcagtgagccaagatcgtcgccattgcactccaagcacatccagcctaggaagccagagggagagactgtctcaaaaataaataaataaataaataaaaacaaataatttggcctcaagtggttacaggacatatgattatagttatccgccaaagagtatttgggggcttcatacttaattattttagctttgttctaactcctctctttataaatttttgtctctttaagacaaggtaaagacagtatgtaaatcagtgagcattccctcgctgatggaaaacagcactgtagtgatatgtctagcttaaagtaaagtctaacatagttgttattaatgcccaggggtgttaagggttgaccacagtttgaaagtgttatgtcagtaacaggttccctgtttatgggcactctaaaaattaacttgcaatataaattacaaaattggttactggtgtatctttttaaagagtgcttggacatttctggttaaaaggttccggtacacttgggctatggcgaaattctacgtagatgggaagttaggaggtcataataatggctgtggcaactgggacagaaataattagggtgtaataaaaaacagaaggagggaaccgaacccagtatagattaatttgggggacattacagaggggagaa

SEQ ID NO: 502318 - DNA, 129 bp, Homo sapiens
gaggatcccctcgcaaggatgaggaattggcaggtcttaaggtcaatccctgtattgctttaagtggttagggggtggtttgatcacatattgtagaatacgtcatttcagttcctcgatccttgggag

SEQ ID NO: 502319 - DNA, 96 bp, Homo sapiens
  misc_feature (51)..(51): n is a, c, g, or t
  misc_feature (68)..(68): n is a, c, g, or t
cgagaagacgacagaaggggaagaaaaaagaaaaagggaagaaaaaaaagnagaaggggagaaaaganaaaaggaaaagagaagaagggaagaagg

SEQ ID NO: 502320 - DNA, 313 bp, Homo sapiens
gggtaggaccgagggtactccacgctggagatgtagcctgatgcctccgtgtacagatcgctgttgtactcagcctgtcaggaatgcctgtctttctgaagctcatatcctgtacggcaggaaacagaatatcctccaacgtatttgtgacacacgtgctggcactggggctggggatccttctcccctaatttgctccgggaagcacattcatcaaggtccacagcttggtagtaggccaggaagcccttgtagaacatgatggtcccattctcctcgttggagaagtctgtgtggaaggtcaacagcatct

SEQ ID NO: 502321 - DNA, 1682 bp, Homo sapiens
  misc_feature (311)..(311): n is a, c, g, or t
tccccgagaaccaattttcattcctgttggcccaaggtaaagtgcaggggcgtgatctctgctctttggcaactgtgccgccctcccgggttcaagcaatttcttcatgtgcattcagcctctcccaagttaccgtgggacatacaggcgttgagcataccatgtgcccggctataattttgtggatatttttaagtataaagagtggggtttccattattgtgttgtgcgccgaggctgtggtctctctcgaacactctcctttaacctctcgaggtgtgattctccacccacacctgtgtggcctctcncgcgaaagtgtgccgtggagatatctcacgaggcgctatgaagcccaagtgtggccccccgggccttgtggacacctgtgtgactgtgtctctttatattcaactcccacaaaaacacatttttgtgaacactgtggcacattattgtggctctctccgagaaaaatatgtgggcacaaccagagacacttatataaatgtgaaataaagcccctgtgtgcccctatatgccacaaactctctctctcctgtgtgtggtgggtgagaaaaatagagagggcccccctctctgtgttgtcttaccaaaaacatcttatcaccctgtgtgtttgtctaaaaaaggagacttctttgttgtttccacaaaggccccaaaccggggcggttccctcgtagggggcttctcccttctcgttggggcccccacacggggggttgttgaaccacctattttttggggcggggctcttatcccctccttttgaaggagagaacgtttttgttggggggccccctttaaaccgcgtgttatttttctcccccaaaagaggcgccgggtggggtcgcccgggggggattctatctcctcacacattatagtttgtggggtcctccgtggatagaagggggggcttcaccacacatccacgaggcccccccgggacgaaggttataataatgaggatggggtgaaggagacggcatactatctctctccctatttactgcagcaccacacaatctactggggcatgtgtttcatattaaggcggcgaaaaccatctcccccgggggtgtggtttccccccacaagcggttttctctcttccttttgtggtcgacaacaatctgtgttctctctctgggaggggcggctttttgcggggatttttgcaacacaccgaggatgggtgcgcccccccacggcttttgtgttgttctccaccaagatttggttttctcccacgagataaacacaaccgtgggcggttcatgggaagcgtttccccaagaacataagagttgtttcccccgtggtgtaacccaattattctttttcttttattgtgtaacagccaacaacttcctctttgacaacccacactgtcggtgtagccaacaatataacacccaccttttttaactaaccccccaacctaacttaaccaagctaacaaacaacaaacacctcacgaggcgggaacacactacattcatcagtcgggagggggggagagaacgaaaaacgaagtgatacataactcggcacgcagtaggtggcaccataatcagtgttattcctggtccacccccactttgtttcttaccacacgcaggggaaaaaatcggggcccccatgaaggaggcgga

SEQ ID NO: 502322 - DNA, 347 bp, Homo sapiens
tcaaactcctgggctcaagccatcctcctgcctcagcctcccaactaactaggactacaggcacatgccactacacccagctaattttttttatttttactcttgctatgttgccgaggttagtcttgaactcctgggctaaagcaatcctcccacctcagcctctcgatgctgggattacatacagattttactagtttatctttttgagttctggaggcacttttattttccctatgactcacctatattcccacaaatgtgtttaaagcaatttataatgaggttaattttcttgtctcatttccagggttaagaagattcccaaatgactgtaaaattaaata

SEQ ID NO: 502323 - DNA, 1007 bp, Homo sapiens
ggcctgctaacggtccggcagtcccgcgtatacaacaaaaacacacaaagatgtaaaaaagcttcaaataaggtcatggatataaaactggcccacaaattaaaactttacctagaaaatctgactagggataataaaaacaaggcaactgtgtgtaacacgcaaataataaccgtaactttaactttgtgtggtactttggggtttttaagcattttccctgttatttacaccagaaactgattaacaggaaaataatacctgcttatatctgtgtaatacctatttggtaaatgtaaaaacgaaggcttagaatgctagaaacaccttgccaggattacccagtgattgggagaccatggtcgaacctcatctcatggatggctgaaacccatccctattctacctgacacccacatttcagagttttccaaaatgtggttccacagacaaccagcatcaaaattgctgggtataattattctaagaaggcaaatcctagaccttacctcaggggttagagcctctgatacaaatttcctgtgtacccatatgcacaaggtgtcactaccactttaaaaggcatgttgtagactctagggtgtacacaagggtcaggacatactacaaacacctctaaagataggtctaggacaatgtgctagaccacccttgcaaacccagtaatacatgcttagcacaaggctctaacattgcccgggcatgtattagtacccctccccggagacgtgacaaaattgtggtcaattgtacaaaaagccaaaattgctctaggaagaaaagaagcacaatataagtgggtcaatccctttaccatgcacagaaataatctttagagccaaacagattataaccgaagggacttacaaaataaacctgactatgaaactcggaataactattaatgtatatacaaacattataacctagctccccaaatgtagttccacaaattaaaacaaacaaatgagtaattgaaaaacgtt

SEQ ID NO: 502324 - DNA, 836 bp, Homo sapiens
gtcccagctactcggattctaaggcaggagaatcacttgagcccagaagtttgagatcagcgtgaacaatacagcaagaccccatctctacaaattaaaaaattaactaggcatcgtggcacgcgtctactcaagaggctgagacggaaggatcacttgagcccaggagtttgagactaggctgggtgacatagtgagaccctgtccctacaaaataaaaaaagatttaaaaaaattagccaggtgctatggcatgtgcctatagttccagctacttgggaagctgaagtgggaggatgttgcatgtgaattgaagtgggtggtctaggctcgcaggtgagctgtatcactccactgactccagcctgggcaaacagaacgagaccctgtctcaaaaacgagacaaagccaaaaaaaaaaaatcccccagagtggtctgttggatgaacacccagtcattatggactagcaggtgcacatttggctgatgaatccgaggggtagcgaagaatacttatagcttaagacttttctcaaacacaattttaattaagtactcttctgcaacaaaatgctatgcccaaatagaacaaaatagaataaggcaaagtagatgaatggccaaacaagataggatgagagagtcagcctacataaggaacagattgttaataaccattacgcagtcgggatcagccgggaggaatgtccaagggggtatgtacaggatagaagacaataaaaaagaagacaaaaataaaaggaagacttaccgaaaacaaacaggaagacaagagagccagaaacaaaaggaaaggcaaacacccatgcgccta

SEQ ID NO: 502325 - DNA, 99 bp, Homo sapiens
ttccttttttttccccccttttttttttggggggggttggaagggatttaatttttggggggagggtgggggggcctttattaaaggggaaccccccca

SEQ ID NO: 502326 - DNA, 544 bp, Homo sapiens
  misc_feature (305)..(305): n is a, c, g, or t
agaggttgcatatcaatttgccaaatattgatgttcaggtttttctaatattaacttgttattggaatttggatacttcataattaatgaaagaaaatattggcagtttatcctttagttctaatcacctctcgtttccctcctaggtcttgtcagcaatacagactggttgacaggcctagcagtactgtcagatttccttggttcaaagctcagtctttttactttctagatatataagttttagcaagtttccctcacccacttaaatagaaagtaattaatggcgctgtactttttggaanctgtgcacaagagctcaagtgataaaattctatggtgtagtactctggcaatagtaccctggcccagaaatgagagaccctaacccacttagcgtgctaatagtgtattttgtacttcttaaagcagtgaaagattcttgaaaatcttatacttctgcgtaaaatcactacctatactcttaaaaattttcactatgggctcctaccttaaattaaaaaatattttccaaaacacggga

SEQ ID NO: 502327 - DNA, 267 bp, Homo sapiens
tatgagctctgttatctcctcgaattggggagggtcagggccattatttcttgagcatcatctagctgatacgatataaggaagttatcacttctaaggaccaagaagaattatgaaaagtgaactacacctatgagatttaggggaggtcatcaaatatagcactatatacatgatgggagtcccagaaggggaggagagaaaggctcagacagattatgtgacagaaataagggtcaaaacgcctcccaaattttaggagataca

SEQ ID NO: 502328 - DNA, 502 bp, Homo sapiens
tgctagtactctcgctgtcagtgacatttccatgaaatccacggtgttctacactctcgctgtgggtgccatttccatgatatccacagtgttctaaactctccctgtggtgccatttccatgatatccacggtgttctaaactctcgctgtcggtgccatttccatgatatccacggtgttctaaactctcgctgtcggtgccatttccatgatatccacggtgttctaaactttcgctgtgggtgccatttccatgatatccacggtgttctaaactctccctgtgggtgccatttccatgatatccacgacgttctaagctctccctgtcggtgccatttgcatgatatccatggtgttctaaactctcgctgtgggtgccatttgcatgatatccacggtgttctaaactctcgctgtgggtgccatttccatgatatccacggtgttctaaactctccctgtaggtgccatttccatgatatccacgacgttcaaag

SEQ ID NO: 502329 - DNA, 374 bp, Homo sapiens
  misc_feature (323)..(323): n is a, c, g, or t
  misc_feature (367)..(367): n is a, c, g, or t
aataagcaatcatattcttacgattattcacatgtaagtacttaacagtaagggatatggcgtaccattaatacaattaaaaaataatgcgtggagggtaactaagcagcatagttgtatcactggaatacctgtaaccgctattaaacagcagcagatgcagggggctgggagggtctttttccccttggagacgcggaataaactgtgttgtgtgcctgcattttgactgtggtctgtcacatgaggtcaaggtgggaattttttacttgtgggtatttaaaaatgtttgggattttgggagcatttcttgattttggggnttgttttgatgaggggacggctccaaccctattactttttatanttgttca

SEQ ID NO: 502330 - DNA, 513 bp, Homo sapiens
  misc_feature (163)..(163): n is a, c, g, or t
  misc_feature (281)..(281): n is a, c, g, or t
  misc_feature (335)..(335): n is a, c, g, or t
  misc_feature (337)..(337): n is a, c, g, or t
ctcgaggccaagaattcggcatccccgccatcatcgtcacctcctgactggtctgatcaaggccgtctgtgtcgtcatcgtgtctacaacggcaacgcggcctgccagcgatcgcgaatcgcggcccgatagttgtcgtcgaaccggttagctcgcgggtaanaatccttccaggcgaagggcttacacgcgtcgatgagcacgatacccatcgacaggtcacccgcatcgcgtttcgcaggcgacagtcgcggatcgatcgccgttgtcggtgtgcgcangacgtggatggattcggtcgggtcgacgcgagtgaacagcgcccagagcacatnantgatgtcggtgatatcgatgtcatcgtcgacgacgacacagtagcggtccatgccgcccgttctctttcgtcccgctgccgccaacaacgcatgcatggcgttcccggtgccggtctgctccatctatatcaccatcatcaactggcgcgcatatgcccacacgcccttgatgttt

SEQ ID NO: 502331 - DNA, 697 bp, Homo sapiens
  misc_feature (605)..(605): n is a, c, g, or t
  misc_feature (616)..(616): n is a, c, g, or t
  misc_feature (638)..(638): n is a, c, g, or t
gcctccagctttgttctttttgcttaggattgcctttgctattcaggctcttttttggttccatatgaattttaaaatagttttttctagttctgtgaagaatgttgttggtagtttgataggaataacattgaatgtgtaaattgcttatgttttcccatttgtttgtgtcatctctgatttctttgaagagtgtttttaattcttgttgtagagatctttctagagtattcctaggtgttttattctttttgtggcagttgtgaatgggattatgtttctgatttggctcttggcttaactgttggtatatgggaatgctagtggtttttgtatgttgcttttgtatcctgagacttcgctgaatttatgtatcagcttaaggagcttttgggctgagactatggggttttctagatatagaatcatgttgtctgcaaacagagggtagtttgacttcctctctttttatttggaggcactttatttctttctcttgactgattgctctggccagggcttccaatattatgttgaataagaatggtgagagagggcatccttgtcttttgccagttttcaaggggaatgcttccagcttttgnccattcaatantatgttggctgtggatttgtcntccaatgggtccttaatatttttgaaggtttgttccatccaataatgttatttactgga

SEQ ID NO: 502332 - DNA, 1730 bp, Homo sapiens
  misc_feature (1018)..(1018): n is a, c, g, or t
tccaaaaaacccagtttttttttaattgtggtaaagctctgccataaatcttctaccgtgtgccaagggtctccccgtccacacttcgcaccaggttgtgctccggtgttacccagcaaacagaagtctcgtggccattcagcagaaccgaggcccagggaaggtgtgcccgtggggtgtggtttcgtgccttggcgtgcgtggtacgtagatataacttctcttgtgcgtatcagtgtctcatctctataacaagagagatctctttcccctctctataaatctcccaaatctcttgagaggtgctgtgggcgcccgtggtggcacgcatcaacaccgccaagataagcggagatataagggctgtagaaccaacaggggggcgtgtgagagataaatgtgtctcccccaacaacatatctatcgcgcgtgtgataaaagggtgtgtttgagacccatctgcgggagaggatctccccatatacacacaagtggccctgtggccacatctcgtgtgtgtgccctatcacacaatatggccaccgaggagagaggggaaaatctcaccataatctgtgggagagaaaatataaacgagtctccacccgcgggtgtctacaacgagaaaaatcagccgcgtgtgtgtgttggcccccacaatgtgtgtgaggtgtgagtgtctcctctactcgacggctgatgggacgacaagatttgataacccccgcggagggtctccacaatacatctctgtttgtacacccacaagctgtatatgctccccccacaaggccccacagtagagagagtaaaacccacagatctaagaaataagagggagatatcagcaatgaagacatagatagagagcagccagacaacaaagcgcgcgagagacaaacaaagagaacacacacccccaaactcactctgtaagaagcgtgcggggccctcaatacaatatccccaggggggacacaacacgatgtgataatatttggaggccgcagccagcaanccccccacgggggagtaaaactcacccaacatgaagcctctttgaaagcgagcttattaatactcaaaacggaagttgtgcggcatggctcctgatgtaaaccccaacaggccgactataagtataatacgagtacaatgaagaggcgcccccgttggatcccccacatgaggctgttagcaacacacgctgtcctaaagcacaacccacctctctgtgtaagttgaaggcccgcacgagaaacagccctccctcccccaaaaaatagcctcgattgttgcctaatagttggatagcgacgcccaccctcataacacaacagagtatgtatttttgcacaaacaatctttgtcagagagaaacatcccccccgcaagaagtgacggagcacacactgtaaaacagaacgcaaagctaaatgcaagtaaccacacgagagagacagtccccccgtagcaacccccgcgatgtggtgtagtgacaataaaacacatacatcccaaagagacagtcgatggagatataacacctcgagacgcaacccactcgtcttgcgtgagaaaaccgcgcgagcccaacaatacaacccacggtacagcaagaaggagcgccacgaagcacccccaccaccaaggagcgagacaaaaacacagccgcagcgacacaacatacgtcagacgaagcgtagacgaagtccgagaacgacacaaca

SEQ ID NO: 502333 - DNA, 292 bp, Homo sapiens
aagccccggccctggcctccccaacccccccttttttttttttgagacggagtcctgctccagcctgggcaacagggtgagactctgtctcaaaaaaaaaaaaaaagtactaaaagattagaaataaaatcaataacaaagatactaggcatggtggctcacatctgtagacccagctactctagaggctgaggtgggatgactgcttgagctcaggagtttgaaagtagcctggccaacatagcaagaccccatctctatttaaaataaaataaaattttttttaaaaaag

SEQ ID NO: 502334 - DNA, 213 bp, Homo sapiens
  misc_feature (23)..(23): n is a, c, g, or t
ctactctgacggactccccgggntctcatggattacttgccatggtttgtgcacattaactttaataaaggtgtggcaccgctcaaggacacagtggaaggaatgtgtagttctgctatggggagtcatgggaagaggcagagaaggttctacaaacggagaccacacacttggtcggaggtcttcaacgagacggacactcggcgtcccgag

SEQ ID NO: 502335 - DNA, 174 bp, Homo sapiens
tagagagatcttgagcaggtccaagcacaaaactagtatgaccggagagactcaatttagaacgatgcagcatctgaaaacctttaccccaggaaaggaggggtgcctgcatggcattcatggagctctggaacaagacatttattcaaacgatgatggcccctcgagaccgga

SEQ ID NO: 502336 - DNA, 167 bp, Homo sapiens
  misc_feature (108)..(108): n is a, c, g, or t
  misc_feature (126)..(126): n is a, c, g, or t
tcccgtagtccttagcaagtagacatctttaattcaaaaaatacatgcacatatatacaatagtgatgggaatgttatctttatccaaaacattatagagtttatctncagatatactggagtacntggtcactcagtctggtaaactaaacccccagcagggtggt

SEQ ID NO: 502337 - DNA, 190 bp, Homo sapiens
acacgcaactggggaactggagcaatatgactctgcttatgttttagcaaagagactggtggcatttgcccctgccatagagttctgtggaactttgaacttgagagagatgatttaggtatctggtggaagaaatttctaagtggcaaagtgttcaagaagaagcagcgcataaaagtttggaaaatgg

SEQ ID NO: 502338 - DNA, 332 bp, Homo sapiens
agaaaaaaaagtgaagaagtctgactttggagaatggcagttgagtttgtgtgtgcccaccagtggagactgtgggctgggcacacgggagggcactcggactggagctgagttcaagcaaaccatgaagacccagagatgtaagatcccctgcaactggaagaagcaattttgcgcggagtgcaaataccagttccaggccttgggagaatgttacctgcacacagccctgagacagaactggagtctgagcgagccctgacaatgccgatgcaaaagctttaccattccaagcctgtggaaatgccagccaacctaagcagatctaggag

SEQ ID NO: 502339 - DNA, 871 bp, Homo sapiens
agcggggtgtgacagcagctgaagggcagaggaggcggcgcggggtgtcctgtcctcgccatgaggccgccgcaggcgccgtgtgtccggaaaggtgttcattcagctgatgatcgtacggcagtggcacagcgctgccagttgccatgaccaaggttccctgcggagctggagaaccggattgataggcagcagtttgatagaaacagttctgaactctaatagtaagcctttatgcacgaagcacgagcaagctcggcggccagtcatatctcgaaggttcgttctggcttgtttaacagcatataccatcttccgtatgccgtggaagctcattatgacgaaggttctgaagaaagtctccgaaatacgattcaccgagcagaatgagaagatctatgctccacaaggtcctcctccgtgtacagaccctattgagcgaggactgcgaggttacttgaaagttaccattctattgaagactagagcgcatgcagcagtggaacgataaaccgaagaattaaagatcccacttccagcctgggcccctcatgtatccacttggtccgaccgaagagatgtccctagctccgtactccagagcatcattcctttctatctgctgccagagccacggtgccatttactcccaaggactcactttctaaaattccacacctggagtgacctactagttcgctcagcatccactttgtgtctccaaattgtgtaggaactctgtaatcttttgattaagttgctgaagaaaacccaatgaagcacttcacttttttttattcagggccattcactaaaaccacagtgggtcagcccagtgcaaagcttggtatcctgccaacggtacatacca

SEQ ID NO: 502340 - DNA, 129 bp, Homo sapiens
  misc_feature (7)..(7): n is a, c, g, or t
acagggnattgggtgggatttagccatagcatctttaacattcttattggcaagtcctagataatgatctatcggggccggaggccgttcataaataacaggaacacggaagagtgaaatgaggccaaa

SEQ ID NO: 502341 - DNA, 342 bp, Homo sapiens
ggtcgctctagacgatcccttatctcgcgtgcgcatcatcgtttcaccactgttagcttcgtttacatcaaactccatcaacgcgccatcgctctcaatcgccccaacgcttgttaccatgataatcatgcacgaaaatcagccacaaaggacgccgctgaagggccaatgatcccgctattatgagagcgcaacgtaccgccgggcaccatcacttcaaagcgcgggttgtggtaaagaatatgcgccacacgcagtgctgttggttgattatcctgcaaatgattatggttaagtaacgcccgggcaacatgctcaacagtcgtaccaatggtgataaat

SEQ ID NO: 502342 - DNA, 132 bp, Homo sapiens
ggatcttaaccactgtcgtctacttcccctggatctgaagatctggatggcaggaacgagctcttatatgactatttcaccctggcatgtgctcagcactcagcacgtgctcgatgggatgtgcaggtgcac

SEQ ID NO: 502343 - DNA, 160 bp, Homo sapiens
gaacatcttctatagctttaataggtgtctgtctccattttcatcttcttcataattggcatggtctctctttctggcacactttttcccaattgtccccacggatgggggaaccttttagaatcgaacttgcagccttccagcttggcacttggcctcg

SEQ ID NO: 502344 - DNA, 765 bp, Homo sapiens
ctgtaaaagttccttcctcctcttttcccgcaaggctctcccttgtcgctaataaaacatgttgcttgcctgtgtttgggtcccccccccccccctgttaagaaaaaccccactctgtgggtttaagacccacactaacattgggctgggatgtcctctcgcaagtaattcttccaaccaactctgttctgcctacacgcacactcccaccggtgctccctctattaataaaatatatttcttcaatccatcgttctgctggagcacactcaaaatatatcttatttgtaaaacacacatcagtgatattcagcccgagtgcggtgctgaaaaattatactgctccacagctgaggggctgcctctctgcttctatgaaagctagggtgctaggtgtcgccgcacgctcgcatgtgcatgtgtgttttgcatgtataatagcgttctgttgtatgtatgtagggggtgcgacgcgcatatacaattaaatttgtgtgtgtgaccaaagaaaacttttgtgtgagtgaccaaaacccatttctctggagtggccgcacacaagttcttgttcgaatgcaatgagtagtggatgacaaatcctccgttcggggtccacaatagtagactataccccctgaagaacttatcttcttcacgtattttccactcttctagactaataggcagaaaaaattttcttccactaaaaatattctttgaatttatttatctcatttctccccacaatacaaaatacaaaaaaca

SEQ ID NO: 502345 - DNA, 868 bp, Homo sapiens
  misc_feature (690)..(691): n is a, c, g, or t
  misc_feature (694)..(694): n is a, c, g, or t
  misc_feature (700)..(700): n is a, c, g, or t
  misc_feature (705)..(705): n is a, c, g, or t
  misc_feature (724)..(725): n is a, c, g, or t
  misc_feature (732)..(732): n is a, c, g, or t
gcaataaagttttagtgagcacagactcccttttcttgggcaagatggcggagtacgacttgactactcgcatcgcgcacttttggatcggcatctagtctttccgcttcttgaatttctctctgtaaaggagatatataatgaaaaggaattattacaaggtaaattgggaccttcttagtgataccaacatggtagacttggctatggatgtatacaaaaacctttattctggatgatattcctcatgctttgagagagaaaagaaccacagtggttgcacaactgaaacagcttcaggcagaaacagaaccaatggtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttaagagtgctggttccagcaacagatagaaatgcttaagttcactctggggaaagctggcctctgaaatcttaactgcagaatgggatgcagcatggaagaccttacaggttacaagagaccatagataataattcgtgtgagttctccacttcagtctctcaggagagaacatggtcatccatgnnctngtggtnctcantcacccaagtcggataatnntgactcntctttataagccacatatcttatgccattccgacatggtcccactcttcggtttggcagggctacacaggttcggaagtggggtcagatcattaattcacaggctccctaaccccagtcgggttgtccgcagcgga

SEQ ID NO: 502346 - DNA, 812 bp, Homo sapiens
gcaataaagttttagtgagcacagactcccttttcttgggcaagatggcggagtacgacttgactactcgcatcgcgcacttttggatcggcatctagtctttccgcttcttgaatttctctctgtaaaggagatatataatgaaaaggaattattacaaggtaaattgggaccttcttagtgataccaacatggtagacttggctatggatgtatacaaaaacctttattctggatgatattcctcatgctttgagagagaaaagaaccacagtggttgcacaactgaaacagcttcaggcagaaacagaaccaatggtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttaagagtgctgatggagtcttgctatgttgcccaggctgatctcatactcctggcctgaagtgatcctccctcctcagcctttcaatgctttgggatttacagccatgagcctctgcaccctgcctgtcataagatttctctagttaatcctagaagttggtaaaatagaccttatactagagactttttgtcttcacaacacttggaagagtttgtttctttaagcacatgaactagtcatgcacacgagaggtctattactgcgtagatccagcatactgcaggggaaagtaacatgcagaatagt

SEQ ID NO: 502347 - DNA, 221 bp, Homo sapiens
ataacatgggatagggaagacaaatgaatgactgtaccagtggataaataacatttttcatttcattacatttttttttttgagacagagtcttactctgttgcccaggctgaagtgcagtggcgcgatcccagctcactgcaacctctgcctccagggttcaagcaattttcctgcctcaatctcccaggatactgggattacaggcattcttcatcagc

SEQ ID NO: 502348 - DNA, 172 bp, Homo sapiens
  misc_feature (16)..(16): n is a, c, g, or t
  misc_feature (75)..(75): n is a, c, g, or t
  misc_feature (85)..(86): n is a, c, g, or t
  misc_feature (91)..(91): n is a, c, g, or t
  misc_feature (107)..(107): n is a, c, g, or t
  misc_feature (118)..(118): n is a, c, g, or t
  misc_feature (123)..(123): n is a, c, g, or t
  misc_feature (128)..(128): n is a, c, g, or t
  misc_feature (161)..(161): n is a, c, g, or t
gggtggagagagaggngtgaaggcagcagggcaggggaggggagggtggggggaggagccaactggggaggcctngagggccagnnaagcnagttagggccagggcnagaatcgcgcntcaanggaanaacagccctagttgccctaaagagcccctaacnctttgctggct

SEQ ID NO: 502349 - DNA, 337 bp, Homo sapiens
  misc_feature (36)..(36): n is a, c, g, or t
  misc_feature (320)..(320): n is a, c, g, or t
  misc_feature (327)..(327): n is a, c, g, or t
gagtgatactctgcctcaaaaaaacaaaagtatttncaggacaaaggcatgtgagtgtgcagtctctgtaacctggcaggagccagtccatggtcagtggtcctcttatgaggagaaagttactggaatcagtctcttgtccagtcaaagctgtagttacggctggtggaacagggttcccgttcatgtctgtgaactgggtgagctgtgatcattttaacattgcttatctttaggtcagtgcttgtttagttgttgaataaaaagaaaaaccttgtggcagttagaacacagtttgttatttaagtttaggggagtgngacttancccttgactg

SEQ ID NO: 502350 - DNA, 660 bp, Homo sapiens
  misc_feature (21)..(21): n is a, c, g, or t
ggcggaagcggagaccatgtnccgagcggcggtccggggcagctccggcgggcggctcattgctacgattcagagtaccctggtaatagctgagcatgcaaattgattccctagcacccattactttaaataccattatctgagccacacgcctgtggaggtgaagtgtcctgcttagtagctggaaccaaatgtgaccaggttggccacaagatctctgtaaggtagcaggcataagcaaaaagttcctgggtggctcagcatgattgtgtacaacaggcctacttccagaggaacctggacaccattgatttgtggcaatcaagaagcagttcaattaccacacacactcttgtgctgtggagcatctgccttctggaaagaacctttttgcccagagtagcaaggcaaacttgaggttgcccccgatttctgacattccatttgcaatcaatgtcaccttgacaccattgtggtgagaactatttttattgcagcgaaaatgctctattgtaccagtgacagttgttgctgacgcaaacgtgacaccgtgtttcgtgtccggtggaaacaatctttggatgctggagccaacaagttgggcggtagtgccagttccagaaaaggcattcaagtacttcaccagtggaaatctccgag

SEQ ID NO: 502351 - DNA, 237 bp, Homo sapiens
cagcgaacaggcaaggaatgtactctacctggagagtctcactcgagttctagagaaatcaagttgtatccccacagtgctacacatgaccttattttataatagattcttcaagtaaaatgtggtcaaaggaaccaataaattgcctcacgtcataattttaaacttaagtgtacggaagactaattacagtgagtctttgcattggtatctttagcccacaaatctttttggctc

SEQ ID NO: 502352 - DNA, 105 bp, Homo sapiens
gcggccgcctactactactaaattagcggccgtgcgacggaagaaagaaaagatagaagagagagagcaagaaagaaatcaagagaaagaaaagagaggtcgacg

SEQ ID NO: 502353 - DNA, 279 bp, Homo sapiens
  misc_feature (251)..(251): n is a, c, g, or t
gctgtgagccatctgcctccttagggactggctattatttcttcatcttattggtagagtaatgggtgcaacgcggcacagaccctttgtcaaatgtgctgaaaagctctgtgctctactcacccagaaaactgcctcatacaattgacacacattttgtacgcgattttcatgggggttccctggatttccctaaccacctttttatgtggtctcataccaacctctgtccttcgcgataaactatctcnaactcatagagagtgtgacatagagggc

SEQ ID NO: 502354 - DNA, 189 bp, Homo sapiens
ccgagatcccgccactgcactccagcctgggcgacagagcgagactccgtctcaaaaaaaaaaaaaaaaaaaaaaaatttttttcaaaaaggccatcaaggccataaacgggatttctcggccgggatctggggcaaaggtaaacttggaaaacctccggggaaaggaggtcaccatttctagggtacc

SEQ ID NO: 502355 - DNA, 869 bp, Homo sapiens
  misc_feature (263)..(263): n is a, c, g, or t
acgctgtcgcgccctttgggcgggttataaccgcgcgcccgcaggtcgtgttttttccgcgcctccttatatgggccctatgttctcccccgctgcgtagtgtgcagggccctcccagatctcatttgttgcgggggaaacccggccgccatactttcttggtgttggccggtcccccttatatcagaagcgttttcaccgtggtccgcgcgtccccggacatatttgtcgcccggggtttctcgcgccattatctcgcgccncgcgggtatattacgcctgggttccacctatataagacagcttggctcgtattgaacccctgctcactcgcgctccctgcccgctgcgttggaaacgcacaagtgtgggcgccccattcccaacagagggtttttccgcccccttcgggagacacacacggttgggcgccaaacaccctctatatgtttccaatgttcgcacacaccacattggcgccttcaatatcagggcaattatcccttcatcacccttcatccccataggtttgaacattattggccgccccccgcattgtattttcatcgccccactccacgatcacgttcgccgcaaaacacccacatgttgggatgacccaggcccccgcccctgccgctctgttttaggggcatgctccctccttgtaggtttggtaggccccagcgccccgcgcccctctgtttgtggccggtgtcccaccccctgttttcgcggaccgccctctagcacatcgccctgccctcttgtctccaataactcggggtcgtagcccctgcccccattcgctgggcctatcgcaggacgcccgcctattacgccgcggccccccttcccccaacaaaaca

SEQ ID NO: 502356 - DNA, 383 bp, Homo sapiens
ctctagagtgatcccctgccaaaggcgtagtacaatacgaatgtacttaatgccatttaattgtacacttgaaactggttacgatagcgccgtggtgctatgtgctcgcgcctgtaatcccagcactattgggaggccaaggcgagtggatcatgaggtcaggagttcaagatcagcctggccaaaatagtgaaaccctgtctctactaaaaatacaaaaatcagccgggcatggtggcatgcgccttgtagttcccagcttcttggggcggctgaggcaggagaatcacttgaccccgggaagtggcggttgcagtgacctgagatcatgccattgcaactccagcttggggtactacgccttatggcagggtaccgagctc

SEQ ID NO: 502357 - DNA, 134 bp, Homo sapiens
tgccctcctgaaaggagttgaactctaggcaggcagaatggtcccactgtccggtccatgggccccatggctcatcatcatcccaggacgcggaggcccacggagtctgtgtcacggggtcgaactaatgccct

SEQ ID NO: 502358 - DNA, 778 bp, Homo sapiens
tgggttatcaatattggggtttaatttaaaaacagggaaaaaaaaaataaatttcggaaaaataaaaatacggggcggggggaggggcccaggccggaacccccagattttggggaaggcggagaggcgaggttgggcccgcctggaccccaggagtttcgagaaccacctccgtcgccacccgcagtgagacccccctctcatacaaaaaatacaaaatttaccccagggttggtgggtggctgcaccgtgtagtcccagctactggaaaaggcatgagggtgggagggctcactctgaccccaggagtcgccaggtaacaggtggaccccctgagtgggccattttccctccaccgctgcgccaagcagcagccaagcactccttgttcctaaaacaaacaaacacaacagcacatttcgccggacagcgggcgcgggcacacgggggccgggcaaccccctagagcggcgccccgggcctcggagacacccactggcaaggggggggccccacaacgccgcggcacccttgcaacagcgcggctgccccatcccccagagccaagaccccgctgccgcgcgtacccccagagggggaacgtcgggggagccgacacaccaaccatcgccaacgtgcccggggtccccagaggccgcggcccgttgcagtatcaccgcaccccccgcgccggcataatacccgcccctggccgcccccagcagtgactacccggaggcctcttatcggccacacgagggactcccgcccacagggc

SEQ ID NO: 502359 - DNA, 475 bp, Homo sapiens
  misc_feature (66)..(66): n is a, c, g, or t
tacggcttttatcttgctcttgagagtttcccacaccttgccgagcttatcgaccagccacgtctntactccgttataaagcttggcgagaatgggcccgatcatgtcccagttcttccacaccagataaacggcgccgactgcagcagccatcccgccagcggcacgagcacaggcgatagggcaacaacaagcccggccagggctgggatggcaccggccgtgatgaccgaaactgagcggatggcgctcgcaacaggcacgatgacagggagaaagcgcccagcgcagagaccacggcgccgatgccgatcgccaccggacctagcaccgccgccaccccaccgatgatcgtgacccacttcagagtttccgggctgacctcggcgagcttatcgacaaagttcccaaggcggtgacgatcgttgtgacgaattccagaatgccagattgcgcgatcgtgatggcgagggtt

SEQ ID NO: 502360 - DNA, 228 bp, Homo sapiens
ggtctgtgctgggggtccggtggctggaacgctgagcagtcatggttcgccaggcaatcgtttcacttctgagagtctcatatgctcagatgagaaaacggaggctattgcaggaaggagcttctcatatttacacagccgaaaaactcctcagacaagcgcgcttcccatacgactcaccagaaccagcacaagaaaatcatacgcgagcaaaagaaccacacgggt

SEQ ID NO: 502361 - DNA, 265 bp, Homo sapiens
ttgccagggtttgggggggggtcatgggggtccccacccccctccccagggtttggggagttgaggagccaaccccacccccctgccaggatcccctcgggggtccccccccacccaaaaagggttttcgggggggggggtgggcagcgcctatgtttttttggaaattcctgcacccccaaaagaacttcccagggggccagggctggattttgcccctctgtgaggaacaagggggcccaaaaaaaacctttttgctttttta

SEQ ID NO: 502362 - DNA, 350 bp, Homo sapiens
ccacaggatatatgtgtcctgtgatagaggttagggtaaagagtgtgctccatactccaactttttttcagcagcaaaccccttaatgcaaataaattcttaccttgaaccccaatatgtaagacagctacaagggaacctgttctgttagaggcgcaaattgcacagcttgctcagctccccacccctttcatctccccaaggactcttgaggcaaccctataggaaactctcagggctctgccaaccagtttgaaaaccagtggcatagtttgtcctgagcaagtcagagaccccacaccacaagtgcgtgccacaagctggctcagagtctgtggtgtcacgcgtgc

SEQ ID NO: 502363 - DNA, 222 bp, Homo sapiens
cctaggaggagaacttttactatacctatttgaatctacagcatcctgcagatgatggtacctaacttgtgtatgcatgttgatttatacatgaaagacaagatccatcttctattagaatcaggctgagcctcgatatacacatatgatattgccaaactgatgtgagtaccactgtatgaactaaaaacagaatgattaaaagattaatttaaaggaagg

SEQ ID NO: 502364 - DNA, 366 bp, Homo sapiens
  misc_feature (5)..(5): n is a, c, g, or t
  misc_feature (47)..(47): n is a, c, g, or t
  misc_feature (237)..(237): n is a, c, g, or t
ttaancctatatttataaacttgttttcccaatagtctgcaaaaacnttaaaaagtaggaagaagccagccacagtggctatcatcccacattcacagtggcctatcatcccagcattctgggaggctgaggtgagaggatcactagagcccaggggtttgagactaatgtgggccacataatgagacccccatctctacaaaaaaattaaaaaattagctaggcatggtggcacanacctgtactgccagctactctggtggctgaggtgggaggattgcttgaacccaggagtttgaggctgcagtaagctaggattgcaccactgcattccagcctgtgtgccagagcaaaatactgtctcca

SEQ ID NO: 502365 - DNA, 794 bp, Homo sapiens
aaataaaccccttataccgggggttttttagacacgcaaacccccctataataaggggagcccccttttgtatgagggcattttcccccggaggggggtttccctcccaccttaaaggagctgtttccctctttatcaccttctaagcagcgaagtggaaggctgctttttactattttgtgacaagccgttaggggctcacccgccatctttttagagggggtacttccaattttccccccccgcctggatgtttcccccttcgttctcaagaaacaatgtggtgtgtgaaccatcggaaaagaatcccccatgaaacccccgcgttcctcttttgtccttaacattaagcccgtgcccacaacctgtgacaaccggtggccgagctttaagtgtttcatgtcattgaacgttggccccgtgtgtctatcatcgggagccacgcagtcattatactataaaagcttcaagcggaacaaaatgtctggctcaggcatgtgaatatagcagccatctgctttgatatggctgtttgccaggtcctttgcctgcgtccaaatgttccactcacccagtgtcaaactcaccaaagttagtaatgacggtcgtgcatcataacgcttcatagagaatacgtatggtctcgttgcatgtccgccagtagttttaccggcaagaagggtttctaagcttagtgttgcccagtgttctcgttccctgtagcccgattcgttcagaggtgcatgtcccacctcaccttatgttgcagccaaaggtaccaatcaatgcccttg

SEQ ID NO: 502366 - DNA, 412 bp, Homo sapiens
gctcagggtgtgatatcaggtggcttccaaacttgtcggcagtttaaagatggtgggccacgactccgccttttccgagtgaaccccactgacagaataaggagcatttggatctcttggtaaaggccatgtggtataaagcggtccaaaagaagtcctccatgttggtgcctaggacttccgaggggagatacagatgttatccagcttgaccggcatggagagaccccgtctccattacaactacaacatcagcctggccatgtggctcttgcgtcctgtcccttaaagttcataggcttcggccgataatttgttttgtgtcagcttttggagttttctttggggcatcatagcatgcttgatcttgcccgattgggttaccagtattaaatgccgtgtcttcttagaa

SEQ ID NO: 502367 - DNA, 146 bp, Homo sapiens
tggtgtagctgttctagaggataccctgatcgccgtgcagactggcccgtgtccagtcgcagcgcttggagtgaggcgttcaccagtccgttgttttgatcgaaaactgccgagaagatggctgccacgactgacgatggacagca

SEQ ID NO: 502368 - DNA, 122 bp, Homo sapiens
gatgtcgctcttctgcttgtcatgcagctgatcatactgcttcacaatgagcagaaaacagctttctagatcagtacactaacccagccagaattgcaaaatgtactacagcgcttcacaag

SEQ ID NO: 502369 - DNA, 548 bp, Homo sapiens
tgcacctccacccgccggtcgctgctgacctcagcccttcaaagctgtcctccagttggtctggggtgcctcatcctgctgggttcctcctcccgccctcctcacctgcctctgcacctgccacagggcatcaccacttgcgggtgaagccagcctcctgggagggaggccctgagctgatgggttgtccaccggtgcaggcgcacaggctgggctcacacaggccccaggagtctgtggcaatgccctggagtccccggagcctggcactgtctggatatccatgacggccactcctctcctcgggcctgagcctgccccaccccggaagggctgccccccgggtcccctgtggctgggcatccagacccactctccccttcatgtctgatgtgccccctgcccccaggcacgtgcaggaagaagcacagaacgtggctggcacccgccctgaggcccggctctgttcccatcttctcttttcctaaagagcggcaagggagcctgtgacccgtggccacgtggctgcccccttggacccgcggccg

SEQ ID NO: 502370 - DNA, 752 bp, Homo sapiens
ggagagagcttcttatagccgccctactgtctattctagattccttaggtcccctccgtctcacctccatgcctttgtgtggcggccggaagaagacagggcgaaggaagaggaggaggacgaacgacgaatacgagggaaggatgtgtttgagttgctttatgccttcacgttaaggctcactggtacctataggggaacctgagctgttcagtaggtgatcagacagcacttagtggacttgggcaagtggtgctttgtgagttttatttgtggaaggaggtggggatgagaagaggatcaaatccacttatttgttcttgtttgtatacccgagcctaggaagaacgtccaacgggtagcaaacaggctgctaggccttactaggccacggacgcacactagtcccgtgcgcaactacaagactctacgcatcgacttttctgtcgacttgccagtgctgcagtgtatgccacaggcagcccttgagatacagactgcgctcgttgcccggtgcgcaccggataatactgctcgttccaacacatatccaccaccctcctcttacaggcgtggcacggcctcttgcgatagtcacgtttacacttctctcactgcctcattccacccgctcccctccccatttctactcaactgccgcatagagagctccgcttgcctctacagcggtcccacgagactacccagtccaacccacactcgcgcctcgtgccccagccgtaacaaccggc

SEQ ID NO: 502371 - DNA, 676 bp, Homo sapiens
tgggtcgtagcggaatcgggggtatgctgtccgaatccataaaaacagggaggttaaaagtagggtctgggtgacaaaatatgtggtgtaaagtccaggggaaagtgcgtcatatgtggtccctaggaaaatggtaggggtgagggtgtaattataataaggttggtgtatccggctatgaagaatagggcgaaggggcctgcggcgtatccgatgttgaagcctgagactagttcggacctccccttcggcaaggctcgaagggggtccggtgggctctctgctaggtggtggagataaactcatattatggccaagggtcatgagtggcaggagtaactcagaggtgttctggtgtggtgataagggtggagaggttaaaggagccacttattagtaagtgtgtgatagctagaagtgagggctaggggtgacttcatatgagatggttggggctactgcccgcagggcgccgatcagggcgaagttggagttggaggctcacccggatcagaggatggagtaaaccggctaggctaaagggggctagaataaataggaggcctaggtggaggttgaccagggggttggggtatggggagggggggtccatagtaaaaaaggcgaatggtgagagcaagggcggggcgggaatgacaaggtgaggaaaatgggg

SEQ ID NO: 502372 - DNA, 704 bp, Homo sapiens
cacttgaggtcaggagttcaagaccagcctgggcaacatggcgaaaccctgtctctactaaaaatacaaaaattagccgggtgtggtggcacttctctgtaatctcagcttctcaggaggctgagacaggagaatcgcttgaacccgggaggcagaggttgcagtgagctgagatcatgccactgcactccggcctaggtgacagagggaaactccatctccaggaaaaaaaaaaaaaacccaggggggttaccaattcaatcaacctatttgggaggcatatcgggggcctaactctaagaagttttaaggtacggtgcggggacaccatttttaaaagggaaatcagggggctagaaaaggtatatggggctgggtagggataaggtccataacgttcagtggtacttcatggcctccttataattggaagtcagatggggaaccattaaagatccaactttcgcggtcgggtaatagaaggtaaaattctagaggtcattaactttgggaaaaaggctggttttaagcaattaaatttagaagttggcaaatagggtgccttgctaagaaaatataatcgggggagtggggataggctcaacgtaacgtcttcaggagagggtgtaactgggggaagatgctcatacttttcgcgaagggtgattgatccccacatataggatgaatctgaggggaaactg

SEQ ID NO: 502373 - DNA, 115 bp, Homo sapiens
atgggagccgaggctgtcgggccgaggggaaatgatatactggaataagaataatggagaactcctgctcatatacagcaagtactggactttgttcgacaccacgaacataaca

SEQ ID NO: 502374 - DNA, 128 bp, Homo sapiens
cccccccccccccccggggttttttttttccccccctttgaaatttttttttttgggggaccccggggcttttttttaatttaaaaaaaaacccccccccccaacccccaaaaaaaagggggttttta

SEQ ID NO: 502375 - DNA, 130 bp, Homo sapiens
agtgcagtggtgagatctcggctcagtacgagctcgctcgcgggttcacagcatttgtcctgcctcagcctaccaggtagctgggacgtgcaggcgcctgtcagtcacgccatggtctaagtttgcgtat

SEQ ID NO: 502376 - DNA, 959 bp, Homo sapiens
  misc_feature (8)..(8): n is a, c, g, or t
  misc_feature (21)..(21): n is a, c, g, or t
  misc_feature (41)..(41): n is a, c, g, or t
  misc_feature (43)..(43): n is a, c, g, or t
  misc_feature (52)..(52): n is a, c, g, or t
  misc_feature (56)..(56): n is a, c, g, or t
  misc_feature (61)..(61): n is a, c, g, or t
  misc_feature (82)..(82): n is a, c, g, or t
  misc_feature (84)..(84): n is a, c, g, or t
  misc_feature (88)..(88): n is a, c, g, or t
  misc_feature (93)..(93): n is a, c, g, or t
  misc_feature (111)..(111): n is a, c, g, or t
  misc_feature (116)..(116): n is a, c, g, or t
  misc_feature (123)..(123): n is a, c, g, or t
  misc_feature (125)..(125): n is a, c, g, or t
  misc_feature (127)..(127): n is a, c, g, or t
  misc_feature (130)..(130): n is a, c, g, or t
  misc_feature (135)..(135): n is a, c, g, or t
  misc_feature (141)..(142): n is a, c, g, or t
  misc_feature (164)..(164): n is a, c, g, or t
  misc_feature (177)..(177): n is a, c, g, or t
  misc_feature (184)..(184): n is a, c, g, or t
  misc_feature (194)..(194): n is a, c, g, or t
  misc_feature (210)..(212): n is a, c, g, or t
  misc_feature (214)..(214): n is a, c, g, or t
  misc_feature (217)..(217): n is a, c, g, or t
  misc_feature (229)..(229): n is a, c, g, or t
  misc_feature (237)..(239): n is a, c, g, or t
  misc_feature (244)..(244): n is a, c, g, or t
  misc_feature (248)..(248): n is a, c, g, or t
  misc_feature (256)..(256): n is a, c, g, or t
  misc_feature (259)..(259): n is a, c, g, or t
  misc_feature (263)..(263): n is a, c, g, or t
  misc_feature (267)..(268): n is a, c, g, or t
  misc_feature (270)..(270): n is a, c, g, or t
  misc_feature (283)..(283): n is a, c, g, or t
  misc_feature (299)..(299): n is a, c, g, or t
  misc_feature (301)..(301): n is a, c, g, or t
  misc_feature (303)..(303): n is a, c, g, or t
  misc_feature (309)..(309): n is a, c, g, or t
  misc_feature (312)..(312): n is a, c, g, or t
  misc_feature (314)..(314): n is a, c, g, or t
  misc_feature (322)..(322): n is a, c, g, or t
  misc_feature (326)..(326): n is a, c, g, or t
  misc_feature (330)..(330): n is a, c, g, or t
  misc_feature (335)..(335): n is a, c, g, or t
  misc_feature (352)..(352): n is a, c, g, or t
  misc_feature (362)..(362): n is a, c, g, or t
  misc_feature (372)..(372): n is a, c, g, or t
  misc_feature (382)..(382): n is a, c, g, or t
  misc_feature (387)..(387): n is a, c, g, or t
  misc_feature (404)..(404): n is a, c, g, or t
  misc_feature (432)..(432): n is a, c, g, or t
  misc_feature (442)..(442): n is a, c, g, or t
  misc_feature (444)..(444): n is a, c, g, or t
  misc_feature (455)..(455): n is a, c, g, or t
  misc_feature (465)..(465): n is a, c, g, or t
  misc_feature (469)..(469): n is a, c, g, or t
  misc_feature (481)..(481): n is a, c, g, or t
  misc_feature (503)..(503): n is a, c, g, or t
  misc_feature (506)..(506): n is a, c, g, or t
  misc_feature (509)..(509): n is a, c, g, or t
  misc_feature (618)..(618): n is a, c, g, or t
  misc_feature (934)..(934): n is a, c, g, or t
ggcccacnccggggggctgcncagaaagcagaggcccagcncngaccagacnccangccanggcccgagaccctcacagccncngggnaggcngggagccccccaatccanggccncagggcnangngantgagnggggcnngggcccccccagcgcgagcganagcaacaagaccnggagganggaacagaangggagagccacggggnnncngcngaaggagaacancaggcccnnncagcncgangagagcancgngacncccnngnaccaggacaccangggaccctcccagcangncnatgccnacncncaagaaanggcncccncccangccccagagcggcatcnaaagcacatnggcaagaccngggcacagcnggagngggggcctgagcccccngagcgggggaagagcccccttacccacnacaccatctncnggaccaacgcncagaaccagncctnctccgccatccngaatgcctccgcccgcgggctntgnccnccatggcctggagcccgccagtctgtatcacatccacctcatggctgccagccaggctggggccaccaacagtacagtcctcaccctgatgaccttgaccccagagggncgggagctacacatcatcctgggcctgttcggcctcctgctgttgctcacctgcctctgtggaactgcctggctctgttgcagccccaacaggaagaatcccctctggccaagtgtcccagacccagctcacagcagcctgggctcctgggtgcccacaatcatggaggaggatgccttccagctgcccggccttggcacgccacccatcaccaagctcacagtgctggtaggaggatgaaaagaagccggtgccctgggagtcccataacagctcagagacctgtggcctccccactctggttcagacctatgtnctccagggggaccaagagcagtttc

SEQ ID NO: 502377 - DNA, 556 bp, Homo sapiens
  misc_feature (404)..(404): n is a, c, g, or t
gggaggagtggccatgtcgcgcttgaacacatgcgagagcacatatcgcgctatgcgctaaggccaacagtccctacagtcgagctgtcttaacctacagtaccattgacattattccaagaagatagcgacatgtgacctattgcagcactgcatgattctgtaacgaggacttgcacatcaagtttctccggctgacttcaaccacagtcagatttttgtagccgttgtgtaagacttaactagtccagtgagagcagccgttgacatgcctgacacaaatgacgtcagtattgttggatacatgtacgctatccgcaggaaggcgtagtgatgtttttaacagtagctaataattaccacatggcactacatatctatgagttgacgcactgctgtccagnccaaatatgcttacactataaatgtttcttttgatttcacatgttcatttaccctccaattgttaaaccttctctacagagtgagttttattaagaatacttcaggctattcgtgcaccacgaggtagcgtatttatggttatattatgtgg

SEQ ID NO: 502378 - DNA, 204 bp, Homo sapiens
cgcattttaggccactagtctgtgactttggacaggagatatttgggaaatgtaaactacttaaatggttgggagaatgtgtatcgggaataatgggaagtaaagctgggacatcgttttgagacgcagtctatcttttaattttcccctgggtccagcatggtatctttggatttcttaaggtttttatcacatgtttggtta

SEQ ID NO: 502379 - DNA, 622 bp, Homo sapiens
ggaagcttgaaatgcatgtggctagatttatgctaaaatgattctcaggttagcatttttagtagacacttcaaaggtttttttttgttggttttctagaagtgtaataaaagcttaggagttaatttatgaaggaagcaagtacataggttagagatgtgtcccagtattgtagtttggatttgtcctgtgaagtatgttgtttcatagttatgtggttgaaaaaggatttagaaatgtcatgtgcactgtggtcagaataattagtaagatatatcttatacaatgttggattccctgtccttgcatagtttttattgcaggtagatttgcgttgggcatcaggtggagtgcaccgaagaggatgaaatgattcttcgaaaaggctatagagtccgaaaggaatgatgtcttttgacaccgaattgtcttcctttaaaaatctgtgaggaattggtgttggccttactttttcattcattctgctcacaatgctaagtggtatccgaggttcttaatatgagatttaacaatcgttaaaatgtttcttattttcagcacttacatcattggtacacagggtcaaatagggcaaataagttgtcttgtatactagattgag

SEQ ID NO: 502380 - DNA, 588 bp, Homo sapiens
  misc_feature (9)..(9): n is a, c, g, or t
  misc_feature (111)..(112): n is a, c, g, or t
  misc_feature (114)..(115): n is a, c, g, or t
  misc_feature (118)..(118): n is a, c, g, or t
  misc_feature (167)..(168): n is a, c, g, or t
  misc_feature (180)..(180): n is a, c, g, or t
  misc_feature (188)..(188): n is a, c, g, or t
  misc_feature (250)..(250): n is a, c, g, or t
  misc_feature (285)..(285): n is a, c, g, or t
  misc_feature (289)..(289): n is a, c, g, or t
  misc_feature (306)..(307): n is a, c, g, or t
  misc_feature (316)..(317): n is a, c, g, or t
  misc_feature (466)..(466): n is a, c, g, or t
  misc_feature (556)..(556): n is a, c, g, or t
caaatgacnaagctcgcaaagctacacaaccacatacaacccgcaacccttcgaagccacacaaaccgcaaaagaaaaccaagaaccttcggaccccggaccccccccccnncnnccncaagagcagcaagaaagccagcagccggagcccagccggggcgaaggcnncgccgagccggnaacctaancccaacaaaaaaaaaagaaacaagcccagaaaacatcaaaaggcagcagaaacgccaagccnaaacagccccgcaggagaaaaaagaaaaagaaacnaaanaagccaagaggaaagcnngaacagganncggccaaaaacagagggcccaattccttaatgaacccaaaaaaaagggggtccccaacaaccaggcctggcctcctggtgtttgcggtcacagtggcccctgggcaggggcacccaggctgacccttaggtgctgctgctgggtctgtnttggctttggggtgtgctgggagggtcaccaggtcccttttccttcctgtgccctttgaaagctaagtgtttgtgtggctgtggagctcnagggtctgtgaataaaggcggcggccctggga

SEQ ID NO: 502381 - DNA, 914 bp, Homo sapiens
  misc_feature (37)..(37): n is a, c, g, or t
  misc_feature (40)..(40): n is a, c, g, or t
  misc_feature (50)..(50): n is a, c, g, or t
  misc_feature (52)..(52): n is a, c, g, or t
  misc_feature (188)..(188): n is a, c, g, or t
  misc_feature (404)..(404): n is a, c, g, or t
  misc_feature (494)..(494): n is a, c, g, or t
ctccccggcctccggaagatcaggatcaggagggganaanaaggagcctntnctgcctcccaggctgctgggactgggctggttttgtcctttgaagtggtcaggatacaggacaagggcagccccaccccatccagcctgggctccccgcagacccttgctgctcccgtggcctggacacgctgggnagcttctcacacctacccctaccgtccagcctggcctcttccctgaatcagcttcaagatggcaccagctctttgggcctaggatactgccgggcccccccaaagggggttcccccgagcaaacacagggtgtgcgtctgctgttgtctgccggtcacagtggcccctgggcaggggcacccaggctgacccttaggtgctgctgctgggtctgtnttggctttggggtgtgctgggagggtcaccaggtcccttttccttcctgtgccctttgaaagctaagtgtttgtgtggctgtggagctcnagggtctgtgaataaaggcggcggccctgggaaaaaacaataaaccacaaacaaaaataactaataaagcaacacaaataacacaaaaaacacacttcaattctccaatacatcaatgactcctccacctacaccacaatcagacaaacacgagcggcgcgcccggccacatactaataacctccccgtcggggcgggaccacacacccacatgccgacccatcaatgatctcatgcccgccacgggaggccccctctatagaggacgacacatcctaacatcgctcgcaccgcggcgcctatcacaaccagcgagagagcagcaacgcgctcctcgatcactgctgcgccgaccccactcgcggcgcctgcccgcgcaacaccacaagaagaacccgagccaacacccgtgtgtgctcc

SEQ ID NO: 502382 - DNA, 253 bp, Homo sapiens
  misc_feature (37)..(37): n is a, c, g, or t
  misc_feature (40)..(40): n is a, c, g, or t
  misc_feature (50)..(50): n is a, c, g, or t
  misc_feature (52)..(52): n is a, c, g, or t
  misc_feature (221)..(221): n is a, c, g, or t
ctccccggcctccggaagatcaggatcaggagggganaanaaggagcctntnctgcctcccaggctgctgggactgggctggttttgtcctttgaagtggtcaggatacaggacaagggcagccccaccccatccagcctgggctccccgcagacccttgctgctcccttttccttcctgtgccctttgaaagctaagtgtttgtgtggctgtggagctcnagggtctgtgaataaaggcggcggccctggga

SEQ ID NO: 502383 - DNA, 673 bp, Homo sapiens
  misc_feature (335)..(335): n is a, c, g, or t
  misc_feature (551)..(551): n is a, c, g, or t
  misc_feature (641)..(641): n is a, c, g, or t
caggctgccccatcatggcgtctgggccctgcaccctcctgccctcccccagccacctggctgcatttttgaagctgcctggcccccaggcgcctcgtactctgaccgtctctcgctctccctctcacgcctccttgccccttggcacgcgtgcaaggactcgagtgagcggcgtagagagacatggacgccatcgtgcatgcctcccaggctgctgggactgggctggttttgtcctttgaagtggtcaggatacaggacaagggcagccccaccccatccagcctgggctccccgcagacccttgctgctcccgtggcctggacacgctgggnagcttctcacacctacccctaccgtccagcctggcctcttccctgaatcagcttcaagatggcaccagctctttgggcctaggatactgccgggcccccccaaagggggttcccccgagcaaacacagggtgtgcgtctgctgttgtctgccggtcacagtggcccctgggcaggggcacccaggctgacccttaggtgctgctgctgggtctgtnttggctttggggtgtgctgggagggtcaccaggtcccttttccttcctgtgccctttgaaagctaagtgtttgtgtggctgtggagctcnagggtctgtgaataaaggcggcggccctggga

SEQ ID NO: 502384 - DNA, 124 bp, Homo sapiens
gctcagtagttctttatagcagtgtgaaaacagactaaggacccttcgggttgaaggaatgtagccattcgctggttgactacttcctttctattcatctctatttcccgggaggtgtttatcc

SEQ ID NO: 502385 - DNA, 355 bp, Homo sapiens
tccattctggcacgctacgcatcctcttcccagttcagcggcagtaatgtgtgtgggaaaccgggatgctgtattaatccaaaggaagatcatgtctgaaacatcagctagtcatcataaacatatacttctggcgggtaggcatgttacagccctggaggcataatatactgattatggccacaacggcgggacccccggaaggcggtcgggaggacgcttttcctgaagtcgtagcgtctgagcttcgagtcgtgactgtgacagccctgtcgctgcctaggctgaggcccaggctactgccactattgagactggaggagacactgaccactgggggaggtgcagagactgt

SEQ ID NO: 502386 - DNA, 189 bp, Homo sapiens
tcaagcttctaacgatgtacggggacatggctaggccggaggtcattaggagggctgagagggcccctgttaggggtcatgtctgtaataccagcactttggaagactaaggcgggagaactgcttgggcccaagagttcaagaccagcctgggcaacatagtgagacctcacctccacaaaaaattga

SEQ ID NO: 502387 - DNA, 839 bp, Homo sapiens
caaggtcttgtcccacgagtacaactgagcagcgcagcagtgaacctggggtctttgccctgtggtctctgatggctttgttgttgggtatgctgttcacgacaggctggataggctgcaatgtctcttcctacccagggccgcaatgcccgggagttttcatccaatgtgtggagaaggccttagaagacatgttttgatagccttagaaggcaatatccatcaaaagtaacttgtgggcagatgaaagagctaccatcactttcctcatcatgaatatactgggagtgccgggcatggtggactcatgcgctgtaagtcccatgcagttttcgagaggcctgagagcgggtggatcaccttgaggtctaggagatttgagacacaacactggccaatacataggtgaaacctctgtactctacctcacaaatacagagagagattagcatgggatgtgagtggcatgtcgcctgatgagatcgccaggctaacttgggatggttgaagcagactaacttgctctgaaccccacggatggtggagagttgctagtgagtcttgtagatcacacacacatgcatcataacaggacctgggcggagcagagcgagactgtcgtcggaaaactaaaagaaaaaaaaactggggcctgtgtagccagtgggtgctattctgtgaaactaatcataagctgcctaggcagccagctacaggcgttgagctataaattcatggttttaaagctaaacgtaatttccacgtggggactagatcacaactgaagataacaagagatttaagttttaagggcattaatcagtacgaccaggttggaa

SEQ ID NO: 502388 - DNA, 409 bp, Homo sapiens
agttatatttttttaactcttatttcaggttcaagggtacatgtgcaggtttgttatataggtttgtgtgtcttgggggtttggggtttggtgtacagattatttcaccacccagtaataagcatagtacctaataggtaggttttttggtttggtttggtttggtttggtttgtgacggagtcttgctctgtcgcccaggctggattgcagtggtgcgatctcggttcactggaaccttcggcttccaggttcgagggattcttctggctcagccttcctattagctggaattacaggcatgtgccaccatgctgggctaatttttgtattttcagtagagaccgagtttcatcatgttggccaggctggtctcgcccctgaccttgggtgataccctgtcttcggct

SEQ ID NO: 502389 - DNA, 851 bp, Homo sapiens
gcccaaacccactccaccttactaccagacaaccttaagcaataccatatacccaaataaagtataggcgatagaaatcgaaacctggcgcaatagatatagtaccgcaagggagagatgagaaaattataaccaagcataatatagcaaggagcctaacccctatgccttctgcataatgaattaactaggaaataactttgcaaggagagccaaaggtaagatccccgaaatcagacgagctaccgtaagaacagctaggataagagcacacccgtctatgtagcacaagatagtgggaagattgtataggtagaggcgacaaacctaccgagcctggtgatatgctggttgtccgaagatagaagtcttacgttcaagcgtttctaacatgtagccacagtaacctctaaatccccttggtaaagtcttagactgttagtccagagaggagacagctgcttgggacagctgaaggaagaaaaaccgttgtaggagagagtaaaagatttacgacccatagtaggcctgaaagcgagccagcgaaggttaagaacagcgttcaagctcaatacccactactaaaaaatcccaaacatattactgaagtcctcacacccaatttggaccaatcttatcagcctcatagaagaactaagtgttagtataagtaacatgaaaaacattctcctccgataagactgcgtcgagattaaaacactgaactgacgaatgaacagccaatatctaagatcagcaacgagttcattattacctcatgtaaccaacacaggctgctcatagaaggttcaaaaagtaaggactgggaatcttacccgctgtgtcaaaac

SEQ ID NO: 502390 - DNA, 688 bp, Homo sapiens
cgagccgtggcaccggcatcggctgacactgctgcctccagctagttatttctgtcctcttccgttcttcacccctacaccttgtgagtgtgaacttctcacctgagtggctgtaaatgactcgtttgaaaatggagatgccaatgaaccaacggaatcttctcagaatggcaaacatgtatatcatttcagatgtgagttaatttcatgaagtgaaaatggtgtcaatgcttgaaaaaacaacgtacatggatcctactggtaaaactagaacttgtggaatcatgtgaaactgtacaaccatggaaatgatgcagacttgcgtgatgtgtgtctgctgtgtcatcccctgtgcttgcatgatgaacacttcactatgatgttgtatctgttcttggtgaaacatgttccgaccaccaatgggtgggctacttgcatagagttccctgcagtgtctcatagatgatgtgtgaaaccccagaagcagctgctctccgtggagcttgcaagaagaaactggctacaaatgtggtgacatttgccgaatagaactaccatccgtgtctagtatgtgacccagtgcttgtacaacacatgtaactatacacatctgtgacatgtcaccattaacggagatgatgccgaaaacgcaagggctaagccaaaagccagggattggcagagttcg

SEQ ID NO: 502391 - DNA, 104 bp, Homo sapiens
cagtatgtatcgaatgcggtatctgttatgatattatatttcgttaaattaagaatggttatgttagggttgtacggtagaactgctattattcatcctatttg

SEQ ID NO: 502392 - DNA, 883 bp, Homo sapiens
tccttctgggtgtctactattatcttagtggggatccacctcacataccatcatctgtctccaaacgaaacgcttctttattatcaggggtcatttctccttctgttgttttcctcccccgcagaaagatttattgttttttttcaccccaagcttttgtttttcggacaccgtttttttccacccatcctcattcattgtgctctcctcctctcccccccctgattggcggcgcgccttttgctcgcccctcctccacggggttgttctctcctccccagtttatttactctcctccttcgtactgattggtgtcccccccttgcttttgatttacacctcctccgctttttttttttctccttcctcgcgcgagcgagtgtttacatttctccctcgcgggttgtcccccccctctttgtttttatttattagggataccctccccccggcttccccccactaatttttttttcgtcccacaccctgcttgtgtttttatacacacgctcttttttctctctggggggtgtgtctttttttctatcccctcctctccctccccctcccccggcggtttttgtgtgtttcccctctccccttttgttcgcccgcggatgctttttctgcggtgctacacacactactcttttttggttgaccccgcgctgttctcccccgaatttttccctgctatttttgtggggcacatcttcttcttctcatctattgttggtttgtcccccccacaatgatgtttttcttctcttacaccccaccaccaccactacttgtgtgggttgttgaaccccccccccattggccctttttataaaaggggttgtttttttttttttttccccttttttgggggggggtttta

SEQ ID NO: 502393 - DNA, 315 bp, Homo sapiens
  misc_feature (208)..(208): n is a, c, g, or t
  misc_feature (210)..(210): n is a, c, g, or t
  misc_feature (213)..(214): n is a, c, g, or t
  misc_feature (219)..(221): n is a, c, g, or t
  misc_feature (224)..(224): n is a, c, g, or t
  misc_feature (227)..(227): n is a, c, g, or t
  misc_feature (241)..(241): n is a, c, g, or t
  misc_feature (243)..(244): n is a, c, g, or t
  misc_feature (258)..(258): n is a, c, g, or t
  misc_feature (268)..(268): n is a, c, g, or t
  misc_feature (278)..(278): n is a, c, g, or t
ttacatttctttaaacctgttttactactatggcactttgataaaatgtcaggaaccaactttactggcaaaaggtccatgtaccaccagtgctggagcatctgttctacatgtggatatctatgaatggtaatgttttccttcatgtaagtgcctattcagagtttcagaattttaaaatgccaatattttcatggtcatttgcatntngtnngctgnnntanttnaaagagattttgananncaattgtatttaancagcctcaanttgtgcaacnatgatgtataataaagaatttgtagcagaagaaaagg

SEQ ID NO: 502394 - DNA, 118 bp, Homo sapiens
gcccttttctccgtcactatctacctctccctagattacctccagcatactatcaatctcacccactctctacctcactgcctccatgccttctactagcaaagaatatgttggctat

SEQ ID NO: 502395 - DNA, 464 bp, Homo sapiens
actagggcagacgtagatacattcgagtgcatcaagagtagtaacagagagacagattacactgaccatcgctctctacgctgcctcctagattacttctccagtaatattcatccctgtagcattgttcgttccgtggtccatcatagacttctcactgtgatatatcaactcagacccatacattaatcagttcttcaaatcatctcactccacttcctaattaccatcataatcttagttaccgctcaacaacctattccaactgttcatcggctgaacgggcgtaggaattatatccttcttgctcatcagtatgatgatacgccctgagcagcatccaacacagcagccattcaagcaatcctatacaaccgtatcggcgatataggttacatcctcgccttagcatgcttgctcctccacacagacatggcccttctgtttcaggttggtgccacagt

SEQ ID NO: 502396 - DNA, 554 bp, Homo sapiens
tattttccctcaaaagagaactgtagtttatgaaactgtagttttggctttggatgaaagggcatatgaaaagactttaagaccaatcatatgaggaatatttagagcatggagatagtaatgaagattgcggaaatgttaagagatttaaatcttggtgaaatgaaaagtggagtaccagtgttggcagtatccttagcattggaggggaaggctagtcatagagagatgacatctaagcttctttctgacctttgtgggacagtaatgagcacagctgatgtgtcaagaatcatttgagtaaatcgttgaaagatctacctgaattagcactggatactcctagagcaccacagttggtgggccagtttattgctagagctgtcggagatggaatgtcatgtaatacctatattgatacttacaaaggaactgtagattgtgtgcaggctacagctgctctggataaggctaccgtgcttctgagtatgtctaaaggtggaaacgcgtaaagatagtgctgtggggctctggaggtgggcagcaatctgtca

SEQ ID NO: 502397 - DNA, 851 bp, Homo sapiens
tatgaagctgagaaactacgtggagctgccaaggtcaggcaaagacccctgactccactagttacttgcgctatgctagagtgtatctgtcctgtgctgtctataggatcggagtgaagcaccaagcgggacttgaaagctgcacagcctgtaaattacctttattcaattaatgcacaaacaaacggggagatgttggaggccgaaggaatgagggtcgtgaccaacgtcagtataccactggaggctctgtgagcaagacagcaagactgttctcatgaaatgccggatgtctggcgaactgagcaaaactctgtctgccgccaggaactggaatgctagggggcagtcatcgtcccaggtcccgatgctccttgaggttatccaacatgtgaacatccagaaccttgttgaacaacagaaacggaatcatgtggggcctgtgttaaatcacaataggctgtaccgacagattataccctttccgtccctattcacgtctaagcctaagtacactagtactgacagggctgtcacaaggctcagtgtcccgtgtttccccctaactactcaacggaagacccctctgaccccgttctattacaaaaccagaattgcttttggtcagtgtctccaatttctggcatttcggtcgtccctctcggttcgggtccagacagacaaccggcggaaaaggtaccctgcactgtgttcgactgccaccgtggtattgtgccggggtgttgaccctcagggtgtggtgaggtaatcccctcataacccctttatcattccttgcctaattcgctctccatccagcctcttgcaaagcacgtattccacgtcatacg

SEQ ID NO: 502398 - DNA, 708 bp, Homo sapiens
  misc_feature (586)..(586): n is a, c, g, or t
  misc_feature (589)..(589): n is a, c, g, or t
tatgaatgtaaaaagaaaagattaaaaatacaaataagattaactcagcttccaaagttcatatagggtaagaatttgcattgaaaatctgatgaaagtgtttgaactctatgttctctcccaagagtcatactccttttaaaatttgctaacagcgaacttcatattttaatttaacattgagctgaagcctctaaaagtgacatttctacatggaaggtgtgccagattcctggagagggcatatggaatgtgcggaatatgagcaacctgtttgtaggcatctggaggcactggaaaagggatgaggttaacctgaaaaccactggattcaggattagagtagcctctcttgccgctgatcctgaagttgtatcttatggaagcattgtcagaccacagaacgcttgctactgaaaacacagggctgaattaataattgctaatctatattttatttatgatgtgctagtcagtgttgtaagcacttgatgtattatttcatttaattattacaattcccttaaaatgggtgcaattgctatctctattttataactgaagaaattgaagtgagcttaaatanttngtagaagttcacgtatctcataagtggtacacctaggatttgaactcctgttcgcacaaagcatgtatcgtaacttgttatttgttgtttgggatgagtggtttgaggggaagatcctg

SEQ ID NO: 502399 - DNA, 116 bp, Homo sapiens
  misc_feature (20)..(20): n is a, c, g, or t
tgatgatctgcggagcttanaatagcgagggtgtcgagcaagttgctgggaggagagcagacacttgacactgcatttatctttgatttgtggtttttattctctgtggataggtt

SEQ ID NO: 502400 - DNA, 251 bp, Homo sapiens
tgtggctacttacgctcgcgactacgccgtgtggtcgcttacgcagaagatggcgaccatcgtgccggtcatcacgatcacggccccgcagtcccggccgtcgctctattgggcggcgcgtctctacgaagatgtctaccgagccgaagagctggccgaccgcaacgaggtcgcgtcaccagccttcatgcctggcacattcgaggcgctcgcgcggtaaccgtgcgggcgtcctcgccagaggatcagcc

SEQ ID NO: 502401 - DNA, 331 bp, Homo sapiens
  misc_feature (10)..(10): n is a, c, g, or t
  misc_feature (12)..(12): n is a, c, g, or t
  misc_feature (56)..(56): n is a, c, g, or t
  misc_feature (67)..(67): n is a, c, g, or t
  misc_feature (78)..(78): n is a, c, g, or t
  misc_feature (149)..(149): n is a, c, g, or t
  misc_feature (152)..(152): n is a, c, g, or t
  misc_feature (157)..(157): n is a, c, g, or t
  misc_feature (160)..(160): n is a, c, g, or t
  misc_feature (165)..(165): n is a, c, g, or t
  misc_feature (170)..(170): n is a, c, g, or t
  misc_feature (173)..(173): n is a, c, g, or t
  misc_feature (232)..(232): n is a, c, g, or t
  misc_feature (235)..(235): n is a, c, g, or t
  misc_feature (249)..(249): n is a, c, g, or t
  misc_feature (294)..(294): n is a, c, g, or t
  misc_feature (314)..(314): n is a, c, g, or t
  misc_feature (328)..(328): n is a, c, g, or t
gggggcacanangggcactagaccatttatactctgatatctgctctggagatggnggactaacatnctacatacctntctggagaaattctcaaagcgcagtgcattttacagaacaaagtggacttaacaatatgaagaactttctnggnactcngcncaatngggcnatnacaactttacagacgcattttccgtgctccaccaggactgtccgcgcgccccagcccanatnccttctttgagagncagactgagagagacggatcggccagatatcccgattctctatgnctgggccgtgaatcgccgancaaggctgaacccncgc

SEQ ID NO: 502402 - DNA, 418 bp, Homo sapiens
  misc_feature (30)..(30): n is a, c, g, or t
taggcacaagtgggcccccagttcacgggntgcgcctcagctgttggccgccttggccccgtggctcacctgaagcctgggccgtgcaggtgaggggagaatggcgcctgctttgtcatctctaagaggcccaagcccaggatcttgcttgggtcctcagctgggcagtcctcagggaaaccatggtttccactcgccgttttagccctctcccttccaaggacctagatgtgcgtagaaccttttaggacagattcatttaacaaccaaaacacccgtggctacatacagttgctaggcatcctgtatacacaggacatgtcctatattaaatgatcttgtcctgtgttgactttgggaggacaccctaaatgtcttatatttagctttttccaataaattacaaaaactcaaaaaa

SEQ ID NO: 502403 - DNA, 1263 bp, Homo sapiens
gggcagctcagctccggagagcctggcggcgcggcggtgcatggctcgggtggcgtggggtgctgctgtggttgctgctgggcatgctgccggtggcggcagtactgagaagtacagcttccggggcttcccgcccggaggacctgatgcctgctgtgcctgctggctgtactgtggcactgctcttggagcagtactgagggtgagatgagcttggcgctgatgagctgcgctgctaccttggagtgctggctgctgctgtgctgcacctggctcctgcgctgacatgcgagtgccttctgtccacgccaaatcttgcagcgtggtccctgtgccctgcggccaagccctgatccccgaacggctggactgctggcagactgagttgggccttgctggaggcttgctggcttcttcgtggcctgcgtccctgtgatgtcgaatgccttgccttgcccttgcggtgctgcttgcctgaagcgggcactggcttgcccccggtctttcccagggttgcgccttacccgcggtcctggcgggccaggccttgcttgccgttgaactttacccaagagggccggtcctttgagcccttaacccaaggtaaccttggcacttaagcggccggcattggctccacagcgtgccctttaaacccgttgcctttgtgcacggacagggggcggggatggcgcagggctggtgcaccttaacaagcccttttacgcttccgcaggaaggtgaagacccccgtgaaagcgccaccggacagtcttttgcactctgtgcgcccaacggttaattcttcaaagcatagccttaattcaagcgggggaactttgccattggggaaccggataccgtgcacgtgcaacctcgagtgattccccctttcacagtggtgaaacccccttaagaaggggcccgcccaagatggcgcctataacggaaaggggacccgggtggtttcaccgtttcaccgggagcggacattttggatgccacaagtgccctaccaataaacgcataacctagtggacgcggtggcgctgaaattttttcccccggtcataatagtcgaaggccgacccggtgaaagtcggaccacatgtgggacagtccgtgcgggtcccatttgggtcacacggaaagttaacaccatatggcgcacgtgctacatatattgcgccacagggggttggccatatttggacacgcgcgactatgacgcaaaccggtgggtagccccccaatttgaagcgc

SEQ ID NO: 502404 - DNA, 348 bp, Homo sapiens
cttttgcagttggtgtcaatagttttcttgttagctccctcctttgagtcccttttaataccatcagccaaatgtaccactcaccattttttcaacaaagaccccatggcttcctttaggaaatcctcagagaagaaaaaaatacagaatgtggaaagaacaacgctgcttggctcttttcttttcaaactataagaggacattttcccatgcaaacaatttatagttcagttgccatattgtgggctacatatggacatttattgtttaaactgaaaaatatcccccccttattacattgttttttttaatcagaaatgtataccaaggccctacttttaccctcca

SEQ ID NO: 502405 - DNA, 130 bp, Homo sapiens
tggacatgtatcgtccagcaggcatctactcctctctctgtccagctgggcatagttccaactgcatcaagccagatgggcttctggagttcgccaagcagctggcgcgctggggccgtggagcctttgg

SEQ ID NO: 502406 - DNA, 234 bp, Homo sapiens
  misc_feature (104)..(104): n is a, c, g, or t
  misc_feature (120)..(120): n is a, c, g, or t
tattgctcgagcctggcagtttgagactgtagtgagtatgaccacgccactgctctccagcatgtgtgacagagcaagccccatctcaaaaaaaaaaaaaaagnaaattccagagggagnaaagtattcacagattataagccaagcagttgaaggggaaaataaacatgttaccaatttctttttttaattttttggtttctttgtgtgagactacagagcaagccccatctc

SEQ ID NO: 502407 - DNA, 114 bp, Homo sapiens
cccggcacgaggctagatccggggacagctttgtacaagaaagcggggtctaatgatgatgatgatgatggaaggcacagcgtgcttaccacaaagggggatcttggcctcgtg

SEQ ID NO: 502408 - DNA, 321 bp, Homo sapiens
  misc_feature (73)..(73): n is a, c, g, or t
  misc_feature (91)..(91): n is a, c, g, or t
cttagaaacatgaaccaaataagtagtataaagagacatttggccagttaggtggctcatgcttgtgatcccnaagcgcttggagccgagnggggtggatcacttgaggtcagaagtttgagaccagcctggccggcatgcggagccgcgtctctactaaaaatgcagaaattagctggatgtggtggtgggtacctgtggtgccagctactcgggtgtctggggcacaggaatcgctcgaacccaaaaggcggaggtttcagtgagcaaagattgtgccactgcactccaacctgggagacagagtgagactctgtctca

SEQ ID NO: 502409 - DNA, 771 bp, Homo sapiens
gcatgagcattagtgtcagtgtaatctagagtgaccccagctatgtcacgtgtggcaggcacaagaacagatgtcaatgagctatgcacgaggtggacactccagatgtgtgcgctggcacagctggcaggggcccgtagggtggctcatagaagcgtcaccctcgttgacggcttgcacttaccacgctgtcagagcgacggttgtggacgatttaccagcggtgagttcctggcgactgctgcgatcggttgcgactgcagctgagcaggagagcctcaagcgctccaaggtagctcaacctggtgcatggacgagatcaagagggccgtgtcagaaaggcaggacgactgcgcagacggagacggtaatcgcacctggggcacgcactaacagaaggaccccgcgattgaagccgtgcgaacggtgtcacacgcagcgagcgtgcgtgtcgacctggccagcaggctgtctggacgcaaggtagagcaggtgctgcaggcccgcgggtgcgcgtgggccagggccgcaccggagtgtcggtggtgatgggcatcccgatcgtgcgggcgaggtgcactcgtacctgactggacacgtcgtgaactcgctcatttccgagctgagcccgcaggagaaggaggactcggtcatcgtggtgctgatcgccgagaatgactcaaagttacacttcggcagtgagagagaactatcaagggcttgtgcgccacggagatgcattctgggctctggaggtcatttatcgttagc

SEQ ID NO: 502410 - DNA, 230 bp, Homo sapiens
agctggaaagacaggtgcatgccaccatgcctggctgatttttgagcttatagttgagacggaggttcaccatgttggccagcctgatctcgaactcctgacctaaagtgatccacccaccttgtctttccagaacgattatagacgagagccactgcacccagctggccctagagttacgatagagatcgtgggctgactgtgaattagggcgcttacagggaaatgac

SEQ ID NO: 502411 - DNA, 702 bp, Homo sapiens
ttggtcggcatcggatttgtcggcagactatagttgtctgtaaaaagtagctcctagaagctatatatgcgaccaggaccttgacctcatatcaacatggtcggtcattgaccatggtagatccagggcaagatctcaccgaggtagtagtccgatctgatctgataattggctggtgacagtctgggcccaggtacggcatgtgtaaaacattttgagcaagagaggctagctgtaagatgggaacagggctccgttacaagatatgcgcttgcatcgtgtgagaagtagaagtaggaaggcttgaggggttgaagtgtggaatatcacccaaattagatgatcggtcctgtgctcggaaatctttgagcaccgagccaatgtcaccaatgttgcagctactcatggtgagggctccctagggcacacaagaaggccacttgtatccaaacataaccgatgcattcacgaggcaaacgatctacagtgctggagcttggtgcgtgactctgaattgtaaagctgctcgcgatgtgaggggaacttttgaacggccggggaatctgccaagatatggtgcgagacccctgagggagcaatgccccttctgtggcttcacaacagttgggttgtgagaaacaacgtaactttgtcgggatagttacacaacaagtggttcccagctgagccaactctatagca

SEQ ID NO: 502412 - DNA, 225 bp, Homo sapiens
agggatctcttgtgagattatcaatatccatacaatcaaacctctggatgaagagattattctgaaatctgtagaaaaaaccggtaagcttgtaactgcagaggaacataattttctgggtggtttgggagaatctgttgccggagttttggcaagaaaaaggccaacaccacaggaatttgttgctgttgtcgaagcggccgcgaatttagtagtagtaggcgg

SEQ ID NO: 502413 - DNA, 158 bp, Homo sapiens
accatacatgatggagctagcagacttaacgttaccacggacacagtatgagtgacccttgagtcagtaaccgtacacgagaagaaattcaggaagtcagaagtaagagtgaccctcttatgcttctcaacggccaggatggtgaacagaaatcttgc

SEQ ID NO: 502414 - DNA, 205 bp, Homo sapiens
  misc_feature (18)..(18): n is a, c, g, or t
ttttttcataaaggagcnctaaaatttgccagtcacttctgcatacattgagatgatcatatggtttttgtttttaattctgatgatgtgatgtatcacattttttaacttgcatatattaaaccacctctgcatcccttggacataacccactagatgattttgaattatctttttgatgtactgctggattcagttgtcgacg

SEQ ID NO: 502415 - DNA, 368 bp, Homo sapiens
cctattcaagtctggaccaagggttcacacaacggtcacatgggcaaggacccggttctacaagggacacgtgcaacagcaaggtgcagcgttggaattcaatgggaacgaacaacgaagccagaatccagtcatccagcaatgttaaaaggccccagtgcaacgaagggcgacagtgcatcaaccctatattaggaagtcagaagcgagaagcaccggaaggttgcgctgagcttggctgcatcgcatgggtcttggatgtcgggattcgaccacttggccgatgggaatggtctgtcacaaatttgctcctttttttttatccgccacacgtaatacgcctgctcctgtcatatagcgatggttca

SEQ ID NO: 502416 - DNA, 219 bp, Homo sapiens
  misc_feature (72)..(72): n is a, c, g, or t
aggaaaaaaacccagcccaaagttatattccctcccttttactgattttttttttttctatctggtccatcngcgggattcatttctccaatctcatgtcccttttggtgtgggagtcggggtaggggggactcttgtcaaaaggcccattggggcatgtgtgtttgctagctcccttgtccatgaaaaaattttatgatattaaaaaaaatcttttga

SEQ ID NO: 502417 - DNA, 608 bp, Homo sapiens
  misc_feature (259)..(259): n is a, c, g, or t
tggaaattgggaaagggggaaaaccttgtgtttatttggtttgattgtgtccaattcaccccctgtgttaaaaaaaccagggggccataaagaaaaggggggggccttgtgaaaattccgggattagggttcccgggggttccccagcccctataaactaattttcttgacccccctctcttgagaggacagtctcgcgcggggggtggaaaaggggctgcacaagagaggggaagttcccagtgtgtgtaccaccacngtggtctcgtgttttcttacacaagatagaggagagtggtggaagagtggatgtgactatagtgtcttcttctatatatcacgagacacctatacaaaaacaagatgtgaccaaataatgtagaaattattcctactctccctccactatagtgtggtggcgctcttctatcttatcttctctatatctttctcttatttcaacaaaaaaacaagcggtgctgtgaacaaccagacaacagtcgagacggtaagaacggaagagacaacacaacgagaaacgaagtagcacgatatcatgtattgaggaaacgagcacactatgacttgaaggtaggcactaggaggta

SEQ ID NO: 502418 - DNA, 531 bp, Homo sapiens
  misc_feature (7)..(7): n is a, c, g, or t
  misc_feature (75)..(76): n is a, c, g, or t
  misc_feature (78)..(79): n is a, c, g, or t
  misc_feature (83)..(83): n is a, c, g, or t
  misc_feature (104)..(104): n is a, c, g, or t
  misc_feature (106)..(107): n is a, c, g, or t
  misc_feature (127)..(127): n is a, c, g, or t
  misc_feature (134)..(134): n is a, c, g, or t
  misc_feature (137)..(137): n is a, c, g, or t
  misc_feature (143)..(145): n is a, c, g, or t
  misc_feature (174)..(174): n is a, c, g, or t
  misc_feature (183)..(183): n is a, c, g, or t
  misc_feature (185)..(185): n is a, c, g, or t
  misc_feature (204)..(204): n is a, c, g, or t
  misc_feature (213)..(213): n is a, c, g, or t
  misc_feature (222)..(222): n is a, c, g, or t
  misc_feature (225)..(225): n is a, c, g, or t
  misc_feature (231)..(231): n is a, c, g, or t
  misc_feature (234)..(234): n is a, c, g, or t
  misc_feature (238)..(238): n is a, c, g, or t
  misc_feature (267)..(267): n is a, c, g, or t
  misc_feature (271)..(271): n is a, c, g, or t
  misc_feature (288)..(288): n is a, c, g, or t
  misc_feature (316)..(316): n is a, c, g, or t
  misc_feature (320)..(320): n is a, c, g, or t
  misc_feature (325)..(325): n is a, c, g, or t
  misc_feature (366)..(366): n is a, c, g, or t
  misc_feature (369)..(370): n is a, c, g, or t
  misc_feature (374)..(374): n is a, c, g, or t
  misc_feature (382)..(382): n is a, c, g, or t
  misc_feature (386)..(387): n is a, c, g, or t
  misc_feature (396)..(396): n is a, c, g, or t
  misc_feature (400)..(400): n is a, c, g, or t
  misc_feature (405)..(405): n is a, c, g, or t
  misc_feature (416)..(416): n is a, c, g, or t
  misc_feature (420)..(420): n is a, c, g, or t
  misc_feature (436)..(436): n is a, c, g, or t
  misc_feature (441)..(441): n is a, c, g, or t
  misc_feature (445)..(445): n is a, c, g, or t
  misc_feature (447)..(447): n is a, c, g, or t
  misc_feature (484)..(484): n is a, c, g, or t
  misc_feature (494)..(497): n is a, c, g, or t
  misc_feature (525)..(525): n is a, c, g, or t
gcttgtncccgttggctctcgttcttaccttgggccctcttacctgccaaagcctacaaggcccttaattctaanncnncccncccttcccacaaccataaaancnnacagtccagtcaccttggantgccggntcngccagnnnctccactacgtgggcattatctccctggntggggtggngncctgtactgtagccttggnctttttttnagttagttnggntcttcnttntttnctccccaagaggggacactccctcatgantgtnactcactggcacaattnctgcctctcagcgggcatcagctggganctgnggggnacccctgtggcctcttgtggccctctctagaagaacttgangtnncagntctgtggnatcnngagccttcntttnttccncctcccgctcngggngctctgcgtgatttgncagcncggntngttgtgaggtgccagtacattgctcgttttttttttntggggttggnnnngggccaggccccatttgggggccaggtnaagggt

SEQ ID NO: 502419 - DNA, 1755 bp, Homo sapiens
gcttaagcatgaagcatactgacatttcaaccagacgcacaaaggagatctctcagtggcagcggagtggaaaattgccatgaatgctagttagggtagaaagactgtattgtataaacagacctttttagtgcattactttttaaagtggatatctgtggtggttccactttaatactgaaacaccgaaaggcatttctatatttttaatcatgttctaaagtgctcttatgagagacttgtgggccatcagtattagtgatttcatactgcagtgctggcattgcagatatttttttaaattggtgctgctttgcccaatcatgttaaaactcagggggatataaaaataacattcacactggctatcttcttaagaacagaaagactgaactgtcctatggttagaaggaattgatgcttatgtagtgccttctgttgtcctacatgtttcacagttcagctgctagtcttgaagcttttccttagcttcattatgatacgtaattttataaggtattctgttgagtgatcattgtttaaaaaaaaagtttcttgctacccattgtgtttattaatagacatgatgggtttttttcagttgtcatatagattttcattattttcccttccattttcaaaatttaatgttaccagtttctccaaagacaagaaggcatctagtattaatgatggaagagtttattttctcttaccctttactaatttaaacatgctgggattacaggtgtgagccaccgcacctggccagaagccactaactaaaataggcacacatgacacagcatgtggttaatagctgtgtcttgaattatcctctaaataaccaaatttagttgtatgtatttgtaaaggatatggcttcagaagctatcttttgttctctgtcgatataactcttaagggcattcctgacccaagaaagactccttgcgtttgtaactgtggtctaatacccaaatgtgccctgttcttatggatacagtctcttgaagcatacctcaaagtcatagagagaatatggcatttgaaagaaatcgtttgccttggatcatatgagttattttgtgaaacaacagctgacttttcagaaaaggagcaactacttttatatgctaaaagtatttcataactttctgggaaaccttatttaggtataaatggtcatcttattatttttcaaaaaggtatattttaataattgtacaatttatatacagtttgtgaccagaatttgtaagttgttggtgtcatatcaaggatcttttaaattatgccactacaggatgtatcatttcaagtctattttgcacagctaaacagtagcaaaagatgccaattagcatgataatggtgtcttcatttttactgtatttaactgaaacctaacacatgttgaaaaccatatcatacctagtttatctcttaatttcaaactatgtacttgtaaaaatgatgtaaatttgcactgggaacctgggaaagagtgactgataatttttggtgcgtgatttttagatttgtctttttttttttaagaagaatttgttactatgtaaaccctgacattaaatgttttatctctaccagcatcaggaggaatcactgctttaagggtattatgtaatgcctagtgccttctatttacagtgaaaaagaggttttgtgaaggcatttatggtcattaccaaaaactaaattaaaggccttggattttaaaaaaaaaaccaaaaa

SEQ ID NO: 502420 - DNA, 1812 bp, Homo sapiens
gcttaagcatgaagcatactgacatttcaaccagacgcacaaaggagatctctcagtggcagcggagtggaaaattgccatgaatgctagttagggtagaaagactgtattgtataaacagacctttttagtgcattactttttaaagtggatatctgtggtggttccactttaatactgaaacaccgaaaggcatttctatatttttaatcatgttctaaagtgctcttatgagagacttgtgggccatcagtattagtgatttcatactgcagtgctggcattgcagatatttttttaaattggtgctgctttgcccaatcatgttaaaactcagggggatataaaaataacattcacactggctatcttcttaagaacagaaagactgaactgtcctatggttagaaggaattgatgcttatgtagtgccttctgttgtcctacatgtttcacagttcagctgctagtcttgaagcttttccttagcttcattatgatacgtaattttataaggtattctgttgagtgatcattgtttaaaaaaaaagtttcttgctacccattgtgtttattaatagacatgatgggtttttttcagttgtcatatagattttcattattttcccttccattttcaaaatttaatgttaccagtttctccaaagacaagaaggcatctagtattaatgatggaagagtttattttctcttaccctttactaatttaaacatcaggctggtctcaaactcccgacctcaggtgatccgcccgcctcggcctcccaaagtgctgggattacaggtgtgagccaccgcacctggccagaagccactaactaaaataggcacacatgacacagcatgtggttaatagctgtgtcttgaattatcctctaaataaccaaatttagttgtatgtatttgtaaaggatatggcttcagaagctatcttttgttctctgtcgatataactcttaagggcattcctgacccaagaaagactccttgcgtttgtaactgtggtctaatacccaaatgtgccctgttcttatggatacagtctcttgaagcatacctcaaagtcatagagagaatatggcatttgaaagaaatcgtttgccttggatcatatgagttattttgtgaaacaacagctgacttttcagaaaaggagcaactacttttatatgctaaaagtatttcataactttctgggaaaccttatttaggtataaatggtcatcttattatttttcaaaaaggtatattttaataattgtacaatttatatacagtttgtgaccagaatttgtaagttgttggtgtcatatcaaggatcttttaaattatgccactacaggatgtatcatttcaagtctattttgcacagctaaacagtagcaaaagatgccaattagcatgataatggtgtcttcatttttactgtatttaactgaaacctaacacatgttgaaaaccatatcatacctagtttatctcttaatttcaaactatgtacttgtaaaaatgatgtaaatttgcactgggaacctgggaaagagtgactgataatttttggtgcgtgatttttagatttgtctttttttttttaagaagaatttgttactatgtaaaccctgacattaaatgttttatctctaccagcatcaggaggaatcactgctttaagggtattatgtaatgcctagtgccttctatttacagtgaaaaagaggttttgtgaaggcatttatggtcattaccaaaaactaaattaaaggccttggattttaaaaaaaaaaccaaaaa

SEQ ID NO: 502421 - DNA, 210 bp, Homo sapiens
ttcgatagtcgaaactgaagaagatagagacgcaagagaaaaatccactgccttcaaagaaacgattgaacaggagaagcaagcaggcgaatcgtaatgaggcgtgcgcgccaatatgcactgtacttcacagcattgcttcttattactctttagctgtttaactttgtaagatgcaagaggttggatcagttaatgactgtgctgccc

SEQ ID NO: 502422 - DNA, 1248 bp, Homo sapiens
  misc_feature (135)..(135): n is a, c, g, or t
tgttgcccaggctgagtgcaatggcgcagtctcggctgactgcaacctccacctcccgggtgcaagtgattgtcctgcctcagcctcctgagtagctgggattacaggtatgtgccaccacgcctggctaatttngtatttttagtggagatggggtttctccatgttggtcaggctggtctcaaactcccgacctcaggtgatccgcccgcctcggcctcccaaagtgctgggattacaggtgtgagccaccgcacctggccagaagccactaactaaaataggcacacatgacacagcatgtggttaatagctgtgtcttgaattatcctctaaataaccaaatttagttgtatgtatttgtaaaggatatggcttcagaagctatcttttgttctctgtcgatataactcttaagggcattcctgacccaagaaagactccttgcgtttgtaactgtggtctaatacccaaatgtgccctgttcttatggatacagtctcttgaagcatacctcaaagtcatagagagaatatggcatttgaaagaaatcgtttgccttggatcatatgagttattttgtgaaacaacagctgacttttcagaaaaggagcaactacttttatatgctaaaagtatttcataactttctgggaaaccttatttaggtataaatggtcatcttattatttttcaaaaaggtatattttaataattgtacaatttatatacagtttgtgaccagaatttgtaagttgttggtgtcatatcaaggatcttttaaattatgccactacaggatgtatcatttcaagtctattttgcacagctaaacagtagcaaaagatgccaattagcatgataatggtgtcttcatttttactgtatttaactgaaacctaacacatgttgaaaaccatatcatacctagtttatctcttaatttcaaactatgtacttgtaaaaatgatgtaaatttgcactgggaacctgggaaagagtgactgataatttttggtgcgtgatttttagatttgtctttttttttttaagaagaatttgttactatgtaaaccctgacattaaatgttttatctctaccagcatcaggaggaatcactgctttaagggtattatgtaatgcctagtgccttctatttacagtgaaaaagaggttttgtgaaggcatttatggtcattaccaaaaactaaattaaaggccttggattttaaaaaaaaaaccaaaaa

SEQ ID NO: 502423 - DNA, 93 bp, Homo sapiens
  misc_feature (48)..(48): n is a, c, g, or t
  misc_feature (86)..(86): n is a, c, g, or t
gcacagcgaggtcggcagcggcacagcgaggtcggcagcggcacgagngtcggcagcggcacagcgaggtcggcagcggcacaagngtcggca

SEQ ID NO: 502424 - DNA, 1689 bp, Homo sapiens
gcttaagcatgaagcatactgacatttcaaccagacgcacaaaggagatctctcagtggcagcggagtggaaaattgccatgaatgctagttagggtagaaagactgtattgtataaacagacctttttagtgcattactttttaaagtggatatctgtggtggttccactttaatactgaaacaccgaaaggcatttctatatttttaatcatgttctaaagtgctcttatgagagacttgtgggccatcagtattagtgatttcatactgcagtgctggcattgcagatatttttttaaattggtgctgctttgcccaatcatgttaaaactcagggggatataaaaataacattcacactggctatcttcttaagaacagaaagactgaactgtcctatggttagaaggaattgatgcttatgtagtgccttctgttgtcctacatgtttcacagttcagctgctagtcttgaagcttttccttagcttcattatgatacgtaattttataaggtattctgttgagtgatcattgtttaaaaaaaaagtttcttgctacccattgtgtttattaatagacatgatgggtttttttcagttgtcatatagattttcattattttcccttccattttcaaaatttaatgttaccagtttctccaaagtgctgggattacaggtgtgagccaccgcacctggccagaagccactaactaaaataggcacacatgacacagcatgtggttaatagctgtgtcttgaattatcctctaaataaccaaatttagttgtatgtatttgtaaaggatatggcttcagaagctatcttttgttctctgtcgatataactcttaagggcattcctgacccaagaaagactccttgcgtttgtaactgtggtctaatacccaaatgtgccctgttcttatggatacagtctcttgaagcatacctcaaagtcatagagagaatatggcatttgaaagaaatcgtttgccttggatcatatgagttattttgtgaaacaacagctgacttttcagaaaaggagcaactacttttatatgctaaaagtatttcataactttctgggaaaccttatttaggtataaatggtcatcttattatttttcaaaaaggtatattttaataattgtacaatttatatacagtttgtgaccagaatttgtaagttgttggtgtcatatcaaggatcttttaaattatgccactacaggatgtatcatttcaagtctattttgcacagctaaacagtagcaaaagatgccaattagcatgataatggtgtcttcatttttactgtatttaactgaaacctaacacatgttgaaaaccatatcatacctagtttatctcttaatttcaaactatgtacttgtaaaaatgatgtaaatttgcactgggaacctgggaaagagtgactgataatttttggtgcgtgatttttagatttgtctttttttttttaagaagaatttgttactatgtaaaccctgacattaaatgttttatctctaccagcatcaggaggaatcactgctttaagggtattatgtaatgcctagtgccttctatttacagtgaaaaagaggttttgtgaaggcatttatggtcattaccaaaaactaaattaaaggccttggattttaaaaaaaaaaccaaaaa

SEQ ID NO: 502425 - DNA, 1097 bp, Homo sapiens
  misc_feature (680)..(680): n is a, c, g, or t
  misc_feature (749)..(749): n is a, c, g, or t
  misc_feature (1097)..(1097): n is a, c, g, or t
cagagcgagactctgactcaagaaaatgatactttattctagtcgggacggagcgaatcttgctctagttgccctggccgttctctaactccgggcctttaaggcgagccatgcctgcctacggcctgtcctgaagtgtctggttgttagcaggattgtgagatccgaccatccaacctgagctcatgactaactagtcctctgcatattttacgatgattgttacaatagtacacaaatactagaataacacgtactcttagaactggtgaagatacccaggctattgactaaatactgactgttgcctattgaagcttggctcatccacatggtcaatctctccgtcgacagaacaactcactgtcccatctttgaaggtagttgtacgaccccatgtccgcagaagactccagttcattgtggaggccctagcttgtctaatattccatttcattcacaattgtggcagatatgtgtcagtggagactaacattttcgacatagtcgcgggggttctgcaaggggagatcccattggggtaacggaccttgaactcctacattcgtgcacatagtatctactcgctcgcgatgatcttcgaatacttgcgcgctgctaacaaaccaatgccccatgggctactcaaatgaaactaggccatataagacctattacgnttggagcacgaaattgggcttaatttgcagaacatggcttctcttctgggcaaaggctttaaaagtctntctcacctttgcactctagtcgattttatcccccatagagggtacactgtctgggcttaacctttgaagtgggggttccaatggtacaacagggcttctctagcaaaatccatatagcgtttgtcgaatagtcatttcgttcagaatggaaaacctataccccaaggaaattcttgtgggggaccagttgagccccttgtggttccattcttgcggccctgatttatctgaatcgcagtacgtggagcaagtattttgtagccttgccattgggataagcggggtcctccttagaattcccccagggaattggctattgggttattagactggactttggaagctccn

SEQ ID NO: 502426 - DNA, 216 bp, Homo sapiens
gaagtaatatcaaaatacagtctcatcccttaggaaggcagattaccatatcaaaagaagagtaataaagtaagtaactatattacaaggcagaaggctataggtatcaacaacaacaaacaaaaaaaggcagggacaaacacacaggcagccagcaaaggatacttctaggctacagcaaagcaaggcacatatttatgggcaataggtcaacta

SEQ ID NO: 502427 - DNA, 648 bp, Homo sapiens
  misc_feature (138)..(138): n is a, c, g, or t
  misc_feature (142)..(142): n is a, c, g, or t
  misc_feature (151)..(151): n is a, c, g, or t
  misc_feature (167)..(167): n is a, c, g, or t
  misc_feature (250)..(250): n is a, c, g, or t
  misc_feature (273)..(274): n is a, c, g, or t
  misc_feature (279)..(279): n is a, c, g, or t
  misc_feature (291)..(291): n is a, c, g, or t
  misc_feature (300)..(300): n is a, c, g, or t
  misc_feature (303)..(303): n is a, c, g, or t
  misc_feature (345)..(345): n is a, c, g, or t
  misc_feature (354)..(354): n is a, c, g, or t
  misc_feature (381)..(381): n is a, c, g, or t
  misc_feature (392)..(392): n is a, c, g, or t
  misc_feature (401)..(401): n is a, c, g, or t
  misc_feature (441)..(441): n is a, c, g, or t
  misc_feature (467)..(467): n is a, c, g, or t
  misc_feature (472)..(472): n is a, c, g, or t
  misc_feature (474)..(474): n is a, c, g, or t
  misc_feature (476)..(476): n is a, c, g, or t
  misc_feature (480)..(481): n is a, c, g, or t
  misc_feature (488)..(488): n is a, c, g, or t
  misc_feature (512)..(512): n is a, c, g, or t
  misc_feature (517)..(517): n is a, c, g, or t
  misc_feature (537)..(537): n is a, c, g, or t
  misc_feature (539)..(539): n is a, c, g, or t
  misc_feature (541)..(541): n is a, c, g, or t
  misc_feature (543)..(543): n is a, c, g, or t
  misc_feature (568)..(568): n is a, c, g, or t
  misc_feature (574)..(574): n is a, c, g, or t
  misc_feature (596)..(596): n is a, c, g, or t
tattatataaaaagcagaattaagctgggcacatgtgcttgtaatctcagttataagggaggctgaggtgggagaatcgagatactcagccagcctggcaatgtagcaaagactccatctcaaaaaaaaaaaacagantggncaaattttntgggaatctatggacnttccatgagcttaaacactttggaggtgggataacatttagttgaaaatacctaagaaagtgtgtcttctttaaagcctgggntttaatcatgggaaatggtgtgnngtgtnggttggtatccnatgtgggantcngtatgtctgatccataatcatttagatattggaatgatctcnggggatggnaggttgggccatttgaccattattatnatcaagtggtngtatgctanggtaagttgacgccatagcattatacagttatcttcatgntcttgaatgatatctgtatataagcnatgtntnanctcnngtccaanggtagaatgaaaaacccattctantgtcnccactcagagatagtaccgnantncngggtatccttctataaactcctaantttggntcctttatttgtaacttaatanggctactaaagacaagtcctaaaggtaaggtctaacaagtgctacaacgtga

SEQ ID NO: 502428 - DNA, 374 bp, Homo sapiens
agcgttcagaggtcacctgcagcccatgtacaccagggtctatagtcatatcgtttcgtactctgatatctaataacgtcactacttagctgtaccaatggatctcttatgcaactttcagagatggagtcttgctctgttgctgggccggagtgcagtggcatgatcttggcttactgcaacctctgcctcctgggttcaagtgactctcttgcctcagcctcccgagtagctggaattacaggtgcccgccaccacgcctggctaatttttgtacttttagtagagacggggtttcaccatgttggccagaatggtcttgatctcctgacctcatgattcgcccccctcggcctcccaaagtgctggtatta

SEQ ID NO: 502429 - DNA, 454 bp, Homo sapiens
  misc_feature (165)..(165): n is a, c, g, or t
  misc_feature (174)..(174): n is a, c, g, or t
  misc_feature (198)..(198): n is a, c, g, or t
  misc_feature (225)..(225): n is a, c, g, or t
  misc_feature (261)..(261): n is a, c, g, or t
  misc_feature (265)..(265): n is a, c, g, or t
  misc_feature (275)..(275): n is a, c, g, or t
  misc_feature (280)..(280): n is a, c, g, or t
  misc_feature (315)..(315): n is a, c, g, or t
  misc_feature (321)..(321): n is a, c, g, or t
  misc_feature (344)..(345): n is a, c, g, or t
  misc_feature (358)..(358): n is a, c, g, or t
  misc_feature (360)..(360): n is a, c, g, or t
  misc_feature (389)..(389): n is a, c, g, or t
  misc_feature (394)..(394): n is a, c, g, or t
  misc_feature (396)..(396): n is a, c, g, or t
  misc_feature (409)..(409): n is a, c, g, or t
  misc_feature (414)..(414): n is a, c, g, or t
  misc_feature (423)..(423): n is a, c, g, or t
  misc_feature (425)..(425): n is a, c, g, or t
  misc_feature (429)..(429): n is a, c, g, or t
cccccgggctgcagaaattgggcacaaaaggtgtttgtgaaaaacaagtttggggcttggtgagtttgtgggcccaccaccttttgatttgtccagggtattaacgtgtcagggttaagtgttttgggattttttaaaaggcggccaaaacccagttgttttttnttgggggtntgtcagggttgaaaagtccaaccngtaggccccagtttcctttttaagttnaggttttgggccaaaaccccgggggttgttacttgntttnagtggaaagnggttngcatttaccccggtaaaggtattcatttttaattnaggaanggtttttttggtacccaattttnnattttttaaaaanangccaacaaatttgggttttttactgttangtganancattaggccccancaacnggtcattgngnaagnaaaaataaaagtgctccggtaccca

SEQ ID NO: 502430 - DNA, 842 bp, Homo sapiens
ctcgggtggctgcgctgcgcggggaaatggccacggggacagaccatgtggtgggactcgggctcgtcgccgttagcctgagtcatcttcacctactacagggcctgggtgacttctcttggtgtgtcattctccccgtccgctgctcaccttccccgagccctggcaccggcagagcaactactatataggctctaggcagcggcgctggcttcattgcctgcctcatctcttgaactctccagaacaactctatgaggaagatgccagtggtaccgcattttatagatgagatagctgaggctaggggagaaggatctggtcccacagatggcatccttgagccgctatgagcttataactctgttgtccggcgttgctttgagcttctcggcgggagtcggttccttctgggttagcctgctgactcttaggcatggcaaacgccagtgatctttgtgaaggccttcaggatatattgcgcttgtgggaaaacttgtggttattgcttaacgaagtgcagtgtgtctggaagtgcagaactgtggtatcctttagagaaaagaaatattagtgaagaagccctggaggcccaggtcgggagtcagtcgatggattcctcaagtaccatttgctaggctgtgaggtgccttagggcaggtctctagtgcccttgtgctcttgtccccagcatcaagctatagcaggcaccaaagcaagtgccggtaaataccagtaagaaatttagggaaaggaaggaagacaggatgacccaaatgcgtcagtcttaaagagaagcaatgcagtccagtcctctgaagtgggtcaggcccttagatggg

SEQ ID NO: 502431 - DNA, 112 bp, Homo sapiens
catccctggccttaactttggaatttggagattaaatgcaaacatgtgaaaggctcatgaatatggatgcccctggaattttataaattttaaaataaaacccgaaaccaga

SEQ ID NO: 502432 - DNA, 312 bp, Homo sapiens
  misc_feature (72)..(72): n is a, c, g, or t
  misc_feature (88)..(88): n is a, c, g, or t
  misc_feature (123)..(123): n is a, c, g, or t
  misc_feature (143)..(144): n is a, c, g, or t
  misc_feature (152)..(152): n is a, c, g, or t
  misc_feature (266)..(266): n is a, c, g, or t
gatagtgatttgacttacaaatgggccaaagacacttcaacctcaaaaccaaagagaaatctctgcttgcangatacaaagaaagtanctctccctcttatgaaaagcaaccaggaactctantccagttatgagggccatgnntggtgtgngcagagctatcaagcaagcattcttcctagcacgctgcgctgccaaagcacagtgcagaacccaggcaaatcacattcatgcgcgcacacttgctcttaacgatcatcaccctntattctatctcaactttggccccatcaaatctaatgataaacaaaa

SEQ ID NO: 502433 - DNA, 372 bp, Homo sapiens
  misc_feature (56)..(56): n is a, c, g, or t
  misc_feature (98)..(98): n is a, c, g, or t
  misc_feature (136)..(136): n is a, c, g, or t
  misc_feature (291)..(291): n is a, c, g, or t
  misc_feature (321)..(322): n is a, c, g, or t
  misc_feature (372)..(372): n is a, c, g, or t
acaactcgagctcgtaccctacttcgtacgcctcatcactgacgtctcatcactgnttctattctattctattctattctgttctgttctattctgtnttattctattctgttttattctgttctgttctattctnttctattctattctattctattctgttctattatattctgttctattgtattctgttctcttctgttctattttttctgttctgttctgttctattctattctattctaatctgttctattctgttctattctattatattgtgttctattccantctattctattctgttctattcagttctgnnctgttctattagcttctgttctattccatcagtgatgagacgtagaaggn

SEQ ID NO: 502434 - DNA, 388 bp, Homo sapiens
ggttttagatttacagaacagctgcagatggagcagagagttcccatgtatccctcatatcagttttctccattgtcagtgttgtacattactagggtacatttgccgcacaataagaaaccaacgtgggtgcgtcactgtgagttaaactctatccttgattcagattttactcatgtatccgctcctgtccttttctgtcctgggtcccattcaggacgctcgatgacatctatcctccgggtcttcttagtgtcttccggtttatgatggcttgtctctccttgtttttcgtgacgttgagagtactgaggagtgccggtcagatattttgtagattgcgcctcattttgggtttctctgatattttccttatagtgagaaggag

SEQ ID NO: 502435 - DNA, 763 bp, Homo sapiens
gaataatggcgtgttgcctaccaggtgaatatgtggctatgcaaatgataaaattcgccagcttaccaagatgggacccacagcacttttgattgaattggaggactggagatgacacaaagtcaaggctcactatggaggtaccactgtacacaatgtatccaacaaataccagatctcacagaacatgtttacaggatcatcccggcatgccctcatgaatggagcatctcatccgatggcagacaacaggaccatgtccactcacaacagcatgttcttcatcacgtgtgacagagacaatgacgcgctggttgacatcacattccagacatcagcgttctaaagaagacggtgctagatggtggttaatagatgacatgcatccaatccaaacggcatatactactgggggtggacagtacacctgggacatggcagagcatgagacacatgatggatgcctatggatgaattggaaggcgtcatggtactcaatggaaaagatgagtctctagatcacgaccttttttctacaagcattgaccccaatacgtacatttttgctcttcgtgatgtgacaacatttagtggcattaaggttattggaatttgcttgtatacattatatatctgctcaaactctccaatggtagtatcggcaggttaacaatagctttttggacattatcgggcaagacccaatggttaagtattcatagccttgatttttcttttgacctgattttggggggggcgggcc

SEQ ID NO: 502436 - DNA, 184 bp, Homo sapiens
ctgtggcttggctccgcgtttagcgctgattggctgcgtgcttgactgcttgtcccttttgatcgtggtgacttagagggtgcactccctgtaaccggggatgcttgcatgtgtaactcttacctaagacgctcatagacaaggctaggacccaaaccctactcacagccaggacattcttccg

SEQ ID NO: 502437 - DNA, 494 bp, Homo sapiens
taggcggtcctctactcccctgacacaaaatcattcaagaagaaatagataccagcctgagcaacatggcaaaatcccatctctacaaaacatcaaaaaaaaaaaattagtcggggcatgggggtgcacaccggtaatcccaggtagctgccactacaggtgctgcaccaccacgcccggctaattttggtatttttagtagagacggggtttcaccatattagccaggggggtctggaactccggacctggtaatccacccgcctcggcctcccaaagtgcggggattacaggcgtgagccacctggccgggccaaaaatctcagaattctttaagacggttttaatggctccatcagtaatttggaagcactttcctttttttttttccccctttgggtcccttccccaaagccaccatggggtgggtatgattgttggaggggaaagaggaggggtaggaggatgctgggttgaggggattgaggggatcg

SEQ ID NO: 502438 - DNA, 333 bp, Homo sapiens
tcgcttccatatcaatgagtgctttcgcgatcttgtcgcctgtgaacggcttggtcaggtagagatatgcgcctgccaagagccctttctgtatgtcgaaaggtgaactcgcactggaaagcatggcgatgggtaggtgcttgaattgagtcgaagctcgtaggattgaggcaagcttcaatccgtccaggttaggcatttcgatgtcgatgaagcacgcatcaggcctagcctcgcgaataacacgcagggcctcgtacccatcctttgcgaggtgaacctcgatatcagctttctgcagaaagccggcccccatcttccgcattccggggg

SEQ ID NO: 502439 - DNA, 104 bp, Homo sapiens
gcggcttctgcatcaggtactcagagtcaacagaggtcaatacattatgtatacatactgacactctcttgcacaggaaactcttactcatttttttttctgag

SEQ ID NO: 502440 - DNA, 584 bp, Homo sapiens
  misc_feature (308)..(308): n is a, c, g, or t
atatttgtgttttttttgagagatttgctcttgttgaccacgatggagtgcagtggcatgatcttggctcactgtaacctctgtgtcctgggttcaagtgattctcctgcgctcagccttccgaatagctgggattacaggcacccaccaccatgccagctaattttttggatttttagtagagacagggtttcaccatgttggtcaggctgtgcttgaacccctgacctcaggtgatccacctacctctggcttcaaagtgctgtgattacaggcatgagccaccgcgcccagacagagagaggttntaaatatatatgggtactttaatattaagttataacataattttcatggtattgaaaagctctttcatctaggatcacacaacttcagtgtcagaatcatattgaggtgggggaattcgtattagtcaggtttctctaaagggacagaaacaatatggtagatgtatatacgcatgggagtttatttgggagaattgcttacatggacataaagggaagtcccacaattggccgtttggaaactggggaccagggaaccccttttggttcccgggc

SEQ ID NO: 502441 - DNA, 841 bp, Homo sapiens
  misc_feature (93)..(93): n is a, c, g, or t
  misc_feature (176)..(176): n is a, c, g, or t
  misc_feature (197)..(197): n is a, c, g, or t
  misc_feature (210)..(210): n is a, c, g, or t
  misc_feature (217)..(217): n is a, c, g, or t
  misc_feature (251)..(252): n is a, c, g, or t
  misc_feature (272)..(273): n is a, c, g, or t
  misc_feature (288)..(288): n is a, c, g, or t
  misc_feature (302)..(302): n is a, c, g, or t
  misc_feature (321)..(321): n is a, c, g, or t
  misc_feature (324)..(324): n is a, c, g, or t
  misc_feature (331)..(331): n is a, c, g, or t
  misc_feature (337)..(337): n is a, c, g, or t
  misc_feature (370)..(370): n is a, c, g, or t
  misc_feature (390)..(390): n is a, c, g, or t
  misc_feature (458)..(458): n is a, c, g, or t
  misc_feature (467)..(467): n is a, c, g, or t
  misc_feature (469)..(469): n is a, c, g, or t
  misc_feature (477)..(478): n is a, c, g, or t
  misc_feature (490)..(490): n is a, c, g, or t
  misc_feature (504)..(504): n is a, c, g, or t
  misc_feature (600)..(601): n is a, c, g, or t
  misc_feature (603)..(603): n is a, c, g, or t
  misc_feature (680)..(680): n is a, c, g, or t
  misc_feature (684)..(684): n is a, c, g, or t
  misc_feature (694)..(694): n is a, c, g, or t
  misc_feature (707)..(707): n is a, c, g, or t
  misc_feature (710)..(710): n is a, c, g, or t
  misc_feature (716)..(716): n is a, c, g, or t
  misc_feature (726)..(726): n is a, c, g, or t
  misc_feature (728)..(728): n is a, c, g, or t
  misc_feature (731)..(731): n is a, c, g, or t
  misc_feature (743)..(743): n is a, c, g, or t
  misc_feature (751)..(751): n is a, c, g, or t
  misc_feature (755)..(755): n is a, c, g, or t
  misc_feature (763)..(763): n is a, c, g, or t
  misc_feature (829)..(829): n is a, c, g, or t
gacacgagagaacaaggggggacaaaaaagcaggcgggaccgggccggaaggcccgggagcagcggacagccgggcgcagacagcggctgganccgaggcccagctccacagaggagaacacgcaggcagcagagaccagggggccccccccagcccctgccggcacacagcgcancaccgggaaggggcgccggcncacagcagcacgnggaaacngcgggaacccgcccaccacggccgaaggcacganngaagcccagccacccaaagnngcggaggggaagganggccggcgacgggnccacaaggggccccagaancgnccgggcnacttcngggacaaaggggaaaggacggaccgcgaccagnacaggagagtcggagagagnggatgggaaaagaagtagagtaggggccgtcagacagtgggtaagagaaacagtagatggccaactcngcccggcgnanccagaagnncacccggaaggnggcaggaaccgacnccggacacagcataaagcgaggggaggagacgagagaataaaggcgacatggcacctgcaccggagacggggagacgcccaagcccgacagcgccnncngctacggaaaccccagtgaggccagggaggcggggcgcttaatcgtggagccggtatacgcgggacgcaagcgaccnaggngggaggaagnggcagagcggccnggngggggngggggggcancnggncaaaaccaacangacccccnagcnaggggggngcacaaaggagagggcaggacccgaggaaggggaaagacggaacccagggaggtccaggtgcaggnacccagggaccc

SEQ ID NO: 502442 - DNA, 292 bp, Homo sapiens
aggaaagcataagtaagtaccagaaaagacaacatatcgccgaccacacgtgatgaatacaaacccacacgattagccctgatggcctaaggaacaatggcatgctgatctaggatcctctaagcacaacgcctgatcgcctcctccgtgtggtagccaggccaatacaggctgctaacttcatcaccacattgcactcgctcatacctggaatccttgctcctagcttcaccagcaaatcgtaagcgctccttcctacttcctagcttccttcaccacatcgcactggctc

SEQ ID NO: 502443 - DNA, 106 bp, Homo sapiens
  misc_feature (36)..(36): n is a, c, g, or t
  misc_feature (94)..(94): n is a, c, g, or t
cacacctacctcaacatgctggaagaagcagaaaancgcgatcaccgccggctggccaagcagctcgacctgttccacatgcaggaagaggcgncgggcatggtgt

SEQ ID NO: 502444 - DNA, 475 bp, Homo sapiens
gcacccatccttctttcttttatgaaaatatatgattgacttgtctttcctgacaggtttctttcctggtttttctcctcacagaggccaatgtaccttgaagccaacaaataaacttacatttcagggcttctcacttgcaagacccttctgatgccacatgtctactctggcaccccagcagcagcgcacaacacaacactgttctgttgctgggaggtcacctgggtcagggttcctaagtcttggagtggggtcaggctactaccatcactatctccactttacttggagtccaacaaaagccctcccatgatgcattcgaggacattagatctcatgtcccaatccaaggagaagatctgaaggaaacgctcttctctgctccttgcccggggtcaccttgatccaaacttcctggctaccttatgtcaccccccacttcagctcaagatttgggaaggtggtgggaacc

SEQ ID NO: 502445 - DNA, 832 bp, Homo sapiens
cggtgctgtcacgtctcctgtgctgcgcggcttccgtgatccttgatttgcgctctatgatgcgcccggctgttgtgatccgatatgtccatgcagaggctgtggacaccgatggctcataggagcatccagactgccctgcctcccggcctgtactggtggcgtcctcaaggcccagtctttcctgttcggggtgtatgtcggtaggcaagtacttggttgaccctcgattatactacggtcgcgcgcggattgttcgtcgtgttggcccgatgcccttcgggccgtgtcctgcttgccgtcttggagttgactgctcgtttggcatgcatccctgctacgaggattgcgctcggctttgagcagttggctcttcccgtgccagaacccggctctcggattctgaacgtcgtttgatcagtgggccaggtaacactcactatgcatcgtagtggccccagctgcttcgcaaggtctaccgagccaggatgcctggagccgctgctacaggtaggtctccaattggggatgcttgcgccaactggaggaggctactaccactattcctactcggtggtgaggggccttgcgacgcggatccgttgcccgtggaacatcctacattcccaggattgaccaacctatggacgaggcctgttctttacgggagatccttgcaaggttgcagaagggaagatcaagacgggagcaggaggctgcagatcttggtaccgcaggttaagcgccggcgctgcgtcgccggagacttgtcgccggtccttgtccccaggctgcttgttgttccgttgaagggttggtcaataaaccttgc

SEQ ID NO: 502446 - DNA, 930 bp, Homo sapiens
cagagccccccacagctggcggctgccctctgaccccgcaaaacataggacttcagaggctggacctacagacccagatgagaagtgctccctaccctcacctcaagacgaccatggcaccatcccagactggaagctacagctgctatcccggcgccggcaggaggaggcgtccggttcgaggccgagagaaagcagaatctgggagctgcctgtcccagattgccatgcctggaaacgagggctcctggagcgccgcccgggccaagcttgggctgtccccatgggagagcctagccctgtgctagggactgtagaggctggacctcctagacccggcatgacgtctgcgtgtccgttctggaggcctatctgggccagtgcacctagaaccgattcagtccaggcaggagcggcagcaagcagctagcaagcaacgaacaacgggagtgaagagctgcatacgcagagagaaagcctgggcctctggaggcccgggatgcggagacccagccctggggagatgcgggatcggagcccccaagggcagagagtcgagagaacgagagactaagtccgagggagaccacgagacgaggaggctgcggcatagggggagcccaagagttgagcctgaggccctctggaggctcgggcactggacggcaaagcccagcgaaacgtgggagacaggagctcccgactgtcagcagcgcctgcaacatgcgccgcttgagtcctgcagaaagcgtccaggagcggacgcgctgacgactagcacgagtcgtccgagtagcaacagccccaggacgaacacgaggctcgcaacggttcacgtgtcgccacggggcactctgccctaccgagaggttggcgccttgactgagggccccttactggacaacctgactcctgagacccccggcaact

SEQ ID NO: 502447 - DNA, 963 bp, Homo sapiens
  misc_feature (963)..(963): n is a, c, g, or t
cgtactgtgatactgcagcgcacctataagaatcgcgcctcgtccgggtcctcaggtacgagtgccgcccatcagttgaactgctccgacgcgaaccccagtaccaaggtaatttctattgcacgagatcatgctacgagtgaaggatcctaaagagagtcactgtatttttatactaggagttcttggacctgacgctacatccacaaaatgtgattttcccattatgaagtttacactctacttcttggcttatgaggataaaaatgacatccctaaagaagcaagatgaaaaatagcctgggcgctctccagaaaagctacacttgagctgacacacaattggggcactgaagatgatgcgagccagagttaccacaatggcaattcagaaccctcgaggatatcgtgcttgtaaaagggtttgaacgaacctgggagtcaaacttttgtgaaggaacccccttgatgatggtaaaatgcaacggcctggcatttattcaacgatcctgagtggctactggactgaaattttgaattcctaagccaaatggcacccttaatgtacgtgctgtgagaattctccttttgaggattccgaagacaggaaacactgtgattcaaggatattactaccagaagcatttagggagtgctggatcacgtggcccgatcaaatcattcttcagtccatttccccataccctatatcaagttgtccttttcaacctaactgttccgccatcgtggttacaacagggtaatcccatgcctgatatcagttgggtacctcttttatcggtatcactaaacacgtccctaacgtggtatcccttctttgccctagatatttccttcacactgctgacatctttaaaaaaaacatgtgggcggtctcgggacagacacaaaatatcgggagaatgttttcaaacgctcaaaaggcacatacagtgagatatn

SEQ ID NO: 502448 - DNA, 353 bp, Homo sapiens
cgcaccgttagacacttacgatctcaaaaaaaaaaaggaacaggtcttgcccctgttgcccaggctggagtgccgtggcacgatcatagctcactgtggcctcaaatttcctgggctcgactgattctcctgcctcagtctcccaagtagctgggaccgcaggtacatgccaccatgctaggctaattttattttaatttttagaaaataaaatattttttattttatttaggcaacatgctatgttgcctagacgggtcttgaactcctggcttcaggctatcctcttgcctcggccaaccaaagtgctgggattgcaggtgtgaactgccatgcctggctttctattctct

SEQ ID NO: 502449 - DNA, 113 bp, Homo sapiens
gctatctagaggatcctcaaagtgcctcttctatatctacaagatgacagtcaagaacttttaaatcgtctaagaaagaccagcatagctgtactttattcaataaaaatgat

SEQ ID NO: 502450 - DNA, 128 bp, Homo sapiens
ccttagggggataagtgtataacctgatggtgattttctcgtgtgaatgacgggttctatgttgttcatgtggtgggtgattgacccccattgtgttgtggtacgatgtgtcgagggagtatcgggct

SEQ ID NO: 502451 - DNA, 315 bp, Homo sapiens
cggacgcgtggggtgacaagcggtgcggcctcccagctctctaagatccgagtcgtccgggaatcccttgcccgtgttctcaccagttattacccagactcagaaagaaacctccgggaattttacaagggccagaagtaccagcccctggaccttcggccttagaagacacgtgccatgcgccggccggctccacaagcacgaggagaacctgaagacccagaagcagcagcggaaggagcggctgtaccccctgcggaagtaccggtcaaggcctgaggggcgcattgtccaattaagcacagctggctgaga

SEQ ID NO: 502452 - DNA, 358 bp, Homo sapiens
  misc_feature (17)..(17): n is a, c, g, or t
  misc_feature (47)..(47): n is a, c, g, or t
  misc_feature (72)..(72): n is a, c, g, or t
  misc_feature (89)..(89): n is a, c, g, or t
  misc_feature (117)..(117): n is a, c, g, or t
  misc_feature (247)..(247): n is a, c, g, or t
  misc_feature (264)..(264): n is a, c, g, or t
  misc_feature (275)..(275): n is a, c, g, or t
  misc_feature (284)..(284): n is a, c, g, or t
  misc_feature (295)..(295): n is a, c, g, or t
taacttaaaccccagtngttaataatggtgccatcttttaggaaaangccatgccttggtattttccctttncaaaaagccagattatnggccgggtttttgttggctccattcccngttaatccccaggcacttttggaaggccgagggcaaggaaggattgcttgagcccaggagtttgagagcagcctgggcaacatatcaagactctgtctctttaaaaaaaaaaaaaattacccagggcatngttgttccacacctttngtcccacctantcgggaggnttaaattcgangatcacttgagcccaggaggttgaggctgcagtgagctgtgattgtgccactgcactccagcc

SEQ ID NO: 502453 - DNA, 690 bp, Homo sapiens
accttatgccctaatgtcgtatatataagcggctccggagctagagacgatacgtgccatgcgcaagagctgtggtggatgcgaaagaatcacgtaccgagcttctgaccgactctgacttgacagaaaacagtaggatgaaagtggacggattcagagcgcatacaaccactatgatgatttgatcatcataacatgatcagatctagtacgaagccttatgcaaaccctgcaaactgccatatgagaaatctgagaatggaaccacagtgggtcccaatcagctgggtttactgatgattcagtaaggttaacaatgaaaattaaactcttaaaaagtgactgcaacaaataaaccttctactgagaaaatacatcacagatagaagattatctgctaagtccaggcatttttatggtgtagattgaaataatagtacacttctgaatttttatataaaatgtggttggaaggtgtactaatatataatttatcttaatttttctaactttgtatggataatctttctattcatatcacatagagaaatgcgttgaagcatttagtatatgttttgatttagtacccttgcctttttcatcaaaggaattttcaaatcattcactctaacattggtctcatattttcactgtgatcatgaatatacttgacatagtttgtaagctgtt

SEQ ID NO: 502454 - DNA, 952 bp, Homo sapiens
cctatcggtactgcgcgggtccttctgcccctgtgtcccgcctgatttctctctattgatggtggtccccctgcgcccgtcgcccctcggctaaattgttgccacggtggtcattttatgtctcccttctgcgtgcgcccccttttgcccccctgttgcccgtgggtttgtcagcgccccctgggtcgtgttgtacaccacggggaggtcactaccgttatggccccagggtgactgggtttttttagtacccggacggcgtgggtggttgtagccccactggtcaggtactgttttcatgcttctgtcgctgtggacgctgtgtgccccccgcgcgtggccccgatttggaatcgtgcctctcgggcgctcaatcacagtatgtcactttacaacgctggtctaacggttatatgtcggcaaattcgtccttcgattcttcagcgcgcagaacggccgtgtatgtctcgtggttgctgtaataaaattcacaccacccatgggtccccctttaatttatcgtaccacaacaagatatgctgttattgactacaacacaaccaccaccccacccctgctagtagttcccacaaacagcccactcctcttcgctaaaaggttcctgaacataaaagggccttgtaacatttttttaattttttaatgaggccccccctaaacatttgtttcgccaatatacccccaacgtggggaccctggaccaattcgcctcacactgttctaatccttgtcaatatccccctcgattcccctcgcatttcccgccaccccctccttaacgcgtgtccaaacgaacgttccagtagatactgtcattactactcactatactgcgctagctctctctcagccgaactgaccgagcgcaagcagaccccctgagtcgaaggaagcggcggcccattttcagcatagcatacattatacgaag

SEQ ID NO: 502455 - DNA, 157 bp, Homo sapiens
tgatctcactcatctactactcgtgacgcttccagctctgcttttgaaagcaagatgagcacactcagctgagaggtcataataggcatgatcgacatgtttcacacatacaccagacgtgatgacaagattgacaagccatgcctgctgacgatga

SEQ ID NO: 502456 - DNA, 322 bp, Homo sapiens
tctccgagacagggtcttgccctgtcgcaagcagtggcatgatcttgcctctctgcaacctccgcctcttgggctaaggcctttttgccacctcagcctcctaagcaggtgggaccacaggcgcttgccaccaggcctggccaatttatatatatattttttggagagatggggtttcaccatgctgcccaggctggtctcgaacttctgagctaaagtgatccacccaccttggcctcccaaagtgccgggatgacaggcgtgagccaccaggcccagccctaaaatatgactttttcaagcaaaaagtttaacattgtct

SEQ ID NO: 502457 - DNA, 283 bp, Homo sapiens
ttttttggggttttccccccccttacccccccccgggggggttttgcccccccgattggccggggctttaacctttaggggggttcccggtttttgcccctttccggggttttttttcccctttttccccccctttttttttcccccccccaggcccttgggataaacccacccggggttggttttttttttgggagcccccccgggggtttttttgggggcttttttttttgggtttccccccccggggtttttttttgccccccttaccttttttttttga

SEQ ID NO: 502458 - DNA, 155 bp, Homo sapiens
gccaggagatccagatgagcagcagatgtacatcttctagtcatcggtgccaagcgtaccctgaccatcagccagtgctcattagcggacgacgcagcctaccagtgcgtggtgggttgcagaagtgtagcacggagctctttatgaaagagccc

SEQ ID NO: 502459 - DNA, 142 bp, Homo sapiens
  misc_feature (45)..(45): n is a, c, g, or t
catcatgtccagctaaacctcggcccagaagccctttaaggctgncagttacgtctcatctcccggtgtgatgctgacaccagcggcctggagtcgtgtaaaggaggggagccttaccaagactcctgcaaaaacccttgga

SEQ ID NO: 502460 - DNA, 787 bp, Homo sapiens
  misc_feature (18)..(18): n is a, c, g, or t
  misc_feature (62)..(62): n is a, c, g, or t
  misc_feature (122)..(123): n is a, c, g, or t
  misc_feature (180)..(180): n is a, c, g, or t
  misc_feature (189)..(189): n is a, c, g, or t
  misc_feature (274)..(274): n is a, c, g, or t
  misc_feature (301)..(301): n is a, c, g, or t
  misc_feature (308)..(308): n is a, c, g, or t
  misc_feature (311)..(311): n is a, c, g, or t
  misc_feature (349)..(349): n is a, c, g, or t
  misc_feature (357)..(357): n is a, c, g, or t
  misc_feature (376)..(376): n is a, c, g, or t
  misc_feature (388)..(388): n is a, c, g, or t
  misc_feature (438)..(438): n is a, c, g, or t
  misc_feature (445)..(445): n is a, c, g, or t
  misc_feature (460)..(460): n is a, c, g, or t
  misc_feature (469)..(469): n is a, c, g, or t
  misc_feature (483)..(483): n is a, c, g, or t
  misc_feature (516)..(516): n is a, c, g, or t
  misc_feature (542)..(542): n is a, c, g, or t
  misc_feature (553)..(553): n is a, c, g, or t
  misc_feature (573)..(573): n is a, c, g, or t
  misc_feature (603)..(603): n is a, c, g, or t
  misc_feature (608)..(608): n is a, c, g, or t
  misc_feature (633)..(633): n is a, c, g, or t
  misc_feature (642)..(642): n is a, c, g, or t
  misc_feature (653)..(653): n is a, c, g, or t
  misc_feature (662)..(662): n is a, c, g, or t
  misc_feature (693)..(693): n is a, c, g, or t
  misc_feature (695)..(695): n is a, c, g, or t
  misc_feature (711)..(711): n is a, c, g, or t
  misc_feature (718)..(718): n is a, c, g, or t
  misc_feature (724)..(724): n is a, c, g, or t
  misc_feature (774)..(774): n is a, c, g, or t
agcgcagcgcacttgctnctaagcaacaacaacaacaataacaaaaagctgcctcgcagcanagcgcagcgcgcagcgcgcgcaacaaaacaacacaagcacatttcctcttttctccctcnngcccaccccccgcccacatcccctgcatcatgcgcgctctcagcagcaacacatccntatttgccntttagcataaaagccagcattcacccacatttcactcattttctctattttttaaaagtgccccagcattgtctcaaagcatagncagaagctagggagcattaaacaaaanatctggnaanccacaaaagcttagctagctttcagcatgcatctgggngctttggnctgctgtgcagggggtggncagcaatgcagngctagggcgccctccagttcgctattcttttctgccagcctttccgcttncttcagncttcctccaacatgnggggggagngttaggcgccactnccgcagggttcaaacttccaatggttcaaaagngttggagggggacttcaaaaacttgnccccttctctngcctcgcaggggttttcagnccacccttttcaacccattttatttttccnaaaanctcggcaattcaaatggaaattctnaaaagttgncgggggggggnaacattcgngccagaggttcaaattgggttaatttgcctngncagggtttcgttttgngttgttncaacancaagaataaaaaacttttgggttccttttcagtgttatagagggggccangccgcctcacccc

SEQ ID NO: 502461 - DNA, 154 bp, Homo sapiens
acagagaaaacaaatagttgtcgtctcttcaacgaatcgagaatagcgtacaaaaaaaaccttacatcacttacgaatgaatacatttacaggcgtacctgcaaaccgcttccaactcaacgcaagtaacagcccaacggtgaccggcgacttc

SEQ ID NO: 502462 - DNA, 240 bp, Homo sapiens
gctcaacttccagacgggcctcctggtgcctgcgcatatcttcgcattgggcccgcgccagcctttcacgggggacaccatcggccttgaacatcatcaaggggcaattgaggaggggctattttggcacgggcagggttcaattggctacacgggtgttggtctaactccagcggggcgtgttggagccccgggactttgtcctggacgtgagattgaagtcgtctcgaggcagagtct

SEQ ID NO: 502463 - DNA, 332 bp, Homo sapiens
ggcccaggcccaggagggcaacgggggggccgggaaccccaaggagccagggcgacgggccgccggcagggaggagggggagggggccggcgggaaggagtcatgcgcggaaggccgcggagcgaccgcgacgggggacagaggaaggacgccccagaaaacggcagagaagacgggaccagccccggagaggaccaggaggagcagccgggaccggcagggaacggggcgcacggcgcggcagacggggggagaagggcagagccacagaagggcgggccggccccgccggggacaggaggccggcaggaaagagcgacagacacagcaaa

SEQ ID NO: 502464 - DNA, 356 bp, Homo sapiens
  misc_feature (193)..(193): n is a, c, g, or t
  misc_feature (229)..(229): n is a, c, g, or t
  misc_feature (242)..(242): n is a, c, g, or t
  misc_feature (244)..(244): n is a, c, g, or t
  misc_feature (249)..(249): n is a, c, g, or t
gccgacgctgatggaccctgatttatacaacatctctgcagtcaatccataactggcaataactaagaagtcaaaaaatgactgcgctcatgtggatgcatctacatgtattatcatggaacactttgactgtttattcagcatttactctaggccaggaattgtgataaataattacttatgtaatcatgtntaatccttgcactattaccaagaaggagatagtatngattattcatatntnatgantgagaactgaggcttacagagttcactagattatttgtctagagtcccccagctgggaaatggaggtgctaagattcttaccctgactgactacgtcggctaattca

SEQ ID NO: 502465 - DNA, 326 bp, Homo sapiens
ggatggcatcccctggaattgtgcaaaggccccatttaccatgaacaccttttgacccatgccctttaaagctgggaccctgagtgagggggagtgaaaggggcgtggttgaatcaactgtgttacaggcccgcatggaatattaggtagaggttaaaaacaaaaaatgaggatagccaggtgtggtggtgctcccctgtagtcccagctactcatgaggctgaggcgggaggattgcttgagcccgggaggttgagggtgcagtaagctatgattgtattagtgcccttctagcgtgggcaacagagtgaaaccgcatttttaga

SEQ ID NO: 502466 - DNA, 216 bp, Homo sapiens
tgaacactgtttcaggactgcagcacctcaacttgctctccctgtatgacaacaatgctgcagaccatcagcaaggggctctacgcccctctgcagtccataccagacactccactatagcccaaaacccatttgtagtgcgactgcacacttgaatgtggctaggcctgactcaccgtcctagtgacaaccccacatctgatgacaatgctgggg

SEQ ID NO: 502467 - DNA, 249 bp, Homo sapiens
gcgagtgatctagaggatcctggcaggctctctacctccgggagggagcgcatggaacctagacggggttctggtgtaccctgggataatggatgtccaggcatgggaccttgattttccacacggcaaaaggagggaacggaactaaatcatctccaaggttctttctggcaattagactccttatctctcagcaagatgatgtgtactcagcgtcttccaccccaacggggaccacctctctagcgg

SEQ ID NO: 502468 - DNA, 339 bp, Homo sapiens
agttttgggggttattttttattttaaaaaaaaaatgacttatttaccccaagctatttttttcccttctggctgtaaggtttggacagactggtttggtaaaagctaaacctttgtgtcttttgcccttttaaaggaattgttaacattggaattgagggtatggacaaaaaagttggggtccaccccctttaaaaagtcatattttttcccaaaaatagaaaatccttttacataagaattttaaggatttgccataaatatatggaaatagattggatggattcctatatttttatttttccttttattattaagtaaaagatccttaaaagtgaa

SEQ ID NO: 502469 - DNA, 769 bp, Homo sapiens
tttttaaccaaggccaaattggttcataatttttttggttaaaaagtggggtttgtgccatgtgttcccccagttctgggttctctccaacctcgctgtgggcctcaggtgtgaactcgtgccggcctctcgtgccttctctatacagagggcgtgggaattggccaggacttaacccaccaaacacgtgtggacctctcctttatcttttataaagtctccgcggtaacaaaagagttcgcttttgtgctccctccagtgaaaccctgtaaaacacttgcttgtggtgtgtgtggtctctctctgttgtcgcaaaactcgtggacactctttttctatcagagtgttcaatagagagagtggtgggctctgagactatgtgagagagtctatacaatctctcactcgcgtctcagaatcgagtggtgcggcagaggagagaaaaaacccgatgtgtctcaaccacgacgaataactactgtgggtcgtctcatccctagcgtagagcggcgccacaatacagacaacataacgctctcccgtggtgggaaccaaccccccctcatggggttgtcgcccactataacatactaagctatcataaccgcccaacgttgtagtaatactgtagtaactaatccacgtgcggcgccaccaccacactcttgtttttgcaaacacatatacacccctggtggtgagcaccccggcaggcacacacaataccaaaaaatactcaacccacacgctagtgtggagcaactcaaaa

SEQ ID NO: 502470 - DNA, 801 bp, Homo sapiens
ggcctgggaaggacagagggaacgggtcctggcggctgctttgctaaagggcccgtgttctgttgcgggaagcttccgggggtcgctcgtgcgtgcgagcccaagcccctcctcacatcacaacttccccgttcctgcgtgccccgtgagtcgagccaaagtcggctaacggtacttctcaggtccgccagagatgtgtgacttcagaacgcgcagctagatttctacgcatacatgttgcaaagtaactctggagttctgtatggtagtaaaatgccggataagaaaattctgcattgaaagaatgtctaactgcttactataatgatccagccttttaatgaatgaatgcaaacatggaatacctgaaggaaagggaaagaattcatgaaaagctggaattcctacgaagaaaaggctacagaagcttccaagcaagcatgtaagcgagatactcgaaatgacattcaggaactctaatattccatggaaagctcattttatagtcctttaacataatgggatctcaagccatgataatgtttggggcttttaccctttaattaattgcgaaagattattgagctttcaatctggacaaagtaaacttatttttaatgctcagagaagaaactccacatgggacaacttggacacacgaaacaatggcattggtgtgcgcgtcaccacacggttggcccgaatgaatggagcttgtttaggcacacaagccgttgttgatgcgcgcgggtccccgcacagatggtgtggtgtatcaagtgcgggttccgacagtggctc

SEQ ID NO: 502471 - DNA, 805 bp, Homo sapiens
gggagtgtctgcatgccatgtctgtctggtaacatcagacagaagcttcagctgtgtgtgcaggtggcctctaaggtaccaggagcagctgggcacgcaggccctggatggagctcttagaatccttcgagagttacatacaggactctacatacttcctgggctcaatcgtgaacttcagccgaggacccagatgtgcatctagaaactaacagttcaggctgctcgtgtaatgacatgggtcagagtcactggaggtggacgtaggatatgccgagagtagcagcgtgatacaacgccatcagcgtgtgaagaacttcctgaaggagggcaagctcacgagatcacagacttcccctcatcatcggtgtgtgatcgttttggcttatgtccatgagccttggtcctataatttatgaccgcaagcagacctgccagaggtacattgagatctacgtgcagacaggtcaacccgtagccggacccaggtgtgattggagggctgcttgatgtggattgtgctgagcgaaagtgactcaaggcactcaatcatgggccatgtgcagcggaccaggagcctcgtacctgcgtgagtgaggcgtggcagaaacgtacgcacgcacggaaccatacggactgcacacgacacggacagcagacagccatgcgaagaggaaggcaccgaagaatccagggaagcgcactgacgagagaaggcctggcgcacgcacacacagcgccggggacagaacatctaacaataggagggggccaccaacaggacccgcaagcgccacaccggaga

SEQ ID NO: 502472 - DNA, 439 bp, Homo sapiens
  misc_feature (17)..(17): n is a, c, g, or t
  misc_feature (32)..(32): n is a, c, g, or t
  misc_feature (78)..(78): n is a, c, g, or t
aatgttggacctgtccnggtgaggggataagnggattaccccaaatgttatgccagatttttttaaataattataatngggaaataatatatccacccaaaatagaaagtccttagagccttccttttaactaaccagtaaaatacatgtaatatgttttataattttccccaaattatttgtaattattgatatagcataattagtgtgttgtatactatcagaatttaatatttaaataatgattgcagagtttgaattctgggggtgatatattcaaagacataaattaattatattaaccctcatgttatgagctaagaaaaaatttcttgagaaagcagtggggcaatgtgtccttttttatgattaattcctaagctgtcactaaaggaagaataacgagtttgctataaatatgcattttgacaaaaaaaaa

SEQ ID NO: 502473 - DNA, 435 bp, Homo sapiens
gggacctttatatcagagaacacctattatgttctgactagagataacccacttcagggcatctttcaggatcatagtgcaactgcagtcagaatagcgcgtactatgcccacgtagggacttgacctgcaagagcagtttctccacctctggggccaaagtctcggcacatctcagcagagcccatggtgctcaaagtgcacaaggacagagacattgtaatggctgaatcccctgactcaggtcaatagcagggttagggaggacgggcagtcgaacctctgagaaaatcagtcctttacaatacccacaacaggcagtcccctaggatttccaaggtccctactctcccatctccctaattccaagtgattgccagaaccctctcacttcttgatgctgttggtaatgagcaggtgggcatcgtgcctctca

SEQ ID NO: 502474 - DNA, 105 bp, Homo sapiens
tggctgatctagaggtccccctcacattggcagtggaagtccccctgctgctggcagagtttatgccaggcccacttgaaaccatcccctacacgtgtccccgtg

SEQ ID NO: 502475 - DNA, 1034 bp, Homo sapiens
tgtgactcatgataggggctcttgtaaagtcacagctccgtggctctccctctccctccccctccccctctccctccatctcatgactccctctctctcctctgtctccctactctctccatggtctacctctgatgcctagctgaagctggatgtagtgccggcatcttggtcactgcaagctccctgcctgatactcctgcctcagctgcctgtgcctgggattgcaggcggtctgccgcctatgcctgactggtttgcgttccacttcttataatcgctggagaacggaggtttcgctgtgttggccgggatggtctccgagactcgtaaccccgaagctgatctgccagaccttaggatctcccgaggtgccgggtatcgctaacaggagctctcgtcccacttcagtgttcaatgttgcccagtcctgaagtgccagtggccatgatcctcaggatcgattatcaacactaccaccttaccatgccgcacgtgccttggcaataccacaaagtgcctgagatcgagctttctgcccggccgacaacacccctctgagaaaactgagagaacatcctgtgactggtcagccccatcgtctgggatgtacacgaccccgcctattgacccggcgccagctctggacacgtcgaggcaccgcttggaccaggttgcccatctgaactgaaggtgcttccctggcccgggccgcccagtactcggacattagcgacagattctctgccccggggcccgaccgggagttgaagtgccccactgtcacggcagaacccatcggtgacagaagggacgccttagccgaccaacacgtctcaaaaatgggaagccccgcccgcagcagccccgtgaagcaagatcctacctgtagacccgcagtaagcatgcagaccacagcgagttccgcacacccacgcacaccgacaagactggccaccccacacagacagacaggacgcaaccgaccgtgtgtagaggacgcacccgcaaaagcaacaagccagcacacacaa

SEQ ID NO: 502476 - DNA, 169 bp, Homo sapiens
catgcacatacaggcagacacacacagctgcatgcacacaacaggcgaacatgcacacaggtggccacatacaaggcagatacacacaatcacatgcacacacaggtcgacacacagtcgcatgcccacaggtggacacagccacacacagatagacacacagttgcac

SEQ ID NO: 502477 - DNA, 524 bp, Homo sapiens
  misc_feature (12)..(12): n is a, c, g, or t
  misc_feature (32)..(32): n is a, c, g, or t
  misc_feature (128)..(128): n is a, c, g, or t
  misc_feature (233)..(233): n is a, c, g, or t
  misc_feature (326)..(326): n is a, c, g, or t
  misc_feature (508)..(508): n is a, c, g, or t
attttaccacgncttaaaagttaagcatgtgnaacaaatctcttaggaccattacttaattttaaacttaatcagtgtgtgtccacagagcaccagtgggcttcgtgagttcttgaagtcactttggncccaaaagagttatcgcccgggtctagcaatttagcagtacagctgttccacgcgggccagggcgggcatgaagtaagtcccgccgactacgtgcccggcacagntggtccctgcggcgaacgttcgggcgctaccagaactccgagctgctgatcagcaagctgccgctcctgcgagagtcggcgttggacccgtgncacgagagcgaggctgaagaactttgtgacacaatagtccacctccctgcaaaggctctgtcagagactcacatctttcctgatggatagctgtgaagcattctcttacccaccctactgcatgttgcaaagtattctttaaaatgaagtgagtaaaatacttggatgacgttatcttgagnccaaggaagattgcta

SEQ ID NO: 502478 - DNA, 197 bp, Homo sapiens
tcgtacgtcccaactacttacgacttacttccgaccgcctggtcggctacgacatctgacttccggatgacccgaaaactcagaatcggtgttggtatagaatggggtctcctcctccggcggggtcgccgtacggtggtgttgcggttgcggtctgttagtcgtatagtgatggtccgagcggagccgggtaccga

SEQ ID NO: 502479 - DNA, 240 bp, Homo sapiens
atgtaatatcactgaacagcaacgcgccccagaggtggatagtctgcagaagctctcaacacacatgggctggccaggaaccatatcaacaagggcggcatcaccagacttcaagaatgtagggccatcttccagctattttaccatgaacggcgatccatcttattccttcgagctcagcataacttgcatgcaatagtgagcctgtgtggcaataccaatacagtgggcatacgccgg

SEQ ID NO: 502480 - DNA, 84 bp, Homo sapiens
gtgtcgagttcccaaaaagctccgcaggggctgtagggaggttgaagcatatgaagaaaacaccagccttgaacagatacgtag

SEQ ID NO: 502481 - DNA, 146 bp, Homo sapiens
atgagtaaatcttgggtagaggctgcggagcatgatcatgccactacagtccagcctgtcaacagagcaagaccccgtctcaaaaaaaaaagaaggtcctttcccacaatgtgtggtgtgaagataggtgtctatgcaaatagctg

SEQ ID NO: 502482 - DNA, 463 bp, Homo sapiens
  misc_feature (31)..(31): n is a, c, g, or t
tcactatttgggcagggagttcaaaaatagncaccaataaaatttgttgcctagattgacttttcctctcacaataggtttctctgaagcatgtgatgcttgctgtttgatacagcattttacccacagtagaacttctttcagagttggaattaatcttcccaaaccctgccactgctttattagctaagtttctatgatattctaaatccttcgttgtcattcagcagtgttcacaaggagttgattccatctcaaaaaaacactttctttgctcatacatagaaagcatcttcttattttttaaagttttattatgggattgcggcaattaataatggaaaagcttgttttattgtaaaaattaccagtatgtgacacagagacaagaagcaagcagatgccattggaaaaatggtgccagtagacttgcttgttgcagggttgccacaaaccttcagtt

SEQ ID NO: 502483 - DNA, 786 bp, Homo sapiens
  misc_feature (12)..(12): n is a, c, g, or t
  misc_feature (23)..(23): n is a, c, g, or t
  misc_feature (51)..(51): n is a, c, g, or t
  misc_feature (277)..(278): n is a, c, g, or t
  misc_feature (280)..(280): n is a, c, g, or t
  misc_feature (283)..(284): n is a, c, g, or t
  misc_feature (286)..(286): n is a, c, g, or t
  misc_feature (292)..(293): n is a, c, g, or t
  misc_feature (297)..(297): n is a, c, g, or t
  misc_feature (300)..(300): n is a, c, g, or t
  misc_feature (303)..(303): n is a, c, g, or t
  misc_feature (309)..(309): n is a, c, g, or t
  misc_feature (312)..(312): n is a, c, g, or t
  misc_feature (315)..(315): n is a, c, g, or t
  misc_feature (318)..(318): n is a, c, g, or t
  misc_feature (321)..(321): n is a, c, g, or t
  misc_feature (323)..(323): n is a, c, g, or t
  misc_feature (325)..(326): n is a, c, g, or t
  misc_feature (334)..(334): n is a, c, g, or t
  misc_feature (343)..(343): n is a, c, g, or t
  misc_feature (355)..(355): n is a, c, g, or t
  misc_feature (358)..(359): n is a, c, g, or t
  misc_feature (365)..(365): n is a, c, g, or t
  misc_feature (367)..(367): n is a, c, g, or t
  misc_feature (372)..(372): n is a, c, g, or t
  misc_feature (382)..(383): n is a, c, g, or t
  misc_feature (385)..(385): n is a, c, g, or t
  misc_feature (397)..(398): n is a, c, g, or t
  misc_feature (403)..(403): n is a, c, g, or t
  misc_feature (407)..(407): n is a, c, g, or t
  misc_feature (409)..(409): n is a, c, g, or t
  misc_feature (427)..(427): n is a, c, g, or t
  misc_feature (430)..(432): n is a, c, g, or t
  misc_feature (434)..(434): n is a, c, g, or t
  misc_feature (439)..(440): n is a, c, g, or t
  misc_feature (442)..(442): n is a, c, g, or t
  misc_feature (446)..(447): n is a, c, g, or t
  misc_feature (449)..(449): n is a, c, g, or t
  misc_feature (452)..(452): n is a, c, g, or t
  misc_feature (458)..(458): n is a, c, g, or t
  misc_feature (460)..(460): n is a, c, g, or t
  misc_feature (463)..(463): n is a, c, g, or t
  misc_feature (468)..(468): n is a, c, g, or t
  misc_feature (472)..(472): n is a, c, g, or t
  misc_feature (478)..(478): n is a, c, g, or t
  misc_feature (483)..(484): n is a, c, g, or t
  misc_feature (488)..(488): n is a, c, g, or t
  misc_feature (490)..(490): n is a, c, g, or t
  misc_feature (493)..(493): n is a, c, g, or t
  misc_feature (495)..(495): n is a, c, g, or t
  misc_feature (500)..(501): n is a, c, g, or t
  misc_feature (505)..(505): n is a, c, g, or t
  misc_feature (512)..(512): n is a, c, g, or t
  misc_feature (514)..(514): n is a, c, g, or t
  misc_feature (517)..(517): n is a, c, g, or t
  misc_feature (520)..(520): n is a, c, g, or t
  misc_feature (523)..(523): n is a, c, g, or t
  misc_feature (526)..(527): n is a, c, g, or t
  misc_feature (533)..(533): n is a, c, g, or t
  misc_feature (538)..(538): n is a, c, g, or t
  misc_feature (542)..(542): n is a, c, g, or t
  misc_feature (557)..(557): n is a, c, g, or t
  misc_feature (560)..(560): n is a, c, g, or t
  misc_feature (564)..(564): n is a, c, g, or t
  misc_feature (567)..(567): n is a, c, g, or t
  misc_feature (571)..(572): n is a, c, g, or t
  misc_feature (576)..(576): n is a, c, g, or t
  misc_feature (582)..(582): n is a, c, g, or t
  misc_feature (586)..(586): n is a, c, g, or t
  misc_feature (593)..(593): n is a, c, g, or t
  misc_feature (595)..(595): n is a, c, g, or t
  misc_feature (600)..(600): n is a, c, g, or t
  misc_feature (603)..(604): n is a, c, g, or t
  misc_feature (607)..(607): n is a, c, g, or t
  misc_feature (609)..(609): n is a, c, g, or t
  misc_feature (611)..(611): n is a, c, g, or t
  misc_feature (617)..(617): n is a, c, g, or t
  misc_feature (621)..(621): n is a, c, g, or t
  misc_feature (631)..(631): n is a, c, g, or t
  misc_feature (633)..(633): n is a, c, g, or t
  misc_feature (637)..(638): n is a, c, g, or t
  misc_feature (649)..(650): n is a, c, g, or t
  misc_feature (652)..(652): n is a, c, g, or t
  misc_feature (654)..(655): n is a, c, g, or t
  misc_feature (662)..(662): n is a, c, g, or t
  misc_feature (668)..(668): n is a, c, g, or t
  misc_feature (671)..(671): n is a, c, g, or t
  misc_feature (674)..(674): n is a, c, g, or t
  misc_feature (686)..(686): n is a, c, g, or t
  misc_feature (693)..(694): n is a, c, g, or t
  misc_feature (704)..(705): n is a, c, g, or t
  misc_feature (712)..(712): n is a, c, g, or t
  misc_feature (715)..(715): n is a, c, g, or t
  misc_feature (747)..(747): n is a, c, g, or t
aacatggcgggngtggaggaggnagcggcctccgggagccacctgaatggngacctggatccagacgacagggaagaaggagctgcctctacggctgaggaagcagccaagaaaaaaagacgaaagaagaagaagagcaaagggccttctgcagcaggggaacaggaacctgataaagaatcaggagcctcagtggatgaagtagcaagacagttggaaagatcagcattggaagataaagaaagagatgaagatgatgaagatggagatggcgatnnanatnnancaaatnnaaanaanaanaaaaanaanaanaanaananannaaaaaaanttgaaaaanaaaattccttanttnnaatatntnaaatntattttaatnntntatttttaaaannaaaanaatnanaataaaaaaaaaaaaaanatnnnanaaaanntngttnnanaantaaaantnaanaaaanaaanaattanattanngaantnaananatttnnaatnatttttnanaanatnganaannaaatanaaaanttanaaaataactaatcanctncatnaanactnncatnaaaatnatanaaatttntnaaaanttnnaanantntttaancaanttaataaaananaatnnattaaatgcanncntnncattttntaatgnatnttntcttaataattntgctgcnnattataattnnaatgcgnctnaaaaaaaactattaaactatgcatgcaatttntaaaatagcatttgcaaaaatataagctgctagcattat

SEQ ID NO: 502484 - DNA, 349 bp, Homo sapiens
cgctgggttctcttgcagagtaagccatttggggtcatcctgaagcctggtgccgctggccgagagcgttggtgactctgacggcggtgtggatggagtgcttccgggaagccgcctataccaagaggctcggcacagagaaggaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagctctgcgaggaacgcacgtcgggt

SEQ ID NO: 502485 - DNA, 817 bp, Homo sapiens
  misc_feature (168)..(168): n is a, c, g, or t
  misc_feature (470)..(470): n is a, c, g, or t
gcggtccgtgctggtagcctgggcggctctcctccagctcctttctcgtggcgtgaacctggtggtgatgcctgcccacccgagtgtgccggagatctagcgcttcgttaccttgctgtaccgccatggagaccgttcaccagtgcacatcacactaatcccgatggnaccccataatcagagcaagacaggaactggtgcccctagaggcggtgttggtcaggataaacactatagtgcagggagatgcgtacatgcactggtgaagcgtgtggccatggtccctggctgcgcagtcgactctatgcacgcgcctgtcctaaacgcctttcttattcacctcgtgccatatgcagggctttagttggtgacggaaggccgagcgaaggatcgtgtctggaactcggggaagcttcctttctactgtatgctgtcctgcagtgcccaggctctgtgcctgtgagcctccntttccctcgtacccaaagcgggggactgtcatgtcgctttcgagacctcgcagaagaacaattgcgtccgtttgagtccacgtccagtaagtatcccctttgttgtcgagcaacccttgtgtgtcctctatttgcaatcatttgcaggttgcaaactagggtgtccgtagcgtcgagagggctcttccccctgatgtggtgggcccccctagttgttcgcgccccgagtttgaatggtaggggccattgcttcagcttagaaagaaccgacgtagcccccggggcgaggtaccaactccgaagaaggttgtccaagcatattgcacgaggtttgcttcttggaaccg

SEQ ID NO: 502486 - DNA, 1568 bp, Homo sapiens
  misc_feature (363)..(363): n is a, c, g, or t
  misc_feature (489)..(489): n is a, c, g, or t
  misc_feature (636)..(636): n is a, c, g, or t
gtgcactcgatgcggctgctagggcggcgatcatcgtctgcgtgggacacgttctctcgggcgacgagagagatccgggacgagttttgtagtcatgcagagaaatgcctgtggacacgtactcgcatatattcttgtgtatggaagtcgccgcatggcgatcggaggatcgacccaggtcgatgcacccagcaatgtcagacagtcgagcggtcagaacatcacagacgtgcgtaactacaacgcatccaacgccgtatcttcaacgtggcgtggcatacagaacgcgtacatggtagttggggaagacgtacgtgtctacgcaagacaatgagaagacgaacgaagcgggcgccacatggnacattacatccgagcgaaaaatgactgaacatgagggggaacaccgtcggtgggagcccacgtgtaaggggatgaataaacttggaaagggatgaaggagcagcacaaggaaaggtacgtgcatanggataggagctagagagaggaagcgaggagaaagagcacgagtaggtgtacctggacatgtagatgtgttgaaatagaggtgcattggatagaagtggctgaggagacttgtacgagagataggatgagtcaaggattcatattgtncgagaggggtcgacgggcgccatgtggtaggacttgaattagaattggaggcgaagtagaacctgtactgatgcaaaagtaaacaactagaggaatacgactaggtagaggcatcacgaacagactgtattggagtcattagacaaggcaaaggtcatttggcgaaaggctaggaatttaactggggcgaaagcaagacggtgaaacggactggcgcataggaatgatacaaggttttctacacatatccacggtggcgtggaggtatactgcgaaaaggtgggaggttaactgacgtaaccgtcggtaaaacaaaggaggggcgcaagaggggtgacacaattggcgagaagcggggaaggggaaaaacacccgtcttgaattagtaggaagccgtgggaaggtttcaaaccggaaacttttaccaccgaacatagggaactgtgggatggaattcgccagaacacaagttagacggttgttgggcttaaccgggacgggaccatacttaagcttcgtgggacacaggaatgggcaaaaggttatgaataaggccgaaaaaggcaggatggggaagagaacattggaaagcgtgcgaaaaaagggtctgagtggccacaattggtgtagtgtttaaggagatacaaaacccgggggggcgcgggcgaccaactgggtggcacggagcgtgttccagagattgacccacccttaccacattgctgtgacgtttatattcagacaaattatccacggacacttgtacgcggggggtgaaccccgcgagtttcatatagacactgagacgagaaacacacatgtcaatagtgcgtttcacaaccaacaaacgcgtgcccgcacaaatacccacaaggagcagcacacagcaccaaacagatgatagaggacacacagcgcgcaaacacaacagc

SEQ ID NO: 502487 - DNA, 1721 bp, Homo sapiens
gttctagatcgcgagcggtcgccctttttattttgatcggtcaccctgaatgttaatatttcttatcctaccaggcttcggaataattctcccatattggaaactaactaaccccggaagaaaaaagaaccattcgggatacataggtatggtgctctggactctatgtattatcaatcgggtctgcctaagggtttaatcgttgtgagtcaacaccattatatttatcatgaaagagaattaagacggtacaactacacgagacgcaatattttacacctctccggcccacgcaatacaatctactccgcttattcccctaccggagcgggtcaagacgataattgtacgcttagactctcagcctagaactatcacatggcgaagcaaaatattagaaatgtgaactctgggctgtgcaggtgtgcctctgtgacgcgccatagcgatattcgattctctattcttttctcaaccgcgatcacggttgagccctgtgcactgtgagccattgtgtgatttttgtaagctaaacactctcaatctcgccgcttcaggaactatgtctgatatcgataaacacgcggacacacgcagtatacgataacgctttgggtaagggcatacaactttctcgcatctataagtgtttcctgtattctcataataagagcgaggccgtgagtattgtgtggcacatgtcaaatacgagaggggccatgtcggacttttcacgctgtgaaagtttgtaccctcataatctctctatctaaggggccattaagaagctcacctatgaggcagtctcgataaaaccacatatagcggctcacagaaacaatgtacccaattcttcaccgagctttaggtcgaaatatgtaaacaactgcggagagcggataaaagagttttgataaaacccttaatatcatttttcgcccaacacaaaaagacatcattgattacctgcggggaccgataatccgcggggcacaggtggccccccgcgacagcggtaataagcgttcggagaatacgataaaacccctcaggcagtgtggcaatttacccactcacacacgctgttggcaacagtttagttcgttatatgtccatactccgtggatcaggggccctccacatcttcccaacttttcgtccttacgtataatacgcaggcgcacggtccacgtcactgtcaaccattataaacgtgtatcatcccctgtggcaccttggggacgatcagaaggcgcccatttccgcgttttagcgcaaacaggcgaaaacagagggttccggtaaacctatatgctgtaagacaaagaaaaacgcgcattctccgttataaacctcggggggagcggcggacatacaattggtgatatgggcgcccacgccagctccgaatagctccaacacaatattctaatagacagccgcggttatacttattaaaatatctctcactcagacaaacaaagagggacgggagaatgagtaggcaccccccaaacagtcgaggtgttaagtgcacacaccaacaagtggttgcccgtccacttgtctttaatacaagcaaccaacactagtcagatctagcgtctacgtagtaaacacacaaaacaaaagtagagggggggctcagataaattacagacgagcaagacgatactcacacgaccttattagaggctgatacaaagcgagtataaatacgt

SEQ ID NO: 502488 - DNA, 1006 bp, Homo sapiens
gttcctgccagagcgagctgcaccgggcgctgtgcgcggctggccgcttcacagagctgcagccacgaggacctcatacatcatccccatccccgaactgcgacctgcaaactgtgcaacttccaccccaatgcagtgtcacccagctctgtgatgggcagctgtgtgcaatgtgctggtgtgtggacctggaagacgggggtgaaggcttcctgtggggtgccatggatgccaaagtggggagcttggacttgccaccacgctggctgacatgcttatcgagagtgaggcctgccagcaggccagtggactcagcgtcccctgctactcctgtgctactggaggctgcagagctgagccagagtggagtctgagtctgagtcctgtctactgcctgactggccagaagtttccctcaaatgcgcgtgtgcaacgtgtgcgtgtgcgtgcgtagtgtagatagtagtaaagcgagcatgggtgtgcccttggggtaagccagagcctggggtgtactctaaggtagtaacaccgcccaagaggactgacgctctggcacttagcccaagacggtctgcagccctggatgatgtttccagattcgatcctggatacagctcactcactcattccttcactcatccgagaccacctaacaccgacttactgaccatggtacctaacgtgccagctctagtaaacagacttggggaggtccaatactgactaccctctgaccatggcatgtgaagaaatcctaataacggagagattcacaccctgtggggcgcaagacaaaatctcatttacccagacccccagaccacagcgccacgtcacccatgtcccaactgccatgtcatctcaagaaaaccgacacgaggaaaccttagaaaccgtggtgtatacatttggataagggaccaacagcacaacacacctcagatcaacaattgagcaccatatatcttatcctgactatcaaaagattgactggacacgatca

SEQ ID NO: 502489 - DNA, 375 bp, Homo sapiens
tggatggccctcagggtcttgggggcccctttggtttgaggggggggaaggggccaaccgcccagttgtttagggtttttggaggccgggctcccgtattttgcttgaaaaccacggggcctttccccagttggggtgagcgctcagagggcctggggccctcattcttgcccacgcctcccggaccccagaacggggcttcaagtcagacagatccctgccttggtgggcagtttttccttccaaggaggaaggggaagaaaagggcctgtgggtggctcaggcccaagcaggccccggggtccaccccagccccgcccagggtgttgccagtgcccacttttacaaatttaatttaaagcaagtcccgtttta

SEQ ID NO: 502490 - DNA, 941 bp, Homo sapiens
ctcacaggaagggaggaaaacaggaatcacgcagaagcgtaagtccccctggcccgggaaggggtgaagggatgtgcgggggggcaggcggccgagcggggtgggggcggctctgcccttcctcgcccccttccagggcctagactgggaaggagagggatgccgccaagctcgggtcctgcagggccccggccttctggtgtgggatctggcttgggaaggcccggcgctgcggctgctgctgaaattcttgagactggttgacaagggatcccatggtttcatttcgcaccgggcctctccagggatggagagggtcctgactggcagtgtcgaagccacggggtctctccttggtccctggctcccctcacagccctccctgcccatggagctccgggcttccgcacacatttctctcctttttaacggctcatttctttgggttcagcagtacctgggtccccagtgccctccttctgaggctctctcctttgagtggccaccctcccccagaacacctggagcgcggaactgggagtgccgtggacaccagccctccctggcccagagcctctgcctctcctgggcctcccaagagtaaaacctctccacgccagaccaggctgaaacctggatttgaaaccagcgctgtcgcactccttgaactgtatcaggggttttcagtagcgggacgggaaccagaacccaaaagaggtccttccttgtcttgaattcctcccgactgagttagcatcttggagggtcacggttcaggaattcagtatctgagaagagaaagagaccgaaagggggttccccatgaggacttgtggctggaaaaaagcgtcaactccatacataattgacgagagttatctgggccagatggaggacgtgacccggaaacactccaggggtcggaggactgggcgaagggg

SEQ ID NO: 502491 - DNA, 267 bp, Homo sapiens
  misc_feature (182)..(182): n is a, c, g, or t
gatcctcggccctggtgttgatgagtggttctctgaattcatctggagagactggatcacgctacaaccttagccatgcccttgccttgttttggtctccatattaccacccatgatgtgaagatctggaaaatctttcttaaccccagaagatgccacctttacaaacacagagcccatanaacgccaaatgacgaacagacaggtgagttctcccagcccaaaccctcatcatagtagttctccccccgaggttctggggccggt

SEQ ID NO: 502492 - DNA, 88 bp, Homo sapiens
ggcctgtgtcatacgccattttgtgagaagcaaggggttctccatgtttcctgagcgttttcttcgctcttgcctccgccctccttta

SEQ ID NO: 502493 - DNA, 260 bp, Homo sapiens
  misc_feature (138)..(138): n is a, c, g, or t
  misc_feature (173)..(173): n is a, c, g, or t
  misc_feature (246)..(246): n is a, c, g, or t
tctttttcatcgatctcttcctttgttgggggctcacaacgccagagcgccggaacccagcggccaccttcacgcggcttctcggtaaatacttcatcatcgctatacgattaagcgtcacgacaggaatattgcaanggccgtgccaactcaaaaaaaccttaaaaatcaangaaaataaatcagacgttggatttttagccaaaaaactgtcgcctattgacgacaggctaagtcacacaaaantgaaatatagttat

SEQ ID NO: 502494 - DNA, 955 bp, Homo sapiens
ttatgtccgtgggtgttgcctccagctatgcccgggttgcgtgcggtccggcccccggccggagacccttctgattgggcttcgcccggcggacgatggtttttgctctcctgcgggggggaggcgagtccttgggttcccgattagagtggtgctggggtgatattcagctgcgctgctccggtgcgtggggtgtgcgttgtttgaccgcccccccctgtggcccggcgcgggcttctggtgggtctccccccctgcggagggccgtggtccccctggtcctccctaatgggcgggtgtccaagccccatgtgtggagcaggcgcgccgctgtgctagtgactttgactccgcagtagatgcgcggtcatcatcgttgcgatgagttcacgcgcacgtttttttccacgggagtccccctctctgttacaagagacgcgttcttttagaaaaaacgagtctctgtcttctggtagacagatcgtgttagtaatatcgccgcccccccgttgtagaggtgaagaaaattaattgttggggtaacgaaaaactttttgtgggagaataagggttgtgtacgtggtcctgttcaatacacgcaggcgctcgcactaatagacgggcgagagggtgagtgtttgacccccctcgttggggagagtaccacgcaaattttatatcccactgaaattgcgggacaaacccccttctttcgcccgtgatttgctctcccgctagcatcacccacctgcaatagacctaccacccctctttctcaccagctcttctaagaacggaccaacaaagtcttcttatcatctctccatggcaggaaaaatatgctttgcatgcccctttcgttgtacaagacttgtccccaaccgcgtcactgtttaaagaacaacccccggtacaattccaagggaaaactcccctttcgtcccaaaaaaaacaa

SEQ ID NO: 502495 - DNA, 458 bp, Homo sapiens
  misc_feature (180)..(180): n is a, c, g, or t
ttagaggacctccattggatagcggatagggagtaccttggtactgactctacccgcaggcctggggtgggtcaggcgcaagatgctctgaggctcacatccagcaggcgtgtgctggcacccagtgtgttcacctcagtcacattaatccggtactggctccagaactcagccccgtgnacaacacagcgggcagcccctatgggatcctgtgggcatggccaggcgcctgtggatggactcctcctctggctatcagctcctaggactgtcttcttcctgtaggaggtgaggtagcgggtgggtaaaccgctgatctggctgggactccaagtgcaagagaagttctcatagtcggctgcttgcgaggagacaaacagggcgggctggagggtagcccaagctgcagggtcactgtgcccccaagtgcaccatccagggtctggcagatgtaggtg

SEQ ID NO: 502496 - DNA, 103 bp, Homo sapiens
tacctcttcatgaaataagcggaggtacttccctggggaatttcctttctctttctttctttcgagacagagtcttgctctgtcgcccaggctgatgggagaa

SEQ ID NO: 502497 - DNA, 341 bp, Homo sapiens
  misc_feature (92)..(92): n is a, c, g, or t
  misc_feature (95)..(95): n is a, c, g, or t
  misc_feature (139)..(139): n is a, c, g, or t
  misc_feature (151)..(151): n is a, c, g, or t
  misc_feature (184)..(184): n is a, c, g, or t
  misc_feature (202)..(202): n is a, c, g, or t
tgtacgatcctgtcaggaaggggtcacacctgcacttgggcttgttgcccagtgtgcctgatccagcagtgggttccggtagtagacacagnggnggtccatgtacatgcgggcgtccagtggttcagggcatgggcangccatctaggtnttggaaaaaatcgtcatcatagatgcgctccgngtcaggacccacacggtnctggtggcttgtcacccggatatgtggatcatttggcgcacagctgcagcagccgtgtcagacttcaacttcgtgacatcccagggccggaaaagaaactgtcgattcagatttgacttctcaatggtgagttccagct

SEQ ID NO: 502498 - DNA, 403 bp, Homo sapiens
agaacagtcacttggcacaggagtcactgaaagggccgcagggtgctgtggtggggagataagaaccatgagagaagttggcacaaaggagttatgggacaaagggtccaagataggcagaaaagaaaattgtgccagttgatggggaagaaaagaagtcagagggcttagatactgagtgggacagaacatcttcatgtgcactctcatctcttgtagtcagcaacaggtatccacggggagagccctacatcatctgctaccctgaaggatctggaggtaagaggctctgggcagaggtgcagtgaccctgcagggcagccctccaacctcctcctccaggtgggacggggtgcccctctgccagctgagacagtccacacacaccccagccctaatgatt

SEQ ID NO: 502499 - DNA, 399 bp, Homo sapiens
  misc_feature (58)..(58): n is a, c, g, or t
  misc_feature (95)..(95): n is a, c, g, or t
  misc_feature (204)..(204): n is a, c, g, or t
  misc_feature (217)..(217): n is a, c, g, or t
  misc_feature (245)..(245): n is a, c, g, or t
  misc_feature (321)..(321): n is a, c, g, or t
  misc_feature (395)..(395): n is a, c, g, or t
gctgtggccctccagaacatgagcagaaagaaccgtttaaggccaagtaattgccaanccatggttggaaaacctcaacctaaggggaaagggtnccccaatgtattaaagcaatggggctgcctcctccccccaatccctcccctaacaaatccgttgtgtggacttcctcatcctaaaaggttagtggcttttgcttgggancagtgctctctantgatgttcttgctggtctccagacacantcctgttgcattaagacttgaaagacttgtagatgtgtgatgttcaggcacaggatgctgaaagctatgttactantcttagtttgtaaattgtccttttgataccatcatcttgttttctttttgtaggtataaataaaaacactgttnacaa

SEQ ID NO: 502500 - DNA, 403 bp, Homo sapiens
tgtcccacctgaggctcttctgcttcttaacaccacagagctgccttctttcctttcttacctaccacagtcttctggcctgcaagcgccgcgcattctctatctgatttggcttgtagtgccgctgctgcagcagctgccttatccacccggagcttgtgatacctggcctggcgaagaatggtgttccggcgcatggtctttgcatatgggtttagcttcaacatgattctcaagtttttcagtgggttcttctttaggactctgcgatggatcttcttgcgtggtgctcgaagggctctttggatctctgggcttttcaagattctgctaagatctgtattaatcatcttgtgcatgggaagatagtagttactcttgagggaagcggctttacgccaag

SEQ ID NO: 502501 - DNA, 640 bp, Homo sapiens
cgtggcaagatggcggacgagaaggacagggaagagataatagtagcagaatttcagcaagaaaaatcagagaggcgattgaagtcttgaccatgagtcgagataatacagggatgtgagagtagatgggaacaatgtatcaggtcaattaggatgctgtccatacggaaggagagctaggatgatcgtgatgcgaggtagaggaagaagaacccactggatacgttcgattcgaaaaatttcttccggtgatgactagaaatacttaccagaaagaaaatagcgaggaccaagttccaggaagatgtcctgccttcgagcttgggaggttctgagattcagctaaacggtgggtttcttactaaggacgagctgatcaagtatatgactgaggaaggtgagcctttttctcacgaggaaatggaagaaatgtggtctgctgcaattgatccagaatcaaatgcaattaattactaggactatataacatagatggtgatagatgaaaatgaaatgttctaaagataatttctgattgcaggaacaattttagaaatgcgttgttcttgttaatttcacatcttatcttaggattcctatatgtgatattgaataacttgtgacataattatttaagaga

SEQ ID NO: 502502 - DNA, 107 bp, Homo sapiens
ctgtggctatactcactctcatcactcttccaagctgccagaactcaccttagcttgaagttgaagctgattcagtgtcgattaagaaggattcacgttacaattgg

SEQ ID NO: 502503 - DNA, 134 bp, Homo sapiens
agagaagaaaataaatagcttggttgaattataagttattttagagtacgaggcttcataacttagctttttatttttttgaagactaaacacttttggagggtaagagaatagaggggtccgggctgtctaga

SEQ ID NO: 502504 - DNA, 150 bp, Homo sapiens
tcagctcagtcttcagagcagtttccctgagccctcaggacagctttttttattcatagtcattacttgtgcatttcaaagcacccgatggttgcataattctgatgataaatatggctttggaagacaagagagttaggggtagggtcc

SEQ ID NO: 502505 - DNA, 1556 bp, Homo sapiens
  misc_feature (49)..(49): n is a, c, g, or t
  misc_feature (189)..(189): n is a, c, g, or t
  misc_feature (1014)..(1014): n is a, c, g, or t
tcctcgtcgcgggcggtggagtgaaaggatatttctctcctccccctcnctcggggtgatgatgagcccccgtcgttttatatagtaactagggccgctcgctcttgtcgctggtggtgttgtgctctcctttcatcgtcgcagttgtgttgtgccccgccgccccgtccgggtttgggtgtggtgttntctgctgccgtctgtgcctcaagcaaatgtgacccgtcccgtgttcatctccaacaacaagggacgggtttgctctggtgtggggtaatatagaatgcgccctctcctccctcttgggctgtgtgctcgtccgttccactatatatatctttgcccttcttcctcctgtctcgtgatgaatgagagaaagtattggggttccgctaacacatcaggggaaatgagtattttcgtgtgttgtttgtgttgttccctgcctgtgggaaggaaaaaaaagaaccgccccctccttaatacatccggcgggggaggaagtagaaggaagagccccccagccgtgcgtcaagcaatccccccgccttccctccggaaggcagggaggtgtgtttttggcgggaagaaagataaaagctcgaactacctctctctctctcctcggggttattaccactgtggtgtgatggttctccagtggctctccctgcggtggcgtgggcggtgaaaaaggggaatatgtaaatttccgcccccgcggcgaaagcgtgcggtgttaaatagtggaggggtaagggcaaggaaggaaaaacaatgcgtggtgatgaaaagaaggggggtgccccaccaagcaggaagatttctcccccaccccgggcggaatgatatataataggcgggaagaaaaaataggcgggaaaaaaatagtttttccttcccttttcctcccccttgggagaatgtcctaacactcggccccaccaggaggggagaccctggaagaagttctcttttgttgtctgctgggggcaaccaacaaggccaacaggncttttgggggaagaacaagaagaattggtgagactcgctgaatccctctttttttggggttcctctggaagacgtactcacaaaaaatatttccacaaaaaacagggagaggttcctgaaacagtctctgtcacaatctctgtgtgtgttttgagagagacctttctgtgtgggtgtggggtgtctataacagagaaaaaagggagaagagaagagaagtgtctctgaacaccccacactccctcacacagagaagagaaataaggcaacccacacagaggagaatagaaaggtgtataagctcggctctgtgtcccgagaaaattaaaaaggtggaatgagaaatggcacaaaattatgtcgcctttcgtcgagagaggtgccctttctgagatgaaatgtggtgctggggggtttaatggcaaagtcacactttgagcacagaacacattaattgtggcacaaagttgtttgacttactgtttctaaccaaccagaagacaagtaactgtatgaggttaataaaagacatggacttacca

SEQ ID NO: 502506 - DNA, 124 bp, Homo sapiens
ggtttactgtcccccccttttcacctcctcattttttgggggtttttttgttttccttttttcaccctcctccctccccttagccatcacttttgggaagtaaaaaacttgatttagggccgga

SEQ ID NO: 502507 - DNA, 878 bp, Homo sapiens
gtgtagaaaaacaatctatgagaagtgtacttccggttgtctgtgatactatatctgggctgatctgaccagtgaaatgacattgccctataggacctctgaggttctatgtagcttgcagatgtacatagtatcccagtgatctgcaaaattaatgccttaccaagaaaaaatcttttcctctctgtatcagttaattctgacaggtagtgatatctgtcttcattataggccttatttccatatatctctatactttatagatattttagtatataaagaaaacagtctttctgtgtatacctacggatgagggtattattataaactgccaacaaatatccaagacatggtcaataaactaatataaatactttagaaaagagtgaccaggacatgtatagaaatgtctgttacctgtagaccttaaaaacaaacaaaaagaacaaaacagaatattggagcatagaaatcattatgatatactccttatatctccttgtaatcttatgtctcctgagtacatatcacacatacatgttgggggattcatgcatgctagattatatcaaggtgtaaccatggtgtctactatatgctgttgataaagcttatacctaaaaatgaaaacacagaggagataaagcgccccatccataacaatcggggactagctatgactaacaacagagaaaaaaacgaagaaccaacacaatgtgacagaaagaaagtaagagaacgcaaaagaagaaacaggagagaaaccagggggcaaggcaacacaggagaaaacaagagaggaagggaggggagagagacccaagaccaagaggaagaggaaaagacaagagcgagcaacacgtgagacaaaagaccag

SEQ ID NO: 502508 - DNA, 350 bp, Homo sapiens
  misc_feature (305)..(305): n is a, c, g, or t
gagtactcactaagcatacactacgacatgatatcttctgtatgtatacgtcataaaggagggaataatattagaggactgtcttccattgcacattcaaagtctatttattcaagctcttatgtgctacattacatcatcatagagccatttagataacctagcaatttctaagccacatcatttcaaatgtcacagaagtggttaagataaactactttatgcatctgtggataatgtcattatgggaagtttatcttaagccacaagtaccctttggcatacaattacgacaaccgattctntcattggtcctgtaagtgacattgaatactagtattattaaaaat

SEQ ID NO: 502509 - DNA, 287 bp, Homo sapiens
ccgggcacatccctgtggggacatgctaatatagtatttttggtagagacggggttcaccatgttggccaggatggtctcgaactcctgacctcgtgatcgtgtctagcctcggcctcccaaagtactgggattacaggcgtgagccaccacacctggacacgttactgaatatttctgtgcctaggtttcttcatgtgaaatgggattgttgtgagaacacaaagggattcccagggcagttcctagtgcatagtctggctgcctttgtgtgtgtgtgtgtgtgtg

SEQ ID NO: 502510 - DNA, 191 bp, Homo sapiens
gtagttaagcgaggaaatcatgcgcggtaaaaaaactctgcgttgtctgatggcgttggcgctgcccgccgcgttgctgatggggtgcagttcgccatccggcatcgcggttaaccgggggcaaacggtggtgatggatccttcggtgctgaccgccggcatttttgccgatacgccctctgtctcgaacg

SEQ ID NO: 502511 - DNA, 177 bp, Homo sapiens
aatcgagctcggcccaggtcagtcttactatttttaagcgctacaattcatgtggcaacaagtacattcacactgttgtgcaactattaccaccatccatctccagaactttttaattcaacccaaactgaaactctacccactaaacaaaaacttcacaataccgcctccctccag

SEQ ID NO: 502512 - DNA, 303 bp, Homo sapiens
gactcgggggaaaaaggtgagaagggggtgagagataaaacactacaaactgggttcagtgtatattgctcagatgatgggtgcaccaaaatctcacaaatcaccactaaagaatttacttatgtaaccaaataccacctcttccccaataacctagggaaataaaattttttggaaaaaagaatatgtgggatttttgcattatttcttgtaactgcatgtgaatctacaattttcttttcttttcttcttttattttttttttggacggagtttcactcttgttgcccatgcttcagagtc

SEQ ID NO: 502513 - DNA, 104 bp, Homo sapiens
ggtaccaatggccgtcgcaggcggtgctcaaggattgctgttacgctacgaactcgatcagcaggtgcgcttcaccccagtctccgaagacgactatcggcagt

SEQ ID NO: 502514 - DNA, 112 bp, Homo sapiens
ccataatcgagctcgctccattaacctgtatcaaacccttcatcaaaccctgtcatcaaacccttcatcaaaccctcgtacaagtagaccactacagccagcggttatttgg

SEQ ID NO: 502515 - DNA, 361 bp, Homo sapiens
aaaaaaaaaaaacccctattttttccatgtggttggcctgtttttttttggcccccaaaaccaaccctttttacccccgttacccatggggcttgtctttcccccccatgttgtccttttattttgctttggttcccccctatttcgttttcccccttggaaaacttaaccccccaaatggtttttgtttttcttaaaaccggccctttttatgggcccccttccccaccaaagattttttacttttttccggggtttacctttttttccggaacctggccgttttttttcctttcccaaattttttttttttttttgggtttttttaatttcctttttttaattaattcccccaattgga

SEQ ID NO: 502516 - DNA, 235 bp, Homo sapiens
gaacacccagcaacctgagcaagtcccggccctgcctcagcgagcccggcagcgtcccgggacagctcagtgaaggagggccagtgaaccacgagccagggctggggcttgcatgtcattgtctatgaacgcgtcaagactggccttgcaccgtgctatatgaacctccctgagactcactgagactgctgagtgaattctcgtcagtgtcagtgtgtcatcatcagctcatgct

SEQ ID NO: 502517 - DNA, 313 bp, Homo sapiens
acactgggttcgagttccactgggttcgagttcagaggagggccatggagacagtgctgacagcaaaggtacctgagacccgggcatctttgaggaagagaatgggatagaaggacagggcggaagtctaactggttccagcccacagacgggccatagcacagcagcagagccgcctggggaagtgaccgctgcaagactcctagactcggaaagggaggggggcgagactggaatcacagggagacatgtcacccaaacttcgagctttgaatcccattaatgacctggtcattttccaagcaactttctg

SEQ ID NO: 502518 - DNA, 841 bp, Homo sapiens
agtattcatttttttttttcctcattaaactttttaaagggggtcccaaaatcctggggccaaatttggggccaagtggttcccataaaaaagtcctgggatttaaaaaactaataacttaaaacggccacacgcaaaaaagaaaaccaaaggggcccacaaaaaaattctccttaccctatcggagggtatatacacagaggctataggtacatcataaacccagtctttaaactactaaagtcttaatggggccaattggaaacaacacagttctggaaaccggttcttccaccagtggtataacgcaggggggtgggcagggtcatacaggggatatattataccatatatagccttctggacgcttctggggcagacgtgggtgagactctaggcccaggccccaagacagctctattctgggcgccacgggctataagggatagagacccccccaacgggccacatcgagcgtgctggtcactctatacaataccacgagaaacacgcaaaaaagcgagaccccaaaagggtgggactcagtcctgagaaaaacgccctccaaacgacacaactatgagggggtctagacgcgacagaggagcaaccccccaatatatccacaacaccacagggggggcagggcaattacaaccccaaagaatatttcacaaaaagatatactaaggggcccaattcttacccgacaggtataataacacccagagaaacgggggcagatccatatcatgtataagcccttatacaggcgccccacgggaaaactctttgggccactgggccacaatggggcgaacgccggtgggggggaaatccc

SEQ ID NO: 502519 - DNA, 213 bp, Homo sapiens
aattccagtttgcttaagtactggggtttgccttgcttgcggcgagacatggtggtctacaggacgaacagacaacaacagcggcggcggcggcaggcggacgacgactcggttcacatcgggagagcagggttagaaagaaggagactccagagaaaatatcttaatcagtgccttttgacatccaaaataaattagaaataatacaaagat

SEQ ID NO: 502520 - DNA, 1226 bp, Homo sapiens
  misc_feature (1226)..(1226): n is a, c, g, or t
cgccagccgagccacatcgctcagacagcatggggaaggtgaaggtcggagtcaacggattaggtcgtattgggcgcctggtcaccgaggactgcttttaagctcgtggtaaagctgtgatattgttgccatcaatgaccaccttcattgagcctcaagctagcatggtttacatgttccaatagtgattcgcacccatggccaaattccatgtgacaccgtcagaggctgatgaacgggaagcttgtcatcaactggcaaatcccagtcacgcatgcgttccaggagcgagatccctccaaaagtcaagtggggcgatgctggcggctgagatactgtcagtggcacgtcctacttggcctgtacttctagcaaccagtggcagaaggcgtggggcatacagttatgcatggggggaagccagaaagggttcatcagtctcatgagcccactcgtgcgtgatgcccccatgttcgtcatgggtgtgaaccatgagaagtactgacgaacagcgctcaagatcagtcaagcaatgtcctccatgcaagcatcaacttgcgttagcaaccctggccaagggtcatccatgagaactttggtatcgtggaaggactcatgaccacatgtgcatgcccatcattggcacccagaagactgtggatgagccctccgaggaaactgtggcgtgatggccagcggggactctccagaacattcatccttgcctctactgggcgctgccaaagagtgtgcggccaggacatccatgagctgaacgggaagctcactgttatggccttcaggtgtcccaatggcaacggttgtcagtcggtggacctgagcttgacgacttaggaaggatccgtgcaaactattgattgactcaaggaaggaggtgaaagcagcagtaggagggcccgtcaagggaacatcagagactcactgacacccaggtggtcttccctgaataacaaagtgaacacacatccattcacatttgaaagacatggggtagcaattgccctaaagacagttagtaaggccaatccggatagaacgaatttatcacaacaggggtggccatacacacaacatcacaaagaaaaacgacgacaccacactatagaagagaaacacatgggagtcatcatacacaaaccacagtaaccataagaagagcgcatctgctacacatcggcttgcttttcgtggaaacatactagaan

SEQ ID NO: 502521 - DNA, 202 bp, Homo sapiens
aagcccccagattatattgaattagttgcatgcccgcgcaatttgttcttcccatgagcagcagagtcgagtgttagagtgcaggcaatccagagcggggagaggctgggcggagtttgggggcctggaggctgggcctggttacttggtgactgtgcagagccctctctggggggctgcagttcaatcttgttgggagctt

SEQ ID NO: 502522 - DNA, 554 bp, Homo sapiens
gggtgcttaattttgcatattgtggagtttaattttcatttctgattgttaatatcttttattcttatccaaactgttttccagatcttctcagttaatgaaagacgtaatttacttcttgatgttgtaaaagtaatcatcctttttaaaccaacttttttttgagatggaggttgcagtgagctgagatcgtgccactgcactccagccttggtgacagcaagattccatccccaaaaaataaaaataacaaaaataaaaagaatcagaagtatccatatgttgttgaggtattaactcacaatatacagataagtgaaagaacaaagggcaaaatagtacacaaatatgctgtgttttatctaagaaggggataatatgagtacactcatatacataagtatcttgttatatttttcttaaaaaactaattggccgggtgtagtggctcattcctgtaatcccagcactttgggaggcttcagcaggaggattgcgtgaggccagtggttcgagactggctttgggcaatgtagctagacccagtttctacg

SEQ ID NO: 502523 - DNA, 596 bp, Homo sapiens
gtttctggtctagagacaccacaaaagccgcggtgcttttgcaccagcaggtcgccgcgtctgaacgaccaatgagtgttttgtacgcgctcttaaagcgtcttacctaagcaggtgttctggaaacagcaccccgttgggcatagaagagttcaggggaagtcagtgtaacaagtgggcacaagaatcagcgagtcttccgtgcacccctctttgcagatcaccaaaacccgtgggccaaaaccaccgtgggtaaaacgcccaggaacactgcacccccacattcagggaagaggcaacagcagggccgattacacgtagggcccaagacgagcatagagactatctccggctgaatacaaccgggaaacacctccgcttggctaaggtcaaaaaacccaaagaatatacccgggccctcgtaagagcacagcccaccgtaaggcccagaccaacttcggggtaagctcgaaaagcacaagacgaatcgccccaacacccgaggcagggcacgaaagtaggccccagggcgcaccaagtaagtgccccagccaccccccccgcgggaattccaaatttaaaccccccacacaaca

SEQ ID NO: 502524 - DNA, 413 bp, Homo sapiens
  misc_feature (14)..(14): n is a, c, g, or t
  misc_feature (43)..(43): n is a, c, g, or t
  misc_feature (139)..(139): n is a, c, g, or t
  misc_feature (377)..(377): n is a, c, g, or t
  misc_feature (389)..(389): n is a, c, g, or t
  misc_feature (396)..(397): n is a, c, g, or t
  misc_feature (408)..(408): n is a, c, g, or t
aacttacccccccngttaaaaacaaattgaccctttggaaaantctgtatgtggaacccatatgctccccccactgtaaactatggaagggccctaactttcacataaaaaattggaaggctcggccgggcgctggtcncacgcctgtaatccccagcactttgggaggccgaggcgggcggatcacgaggtcaggagatcgagaccatccctggctaacacggtgaaaccccgtctctactaaaaatacaaaaaattagccgggcgtggtagcgggcgcctgtagtcccagctactcgggaggctgaggcaggagaatggcgtgaacctgggaggcggagcttgcagtgagccgagatcgcgccactgcactccancctgggcgacangaagtcnntccgtctgcangaaaa

SEQ ID NO: 502525 - DNA, 220 bp, Homo sapiens
gtaagaggatgacgtgcgtggcttgatctcattttaccgcaactctgcctcctgggtttaagcgattctcctgccttagcctcccaagtatgctgggactacaggcgcgcaccaccacgcccaggtcagttttgtatttttagtatagtagagacggggtttcaccatagttggccagagtcacgtctgggcgatacctctagatgtcgaccgtgcatgg

SEQ ID NO: 502526 - DNA, 1366 bp, Homo sapiens
ggaggatgaagatgatgacagatgatgaagaggaagacagaattggagagtgggcgtcgctttcatctacagggacaagaggtcccccaggtgtcgagatttgctaggcttctgggccagaaaagaggagctttgctaggggacatcttggcatggctcggtgttacgacttctagaaagcacgtgctgagtgtgtgacaccaatgacacaccgtcagggccgatagtgctcgagggctcgagaaccgatggtacccatgacagagcctcattgctggaggaatcatgatgccactgttactcttttggagccaagccatagtgcataaatgcgaagtgggcgtaggaatcgccttcgaacatagcaacagacctcgaacgaccttgttgggcccttgagggcgtgtagagttcgtcgaggcgatcgttgggcaagactttgcgaagacaagcattgcaaggccacgcaagcagaactatcgaaggggccattctttctaggaacgcccaggggggcaggtttggactgagaggcatcaataatcttgagcacgtagcaatggcgtacatttccctcgaaatgcggccactacactcgtgagatgggcataatgtcgattcccaaatacccatgggcacaggtagacgccaacgtggggcaagaactaaggacgtcaatctcgcacgcttgaacgaataaacaatatcctcgcattggggcttttctcgcgttggaagcgtaaaccaaaagccgctcggggggtagagaaccattgtcgccttatgggctatttgcgaaggacaccaagcggagtgctaaaacctttccgattgttgtgtggtacaccggaacgccaaacaaaggggacaggaaacagtgtcttcttggaaccaatagggttccttttggttaagcttaagtgagggagtttcattggggccatgtgtgcgagaaaacaacaggctcaattttatagaagcgaagcgaggcgacaattcgtttggcttaacaaaagacaacaatttatgggttcccatatttgaggcggggaaaaagcgttctcggtttttcgaattacagaggagagtaaaacggcacggcggctaggattggggcggggcccccctagattggctattatacaaaccggcgggatatcgccggcgaagaaggaatctcgggtggggctccccccaccaaggggtgtggggctccccccagatataatcggggtgagagagcctaggtagaaaggaccaagacatataagtaaccgttaggggagcgacgcggaatggaacaccggggatgagggtccctgataacaaccacagcgcaggtccggggtgggaacactggggggat

SEQ ID NO: 502527 - DNA, 454 bp, Homo sapiens
  misc_feature (3)..(3): n is a, c, g, or t
  misc_feature (18)..(18): n is a, c, g, or t
  misc_feature (281)..(281): n is a, c, g, or t
agntaatccggtgggccnaaaaaattgtccccctaatgtcctgtttaagattgaccccatgttgtaacccccctcaaaatgatgagataaactttttatttccattggtgtgcctggttccttaaaagttacccctttgagttccttatggaagaataagtatggaaaatcagcccaagttaattctgaaaataaataatattacgaacaaggacaggcacggtggctcacacttgtaatcccagcactttgggaggccgaggtgggaggatcacgtgagncccaggagtttgagaacatgctgatcaacatagtgagaccttcatctctacaaaaagtaaaaaaaattagctgggcatggcaacctgtgctgtagttccaactgctcaggagactgaggtgggaggactgcttgggcctgggaggtggacgctgcagtgagctgcggttgcac

SEQ ID NO: 502528 - DNA, 470 bp, Homo sapiens
  misc_feature (246)..(246): n is a, c, g, or t
ttatgggtcatgggttgattcaggtgctggcagatcacatgctaacctgtctagtgttctctctgtactcattcttctggtagcagcacagtgtcagcctgatggagaagggaggccctcatgagagaggagctgagtctcacctcccgggcccatacatttctctctgaccgtacattctgtgcacagggaagtgggccctctctggtcgtgagactgaagtccccgtgctgtgttgagcagtgnagggtgggggtggctcaggtagaatggagggtacttgactcctgttttttgagggagagttgcctttaaagttggagggatgctgttggcttcctgcagctgcttgctgccttttgatgacgcccctgtgcattggggccttcaagtgtaggtggaataggcagggttggaaaggctcttttctccccacagtccaggagaggcagtgctggggtggcagaatt

SEQ ID NO: 502529 - DNA, 222 bp, Homo sapiens
cacttcatttaatcttcacaacacctgtgagataggtacctcatgccaaattaagaagacgctctgtgaggtcagaaactggcccaggtctcacagctgactagtgaggagctgagatttgctaggatgacctgacactctgaattctctaaattccacctccttaacacaatacatgtagtcagggaaggcctgactttatattattcacatggccactca

SEQ ID NO: 502530 - DNA, 715 bp, Homo sapiens
cgcgagtcgtcccgacgggatcgctggaatatacggcatgaactttaagcacatgccggagctggacacggctacggatactttgtcgtgctcggagtgatagcgatatcgtgcgttttcctatttgtgcgcttcaagaaggctaagtggctgtgaatactgcccatcgttttcttcgccgtcatctgacggttacagcgggccttatacgggagcttgtccaatccaactcaagatgaaggtgcgtccatgacatagcagctgaccgacgctctacaagcagttcagtccttcatcgccaagggctaagaccgcgaatagcgcgtcaaggacagcaatctcgtcgatctcgagccaggatcaaccatcggtccgtgcggcatctgcgtcgacgcggcgtttcgcctcggaagcggtgatgatggcgataacgcctccaccctctacgcgatcaccgatccggcgaccgagcataagggcctgttgatcgacgcgttcgatgaaatctgctaccgcgacccagttcaagagtcgggacctcaatgtagaagaagtcgactaacgagcattcgcgtcatccgatcaagcaagctggagacatttatgaaagccatgggttacaaggttccgggacccatcgccgcggatgcgcgctggtcgaatcaattgcctcggctgtgctgcggatagaatccgttgagggaggcgccggcac

SEQ ID NO: 502531 - DNA, 611 bp, Homo sapiens
gtctcattctgtcactcaggctggagtgcagtggcgtgatctcagctcactgcaacctccactcccaggttcaagtgattctcctgcctcagcctcccaagtagctgggattacaggcgcctgccaccacgcccagctaatttttgtgtttttattagagacagggtttcaccaagttggccagactggtctcaaactcctgacctcgtgatccacccgcctgggcctcccacagtgctgggatgacaggcgtgagctaccacacccggctgatttatccttttatttgggctcctttcactcagcgtctttaagcttcatacgcgaaagatgcttcagagattcctttttcaggctgaatatctgctgcgtggctaggccactttttgtttaatcctctctcctctggtggacaccaggactgtgctgttttggttgctgtaagcgcgggtgcacacgcctgcctgaggctgtgttttggccgttgtgagtgtgggtgcacacacctgcctgaggctctgctttgttgtgagtgcgggtgcacacacctgcctgaggctgtgttttgggtgttgtgagtgtgggtgcacacacctgcctgaggctgtgtt

SEQ ID NO: 502532 - DNA, 942 bp, Homo sapiens
ggagagacgagataactagtctcgcgtatgctgtgtgtgggcccgggggccctgtggccctgggatgggaatctggggtgtttccgtggaggtttctgtgtgctccggtgccggggtcgctttcgtacttgggccgtggccgaggccgcggagctcgcggaggcaaggccgaggataaggagtggaaagcacgataaacaagttgggccgcttggtcaacggcacatgaaagatcaagtccctggaggatgatctatctcttctccctgcccattaaggaatcagagatcattgattaactatcctgggggcctctctcaaggatgaggtattgaagattatgccagtgcagaagcagaccgtgccggacacgcaccaggttcaagggcatctggtctgctatacggggactaacaataggacacgtacggtctagaggtagtaaagtagctaccaaaggcagagtaggacaccgcacataccagcggggccataaatacctaagggccaaacatactccataggtaccccggtgccgcagcaggcatactggggggcaacacagattcgggcaagacacacaaaactggacccatagaaagggtagacagggccgctagcggctcatgtgctggttacgtctccaaccctggacacccacgtggacaccttggcaattccgtcctaacgaaaacctgtggcctaaaagaaggctgcaccatgaatgggctggtatagaatagacagcatagacctacagaaccgaagataaaacagaccaccatgggcaagtaagcgaaaggcaactttgtatgccattcttaagacaacagttactgaaaccagaactcggaagaaagagattacagagactaccaacaggggtaggtgcaactcgcaagaaaacaacgactccgacaggaacaactcaaggggcacaac

SEQ ID NO: 502533 - DNA, 470 bp, Homo sapiens
  misc_feature (8)..(8): n is a, c, g, or t
  misc_feature (10)..(10): n is a, c, g, or t
  misc_feature (12)..(12): n is a, c, g, or t
  misc_feature (134)..(134): n is a, c, g, or t
  misc_feature (137)..(137): n is a, c, g, or t
  misc_feature (167)..(167): n is a, c, g, or t
  misc_feature (169)..(169): n is a, c, g, or t
  misc_feature (344)..(344): n is a, c, g, or t
  misc_feature (346)..(346): n is a, c, g, or t
  misc_feature (441)..(441): n is a, c, g, or t
atcagcangntncgggctgaagattgcttctcttctctcctccaaggtctagtgacggagcccgcgcgcgctgacccatgcggcagaaggcggtatccttttcttgtgctacctgctgctcttcacttgcagtnggntggaggcaggtaagaaaaagtgctcggagntncggaacagcggctccgggttctggaaggccctgaccttcatggccgtcggaggaggactcgcagtcgccgggctgcccgcgctgggctttcaccggcgccggcatcgcggccaactcggtggctgcctcgctgatgagctggtctgcgatcctgaatgggggcggcgtgcccggngngggcttagtggccacgctggcagagccttcggggcttggttggcagcagcgttcgttcataaggtaattattggtggccttgatgggtaacgcancccacaagtattttcgatagtgaggattt

SEQ ID NO: 502534 - DNA, 1200 bp, Homo sapiens
atgacataaatgacgagcaatgccataccaagacaccagatgatgatacacagctacacatgatggacacttacatgccatgtcatgcgccatcttaggcactctattgccacctccacgagcgttcacaaagacaagtactatgctcagaaagcgtacacaaaactacaacgacaccatacacaacgacatagagagattcacagccactaatagaaatacactgacatccactatatcatcaccaaactaaattcgactgcgcagcacacgcacgtatggaacatcggctccactccgaacaaaccacaggatttagccaaacttgagacaacgaacagtagaaactaagccaagacacgcaccactcaattatcacatcaacactcatttacaaaaaagagactcatatcagatgtccccaccatacgaaaacaacttgcgcgaaccccaacagagagttcaaggaagatccacagacacccacatggtcatgatcatgtaaaatacacagactccaaatctatcgacaccacaccaaagcgcctaccacaacacctaggaacacttcacattagataaacgactccctccgataactcacatctaacatccacacacataacccaatcacccaaacacatgctacccatccacctaacacaaccaccacccccatgatctctccaacagaacaaccacagtatcaatcaacacacacaaacataaatacaattcgccacaacccaattattccatacacaaaacgcacagacatataaaactactaagcacaacacacatattaataacataacactcctaccctgacaataaaccaaatcccaatgctaataaacaaatcccaccaaatgagcacacccaaaacacacaatcggcatacaacgacgagatcctaatcacaacaaggacacatatgcagcgccaaacacgattttcactactcttacgtgcacaacatacaggtacaccaacacctacagcatagcccaaagacgccacgtacaactcgacacaacacacaagtacaacagacgaatcgagccagaccacccgtacacaacaaccactaggaccccacatgcgaacaccacctcaacagagcagttaccacaaatcagccaacatagcgaccattgaaacatcgaccaagcgagacatcacacaaccaggctaccc

SEQ ID NO: 502535 - DNA, 612 bp, Homo sapiens
gagagggaggtacgctctctttgcccaggcaggagttaaattgtgcaatctaggcccactgcaacctctgcctaccgggtttacgccattatcctgccaagtggaggctggaatgagctgacaccacaccaccgcactccagtctgtactacagaacgagactccataccagaccgtaagtggcctgggaggcaaagaagccccgtagttgcaggatgctctcccggacttgccctgaggccaaaagttaatagggccaactattgccctgcttgaaaagaagtattacagtttccgggaggccttcttttgccagggaagaggattgcaaagggtggccccacaactggttgaaacaaggcccggaggttaaaggtccttaagggaaccccgaacgtggacaaaaccgggaacaccaaaaggagccccgcgcacagtgtcttttgggccccttctctgaaccaggttaaggggtagagccctttttaaaaggaataagacagggaaattcccaagacaccaggtttgtaaaaaaaagagtctttttttgaaacccccagagcacacaaaaaaaaatttgggtttgggacccccaacacctttggggaacac

SEQ ID NO: 502536 - DNA, 761 bp, Homo sapiens
aatgattcagctgacttgaggacaaggcctagcatttggctgagcagagccctcttcttgcctcaagctggtggtaggctaggctatggacaatggacagtctggttggtccaaacggtaagaatccggtatgatcccctgggaggtacaggtgacctctgcaactatgcatgatttctcaaacttcaagattcatgtctgtgatgtattatgctgtggatataagtttagtagggcggtcatttcctactctgagttactggttacctagccagtccactgggctgtgacttgtgtccttaagtcaggtcactatctgcctcccaccctgggggcaggactgaagtatagaacgagcatcatggctgtgcatgcaggctgtggtttgaaaactgcagcccaggagggcactttcagctgccctcaataatgtgaagtggattcagtgctaggagtcctaaggacgcaatgactggattatctcatctgactgtgtgcagaatcctgttgaatgtccctgtcttctattggttgggcagaagctctgcatatggttgaaacatttccaaggatctggttcaaaccaactttttcctggtcatggcccggtccgaagagggattagtcctatttccactcggtcccgttggatcttctgacaacggagcgtctttattgttagagtcacaaagactcaaatctctgatacggaaggaaaggaaagggacttaggttcctttaaagagctcaatattcctgag

SEQ ID NO: 502537 - DNA, 605 bp, Homo sapiens
gtaatactagtatatcgctcacacctcatatactccgtactatgcctagaaggaataatactatcgctggtcattataggtactgtcataaccctgaacacccactccatcttagccaacagtgcgcctattgccatactagcctatgccgcctgcgaagcagcgatgggcctagccctactagcctcaatctccaacacatacggcctacactacgtgcatagcctaaacctactccagtgctaacactaatcgaccgaacacttatattactaccactgacatgactttccaaccccctactatatcataacctgaacatcaacctattaagctgttccccaaccttcaactacgaccgcctaacagcctctctgctaatactagctacctgactgctaccccttacaatcatgacaggccaacgtcacttatccagcgaaccactatcacgaatataactctagctctctatactagatctcgctacaatctacctaagtattacattcacaggcacagcactactggtatatatatcttcttcggaaccacactgatgcccacctttgctatcataccccgatgaggcaaccagtcagcgc

SEQ ID NO: 502538 - DNA, 196 bp, Homo sapiens
gtacaggtaacgcctggtgctccacccactcccaggagacaaaagccttcatacatctcaagtgggggacacaaaagggggacgggggggcacgaaggtcatcattcaaaataaaacaaaataaaaaagtattaaggcgaagattcaaaaacattttgcattacataatttacacgaaagcaatgctatcacctca

SEQ ID NO: 502539 - DNA, 724 bp, Homo sapiens
cagtcaatcagactgtcgacatgccagaaagatgtcgacattactactgaagggacgcacagttatcgtgaagggccccagagggaaacctgacggtggagggacttcaatcacatcaatgtagaactcagacttcttggaaagaacaaacagaggctccgggttgacgaaaatggtggggtaacagcaacaggaacgggctaccgtgtcggactatttgttagctcatgtacagaaatcatgatcaagggtgtcacactgggagctgccgttacaagatgaggtctgtgtatgctcacttccccagtcaacgattgtttatccaggagaatgggtctcttgtttagaaaatccagaaattagcttgtggtgaaaaatgatactccgcaagggttcgggatgagaccaggagttgctagttcaggggatctcgaagcccatgaagaggatgaatgaatccttgaaggacatgacattgagcttgtttcaaattcgagaggctttgattcagcaagccacaacagttaaaaacgaggatatcaggaaatttggatggtatctatgtctctgaaagaggaactgttcagcaggctgatgactaagatctaagagtgacctggctacagaaagattgatggcagatgacacttaaggacctaacttggtgaatatctacacatggatgccgataccaaagacctattgattcgggaaacaacgccag

SEQ ID NO: 502540 - DNA, 392 bp, Homo sapiens
tccgaattccggccatgggatctaattaaactaaagagcttctgcacagcaaaagattctaccatcagagtgaacaggcaacctacaaaatgggagaaaattttcgcaacctactcatctgacaaagagctaatacccagaatctacaatgaactcaaacaaatttacaaaaaaaaaaaaaaccaaccccccccttaaaaagggggccgaggtatttaaccaaccctttttaaaaaaaagacttttttgcggccaaaaaacacttaaaaaaatggctaataatcatgggccataagaaaaatgcaattaaaacccacagggggttcccttttcacacaagtgggagggcaattctttaaaaggccggaaaccggggcctgaagggattgtgg

SEQ ID NO: 502541 - DNA, 297 bp, Homo sapiens
  misc_feature (214)..(214): n is a, c, g, or t
gatcctatatctagaaaaccccatcatctcagcccaaaagctttttaagctgataagcaacttcagcaatgtctcaggatacaaaatcaatgtgcaaaaccgctagcattcctataaaccaacgacaggcaagcagagagctgaatcatgaatgaactcccattcacaattgctacagaaagaataagttatctagggaattacagcttaacanggggaagcgaagggacccctttcaagggaggaacttacaaaccacttgcttcaaaggaaatccaggaggagggacacaatggg

SEQ ID NO: 502542 - DNA, 302 bp, Homo sapiens
aattaatgacacatcctggcggggagcaccagatcttcaaagggcgctcatggtacttcccagaccagacggccaattccctgacagcacggcatccagtccttttcatgtattattattatatttttcgagaaggtctcactctgtcaccaggctggagtgcagaggtgcgatcacagctcatagcagactccactttccaggctcaggtcattctcccacctcagcctcccaagtagctcgaacaaccggtgcatgccaccacgcccagctaattttttcttttatttttagtaaagaca

SEQ ID NO: 502543 - DNA, 104 bp, Homo sapiens
gagcggcgttaaaccaactgggacatttcaagttgagaagagtagttgaaaagacagaaaataccattttaaaatagatatcaggagttcccgttgtggctcag

SEQ ID NO: 502544 - DNA, 125 bp, Homo sapiens
ccgaacactctaacacatccttaggaatagcatgtatttgtaggaagcaacaaagctttccatagagaaacttgtctatgtaccttaatactttgtttaggatgaggagtctttgtgtccctgta

SEQ ID NO: 502545 - DNA, 519 bp, Homo sapiens
  misc_feature (114)..(114): n is a, c, g, or t
  misc_feature (123)..(123): n is a, c, g, or t
  misc_feature (187)..(187): n is a, c, g, or t
  misc_feature (365)..(365): n is a, c, g, or t
  misc_feature (389)..(389): n is a, c, g, or t
  misc_feature (407)..(407): n is a, c, g, or t
  misc_feature (454)..(454): n is a, c, g, or t
  misc_feature (463)..(463): n is a, c, g, or t
  misc_feature (496)..(496): n is a, c, g, or t
gccgtggtgcgtgcctcgaccctgccattgtcagtgttcatggtgggtgtgggtggtcctaactttaggccatggaccacttggccgttgatggtggcccctgcatacacgttntgggcaggntgctgcccgcgacattgtgcagtttgtaccctaccgccggttccagaatgcccctcgggaggcnttggcacagaccgtgctcgcagaagtgcccacacaactggtctcatacttcagggcccagggttgggccccgctcaagccacttccaccctcagccaaggatcctgcacaggccccccaggcctaggttcccttggaggctgtggcaagtcctcaatcctgtgtcccaggggtccctntgggccacaacccaacccttctcnctttcctcagctgtagcnctttgtattttttgatacttttatacttgtttctgcttttgctgctnttgatcccncctttgctcctgacaaccctcattcaataaagnccagtgaaggcccaaaaaaaaaa

SEQ ID NO: 502546 - DNA, 855 bp, Homo sapiens
ggttctacaccaggcagtccccaatatcccggcccagtgagcccagcagctcggggccgtcctcgtattacactgacccaggaggacctggggatgaaccctgtcgggaattccgatggcaatggcatttccacggtcccagccaagatcaccccaggggacgtgtgtgctgcccgcgcccgctcctagacctatctgcaattacagcctgctgagccccgtaccgaacaaggtagtgagaggcctgaagtaggctggggtgcgccatcgtgcaagaggacgcagacaggatgagggcccgttgaccctggaccttgctgtacttcgttgatgtccacttctcatgaacgtgtctcgatgggctgctaacgggcagttcctctgatatcctcacaggaagcacagctctctttcaggctttccatggagtaccatatatgaactcacactttgtctcctctgtcgcttctgtctctgacgcagtctgtaagcttctcaccatggtcagtgtggtgacggatccccgaggggcttgacacttccttaacgaggtgcgcagttggacccacgaattcctgaacgagcgacgaagacgcacgtcgaggaacgaacgcacggcgcgcggccagcgacgcgtcacgaacgcgcgccagttgttactcacacgatcacaccagggcaacattcccctccacccggcgccaagtgggcacctcacactctgacccgcggaggacaacctacataaacagacaataccccccaaggacctggtggagcccacatcgaccggcagttactaccacagactctctgccgaccctaataaaccgacggggcgctcttcccagccca

SEQ ID NO: 502547 - DNA, 159 bp, Homo sapiens
agtatttagagtctgtaatgtcggtcgagagcgtatgatggcagtgaggggcgcaatgatctagctatatatcgatatacgtagcgtaacgtaaacggtactctagaatatagtaggatgcgaaatttaaagagtgatattgatcgagcgcagatctgt

SEQ ID NO: 502548 - DNA, 307 bp, Homo sapiens
tccttacgactagccgacagtggggcggatacattctcgtgcactcccgcccagcctagcccaagactttggatacggggcgagatgaaggggagagggttgtttggtttcggacgacccttagctctgacacggaagagaagtacctataccacacctgcctgttacgttccctccccttttcccagcgcactgttgagggcagcctctccagctctcttgtttatgcaaacgccgagcgcctgggaggctcggtaaggaggagtcttccacggagccggcccgccccctgttggggtagtcgaag

SEQ ID NO: 502549 - DNA, 383 bp, Homo sapiens
  misc_feature (134)..(134): n is a, c, g, or t
cggtggtgttatacaacacaatggccaaaaaaggtttctggagctggcaaggttcccaagtttgcccaaaaagctcagaagggtaaaatgaaaatatccctaaaacccgcccccccccttttaaacaatggggnaaagacggtttcaaaactgtttgtttccattggccccttaagtttagtaataaaaaactggttaattaaaaccagggcttgttaaaccctcaaaaagaaaagaaaattttttttgggcccccttggtttttttttttggggggggcaagtttaaaatattagtttttaaaaacagggctttttaaaggaaaccacttggccaaaaatttgtcccagaatttttaggccccttaaaaaagtttaatgtga

SEQ ID NO: 502550 - DNA, 665 bp, Homo sapiens
gagcgatccctagaggtattcagcagagaatcgtatctctgtgggagagggcaagagagacagtgtggggccgaaggtgacttgtgtgatgcctgtgtcgggggaaaaccttgtggaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaaagcccaggatagaggtgtcgagggagaactgggcaatgaggagagcttggatagaaatgaggagggcttggatagaaatgaggagggcttggatcgaaatgaggagagcttggatagaaatgaggagggcttggatagaaatgaggagattaagcgggctgccttccagataatctcccaagtgatctcagaagcaaccgaacaggtgctggccaccacggttggcaacgttgcaggtcgtgtgtgtcagggcagtcagctccaagggcaaaaggacagagctgtgtccagttcaccgaaaactgcttggcccc

SEQ ID NO: 502551 - DNA, 496 bp, Homo sapiens
  misc_feature (74)..(74): n is a, c, g, or t
  misc_feature (308)..(309): n is a, c, g, or t
  misc_feature (389)..(389): n is a, c, g, or t
  misc_feature (392)..(392): n is a, c, g, or t
  misc_feature (394)..(395): n is a, c, g, or t
  misc_feature (398)..(398): n is a, c, g, or t
  misc_feature (401)..(401): n is a, c, g, or t
  misc_feature (403)..(406): n is a, c, g, or t
  misc_feature (408)..(409): n is a, c, g, or t
atccacgtgccattgtgggagcagcagaaattggcaggggccatgtaaattgtgaagactggggaaatgatgcnttggttacctccaggggtctcaggtaggcagtcccccattgggtgctccagattggggttccgtgggtcagaaggaaggcccagtggttccacacaggcaggtgaccatggtgggggcctttggttctgcagccccttcaaggaagctctacatgaaagtgtgggtcttctctccctgcagcacccccacattcactcatttgtgcattcatacatgcatgtatacatgcaaanncacatgcctctactttcttccttaattgtgtatctatgtgtgttttcttctttttctcttcctttctcccataaccaccntgnanntgncangnnnntnnagatcctcccaattaagtggtagcccttaacactgcatgatggacactcccaagtttcccctcaaagcctccttggggggatcctct

SEQ ID NO: 502552 - DNA, 629 bp, Homo sapiens
ttttctccccggagatttttgggttttcttcccccccgagatattgggcacacagttctacactggaaaacctcgggaaaaggtgggtgggcctttgttccctcgggcgttggagccgctaaactccccggagccccacaaaaagcttgttacttccttgaaaagaaacactctgaattgagtgggcgacccctcctcagagtgttgcgccccctctacacacgccactactgtctctcgggtgggctgtggaatttgtgaccgcctatcccccccgcccaagatggaacacgagctgccacaggggcaagaaaaaagagattccccacagaggggattcacaagaattaaattctttttgttggaaagagtggtaataaactacacattcacccttatagccccacaaggtactctggtggataatcccctctgggaccaaactgttgtcaataaagggatagttcttcagagatcctcggcttctttaaaggcaagggcccgcacggggggcacaaggttcaaaatttgtaagagaagaataacaacaacaggcaagaaacaaagggtttttcccaaaaacttcggttttaaaagctttgtttttgatccatttaaaattataaaga

SEQ ID NO: 502553 - DNA, 253 bp, Homo sapiens
cgcccagcattgactgcacatgtgaacatatgaggtgcccaacaaccagcatgtgaaggtgcgcttcaaattacttctacctgctggagccctggcgtgcatgcgggcacatgccccatggactatgtggagatcaacggggagaaatactgcggagcgaggtcccagtccgtcgtccccagcaaccgcaacaagatcacagttcgcttccattcagatcagtcctacacctgacccggcttcttcgctgaat

SEQ ID NO: 502554 - DNA, 473 bp, Homo sapiens
tctcagtgtgatagactatgcgttgccaagcttcctgtccaggtttgtacctgccacagaaatatcttgaaagtttatctaacagctggagccatgaaaaaaaaaaaaaaaaaaaaaccatgggagcttggtaaaacggggggggttttgccaacgggaagagcccaagaaaaagtacgaggttgccaaggtggttggctgcaagaggtgcccaaggtgggagcgcggggaattggcggtttgggggaagctgggggtgccttctaccactggttctttctgggccccagtgatgtgtcctctcttaacggtgcacacattctttcatgaagatgaccaagcccatacataaccggggcatgaacaccccattggtggttatttctgcattcaggaacaagtgggtcctatggcccagctctctgatgaatgggcgagtatagagggggagataatagggctatttctcatgg

SEQ ID NO: 502555 - DNA, 152 bp, Homo sapiens
tccaaaatgatgtagaacctcctatgaatctataattattctaaataaaaactaaaaccagccgtggacaacataacaaaacccactctacaaaaaatacaaaaaaaatttgccaggcatggggacacagagcctgcagtcccagctacctg

SEQ ID NO: 502556 - DNA, 430 bp, Homo sapiens
  misc_feature (58)..(58): n is a, c, g, or t
  misc_feature (99)..(99): n is a, c, g, or t
  misc_feature (111)..(111): n is a, c, g, or t
  misc_feature (210)..(210): n is a, c, g, or t
caggctggttcgagctccggcctcgggtggtccgcctgctacggcttcagggtgctgngattgcaggcgtgagcactggtctggcttctataattttgntagtcacgatgngaacaaacaaaacagcttagaaccagagatctgacccctcaagcaatacatcaatttcccttcacaaggaaacgtcggggctacatgagtatctgtgtngaatgcggtctggaaaatgatcctatggattttccgggctgttgccactgctgtacaacattcaggtgccacatccacctgtgccattaagcttttttgggacatgggagatgcctctttcctgctgtatgacatgcatttgggacagttggcaagaaatgaccaaatcggggggacaacatccaagcttcttacctgtagatagaatcaggcctcactt

SEQ ID NO: 502557 - DNA, 908 bp, Homo sapiens
  misc_feature (29)..(29): n is a, c, g, or t
  misc_feature (96)..(96): n is a, c, g, or t
  misc_feature (157)..(157): n is a, c, g, or t
  misc_feature (252)..(252): n is a, c, g, or t
  misc_feature (254)..(254): n is a, c, g, or t
  misc_feature (260)..(260): n is a, c, g, or t
  misc_feature (266)..(266): n is a, c, g, or t
  misc_feature (268)..(268): n is a, c, g, or t
  misc_feature (277)..(277): n is a, c, g, or t
  misc_feature (280)..(280): n is a, c, g, or t
  misc_feature (286)..(286): n is a, c, g, or t
  misc_feature (293)..(293): n is a, c, g, or t
  misc_feature (298)..(298): n is a, c, g, or t
  misc_feature (300)..(300): n is a, c, g, or t
  misc_feature (306)..(306): n is a, c, g, or t
  misc_feature (323)..(323): n is a, c, g, or t
  misc_feature (332)..(332): n is a, c, g, or t
  misc_feature (334)..(334): n is a, c, g, or t
  misc_feature (336)..(336): n is a, c, g, or t
  misc_feature (339)..(339): n is a, c, g, or t
  misc_feature (342)..(342): n is a, c, g, or t
  misc_feature (347)..(347): n is a, c, g, or t
  misc_feature (364)..(364): n is a, c, g, or t
  misc_feature (368)..(368): n is a, c, g, or t
  misc_feature (378)..(378): n is a, c, g, or t
  misc_feature (380)..(380): n is a, c, g, or t
  misc_feature (445)..(445): n is a, c, g, or t
  misc_feature (456)..(457): n is a, c, g, or t
  misc_feature (461)..(461): n is a, c, g, or t
  misc_feature (632)..(632): n is a, c, g, or t
cccagctttaagatatctagcagaaactntagctgaggactaaggaattctgcagcttgcagatgtttaagaaaataatggccagattttttgggnccttcccaaagatgttaagtgaacctacagttagctaattaggacaagctctatttttcanccctgggccctgacaagtttttaccacaggaatatgtatcatggaagaatagaggttattctgtaatggaaaagtgttgcctgccaccaccctcngnagagcngagcangnctgtgaaanagnctgcanggccaanggggncngggagnaaagggaacaagggggnagggcgaangncnganganaaagnagtggaggggaaaaaanatcngagtatattntntttttttttttttttttttttttttgtttctcgtggaagaccttagtaaaatcaaagatcagtgngttcatctgtnntttnttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaatcaanatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaaaaaaa

SEQ ID NO: 502558 - DNA, 135 bp, Homo sapiens
aatgatatacatggcaatgaggctgaccacaagaactggccagagagagggactggggcatgttgctctctgtttgcccagcactctacgatctttgtagattatgttgtatagatcatgcctgcgaacctatta

SEQ ID NO: 502559 - DNA, 955 bp, Homo sapiens
  misc_feature (29)..(29): n is a, c, g, or t
  misc_feature (96)..(96): n is a, c, g, or t
  misc_feature (157)..(157): n is a, c, g, or t
  misc_feature (252)..(252): n is a, c, g, or t
  misc_feature (254)..(254): n is a, c, g, or t
  misc_feature (260)..(260): n is a, c, g, or t
  misc_feature (266)..(266): n is a, c, g, or t
  misc_feature (268)..(268): n is a, c, g, or t
  misc_feature (277)..(277): n is a, c, g, or t
  misc_feature (280)..(280): n is a, c, g, or t
  misc_feature (286)..(286): n is a, c, g, or t
  misc_feature (293)..(293): n is a, c, g, or t
  misc_feature (298)..(298): n is a, c, g, or t
  misc_feature (300)..(300): n is a, c, g, or t
  misc_feature (306)..(306): n is a, c, g, or t
  misc_feature (323)..(323): n is a, c, g, or t
  misc_feature (332)..(332): n is a, c, g, or t
  misc_feature (334)..(334): n is a, c, g, or t
  misc_feature (336)..(336): n is a, c, g, or t
  misc_feature (339)..(339): n is a, c, g, or t
  misc_feature (342)..(342): n is a, c, g, or t
  misc_feature (347)..(347): n is a, c, g, or t
  misc_feature (364)..(364): n is a, c, g, or t
  misc_feature (368)..(368): n is a, c, g, or t
  misc_feature (378)..(378): n is a, c, g, or t
  misc_feature (380)..(380): n is a, c, g, or t
  misc_feature (445)..(445): n is a, c, g, or t
  misc_feature (456)..(457): n is a, c, g, or t
  misc_feature (461)..(461): n is a, c, g, or t
  misc_feature (679)..(679): n is a, c, g, or t
cccagctttaagatatctagcagaaactntagctgaggactaaggaattctgcagcttgcagatgtttaagaaaataatggccagattttttgggnccttcccaaagatgttaagtgaacctacagttagctaattaggacaagctctatttttcanccctgggccctgacaagtttttaccacaggaatatgtatcatggaagaatagaggttattctgtaatggaaaagtgttgcctgccaccaccctcngnagagcngagcangnctgtgaaanagnctgcanggccaanggggncngggagnaaagggaacaagggggnagggcgaangncnganganaaagnagtggaggggaaaaaanatcngagtatattntntttttttttttttttttttttttttgtttctcgtggaagaccttagtaaaatcaaagatcagtgngttcatctgtnntttnttttttacttgctttcttactgacagcaaccaggaatttttttatcctgcagagcaagttttcaaaatgtaaatacttcctctgtttaacagtccttggaccattctgatccagttcaccagtaggttggacagcatataatttgcatcattttgtcccttgtaaattatatgctgtccaacctactggtgaactggatataatttacaagggacaanatgttctgcagattattcctttaacggccggacttttggctgtttcctaatgaaacatgtagtggttattatttagagtttatagccgtattgctagcaccttgtagtatgtcatcattctgctcatgattccaaggatcagcctggatgcctagaggactagatcaccttagtttgattctattttttagcttgcaaaaagtgacttatattccaaagaaattaaaatgttgaaatccaaatcctagaaataaaatgagttaacttcaaaaaaaa

SEQ ID NO: 502560 - DNA, 392 bp, Homo sapiens
gtacctctggattgtgtccctgcttgtttatgatagttaatgaaagctgcctattgtctggagggagaggcttagtgcatgaagcctattactttacaatggtgcccttcagaatgtctgctgggctcagaaggctcttagtcgtgcttgagagtgagcctttcgaagagatactcgcccagcccagcctccgggccacccagcctgtggaggttggtcaggtgttcacccatcttcttgataagcttcacttcctcatctaggaatgtgagtctccaggaagtcacagagatgggggtcctgtgctgggaatgaacccagggcatgaagatccaaaagggcctggtacaagctatttctccagtgccatgaaagcttacatggcgtcttgg

SEQ ID NO: 502561 - DNA, 170 bp, Homo sapiens
cgcttcacacgatttgactgccatcatcttcgtggtcggccagcagcagctaccacatggtcatccgggaggacaaccagaccaaccgcctgcaggacgctctgaaccccttcaataccatctggaacaacagatggctgcgcaccatctctgtgatcctctagattcta

SEQ ID NO: 502562 - DNA, 1074 bp, Homo sapiens
  misc_feature (292)..(292): n is a, c, g, or t
agcgcctcggcagtgcgtacatgcctgcattcaagatggaacgtctagaagaatcatccctttcgcaggccactgagacatagcccacaaaacatccaatttcgaacgttggaactgataggaatcggtcgataacatcttcgatagcttatgcttgactggagcatatgtcgatatgagctcagcaaagcccgttggacgtcggcatggactggctcatgtgagttgaccagaactgtgcaagaggatgattgtcggtctcgaactcctagtcggcatggaaagaacagantatgatcgaacgtgtttgatccacgcaagtcgaagacgtcaggtggttaggtcattcgcaacctccactggcatccgctggtacgcagtacattggttacctttgaagatgagagtgcgtgccactttcctgattcacctggagcacagacgtggagaaacccagcgcacgcaaacaagcatacatgaaggaatacgtatcacaagtcaccctgctgggttatggcacttctagtcgaggaatcggcacacctatgcttgggcagcctggtatccttcaccacgttccgaggttacctatcctgctagacaatcacaaggggaaggcactcagaagggcactaatttcccattgcgggacattgactcttgggtattactcgtaaaccgcgctagccacctagccgtccccgttcactatggggggcggtataccctccatagcagatgtacggccgtaatggccacgtacagtgtcctgggcaaaaagcctttcccctcacaacttacataccttcctaaaagtaggaacatgaccttgactttgtcccccgtgacccacaataccatgcatgaacataaatggaaacataggcctgcacgtaaccactctacaccggcacgacaccgggctcaatacaaataccccgcatacggggacaaccagagaagggctacccacccaaaggaaattccacagaccagaaacacaggggtatacagcgtacccgacccgacgtgtatccccagggaaaggccgaaccaagaacgccgcggccgcgc

SEQ ID NO: 502563 - DNA, 678 bp, Homo sapiens
  misc_feature (517)..(517): n is a, c, g, or t
catattcaaggatacattatttatctatacagcgtttctacatggcatagctttcaaattctctttgtgaagtatctggcggttataatagctccacccccatctccattcctaccggtcaagagaacagcaaaggcactagaaccttcattgcatgactgtctggattggtagtatacatgtatttctggaaatgtacttcttcaaacgaatatttttctactttggatttttttttttttttatccattcgcagaacccctttgctgatgcaactaagggtgacgacttactcccggcagggaactgaggattacattcatataagaatccagcaacggaacggcagaaaagacactgactacgtgttcagggcattgcagatgattatgcacaaaaagaacacttgtgaaagctttcaaaaagaaatttgcctgtcaatggtcactgtgcattgacacatcctgaaatcacggagcaggttatctcagcttcaaggtgcaccaaagaaaaaccnatctgcccagtttcctctgtggcaggttgcaggtgcatgggggtgcttaatgttgtacaccttggagaattgcgttttcacacaattgtcatttacagaggccacacatgcattgtgtttccctaactaagttacaaaaatcatacgcattgcacggcaaa

SEQ ID NO: 502564 - DNA, 713 bp, Homo sapiens
gctggtggagcctggctcgccggcgagaaggcggggtgtggcgggggaccggctggtggaggtgaacggcgaaaacgtggagaaggagacccaccagcaggtggtgagcctgcatcctgcgccgcactcaacgcctgtgctgcctgctgtgtgtgtctgacccctgatgactggactgagcatgctgcatgaagctctggctgtccagtgtcctgatgatggatgcttgcttgcgctgcccaggaatgcgcctggggcatggcctgatgcctgcctggcctgcctgccgagtgtgcatgggtggcttggcaacgaaaatgagcctcgctgaggccgacaagagccaccctggagcagcgcgagcttcggcctcggctctgtaccatgaagaagggccccagtggctatggcttcaacctgcacagctgacaagtccaagccaggccagttcatccggtcagtggacccagactccccggctgaggcttcaggggctccgggccccaggatcgcattgtggcaggtgaacggggtcttgcattggcgggcgaccgccgccattgggggacgttggtgtgccgccatcagggctggccggggacgagaccacgctgctggtggtggccaggggcacctgaccgagtcttccgaatgcgagtgtccatctcacgagcccctgatggtcctgcctgtcccttcaccatgggggccta

SEQ ID NO: 502565 - DNA, 545 bp, Homo sapiens
cttttggggtctttgctgaatttttttctcagttctaggagctctctgaaggagtctttagggatttcacggtaaacgatcatatcatcagcaaacagtgacagtgtgacttcctctttaccaagttggatgccctttatttctttctcttgtctaattgctctggctaggacttccagtactatgttgaagaggagtggtgagagcaggcatccttgtcttgttccagttctcagagggaatgctttcaatttttccccattcagtattatgttggctgtggttttgcatagacggcttttattacactgatgtatgtcccttatatgccaattttgctgagagttttaatcataaagtgatgctggattttgtctaatgttttttctgcatctattgagatgatcatgtgatttttgtttttaattctgtttatgtgacatatcatatgtactgacttgggtatgttaaactatccctgcatccctgatatgaaacccacttgaccggggcgtattatctttttgataatgtggtggattcag

SEQ ID NO: 502566 - DNA, 1378 bp, Homo sapiens
  misc_feature (505)..(505): n is a, c, g, or t
  misc_feature (580)..(580): n is a, c, g, or t
  misc_feature (981)..(981): n is a, c, g, or t
  misc_feature (992)..(992): n is a, c, g, or t
actttctccttcttctgtccctctccgttgctgtgtctctgcttgcctcttctttcttttctcttcctcttgctgtttcccgcctgtcgcttactggtgtctatcgtcctgtctcttgtgtctgttactcctctgtgaactcgagctcgttccgcttctcgtccgccgttctcgtcgagtccttccgtccttactttctttggtcgcttatggtatctgttctgtccgtcctgattccgctttctttcttgcttcctcgtcctctcacctcgttcccgcgtgtcttgtgtcttttgtctctatagagtggctccaccccgacgcggtgtgtcggcgcgaggagggcgcccaggggtggtgtagtgatcttgtgttgtaggtttgtcggctgcccccccgcctgtcctgatgagacgtccgctctgtttagttgcgtggggtgaacaagaaattctcgtggtgtgcgccgtcgtcatcttgtccaatgtggggcgtccgcccccanagagcgtcttgtcgcccgccccttttttttacggcgacgaccgaggtgtactgaaaaaaaaaaagtcttttgggntgattttatagcgcgccccgtttgcggagccgctgagtttgtcggtcgccccccgtggctccgtccatgaacaaaagacaggggtgaacacctgtcgcccactggtaaagggatcaatatatataaggggcccgcggtgaaaagtgttgtcgttacgaccacgcgcaccaatgttaggccccggtgggtaggtatgaaggccgccccctggttgtttgaaaagagataacgaaggtttgtgcaaataggggcgtagacaaaaatgggaaagcagctacagaaagaacccttggtggtgagacaacaaggcgcaacgcctcatgggtccgccgctcttgccgaatagatgtcttgctccataatatacgcgcgggcgcccacctgtggctgtccacgcctcnccatatttagnctcccgccacaccattggtgagggcgcgcgcctcacacgcgggtatctgtacccacacgttcacgtgcgggttaccacgcacaccgccgcaccgtggcccacacacactgtaggggagaaacgcaccttttcttagttactttctaaatagcgccacgcgaaatacattacggagcgcgcgagtgatatgtagggcggccacgctagataggacacagtatgtcgccggcgggaggtgggagtgcgcgcgaggtaatgggcgggagacaaccacagcaggggtggggcgagtccgcgggcgtccagaggtgattgcgccccgacccccccgcccccacgcgacgcacgcgtggcgacaacatcccccgccccatcaaagaacgaga

SEQ ID NO: 502567 - DNA, 155 bp, Homo sapiens
tgttacactgagggaaagggtggggttaggctgtgatattaatttgcctcaataatgttaatctggactggttcaagaacaaagttaaagtttccacgcgcaaactttgttttcaaaactgccgacattgcgaacacaagtggctaggcttcacg

SEQ ID NO: 502568 - DNA, 454 bp, Homo sapiens
  misc_feature (129)..(129): n is a, c, g, or t
  misc_feature (146)..(146): n is a, c, g, or t
  misc_feature (156)..(156): n is a, c, g, or t
  misc_feature (230)..(230): n is a, c, g, or t
  misc_feature (398)..(398): n is a, c, g, or t
  misc_feature (401)..(401): n is a, c, g, or t
aaaaatgatgtggtaaacatacccccatatttatttgaaagaatgcaatccccccacatcattgttgccaaatatgaacagtgcaaaaaactgcagttcccttttgcacccaaccctatttgcatcaanaattttccctaactggnccatgttaanaaatgtgtgtgggccgggtgcagtggctcatgcctataatgtcagcactttgggagcccaaggcaggtggatcnccttaggtcaggagttggagaccagcctggccaacatggtgaatctccatctctactaaaaatacaacaattagccagacatggtggcacgcatctgtaatcccagctacttgggaggctgaggcaggagaatcacttgaatccgggaggcagaatttacagttagcntgnggcgccattgtactccagcctcagtgacaagggaaagctccaaaaaaaaaaaa

SEQ ID NO: 502569 - DNA, 129 bp, Homo sapiens
ctaccatgtgagctctccatcttatatagctcatccccagatactgcaggtccaacaggcaaggtcaaagccccactcctgagctccaaattttccagcagggaggatcctcctgggccactcagtggg

SEQ ID NO: 502570 - DNA, 127 bp, Homo sapiens
tgtcactagaggatcccctcccaagcatgaggaactggactgagccatgtgctggataatagtcggttatctaatgagctctatatgcattgccgcagtatcctatggtactatgctactgtataga

SEQ ID NO: 502571 - DNA, 350 bp, Homo sapiens
  misc_feature (116)..(116): n is a, c, g, or t
  misc_feature (210)..(210): n is a, c, g, or t
  misc_feature (307)..(307): n is a, c, g, or t
gaaaatgcagattcactgagccagactaaggcatcagtgactgttcctctacctgcctctcacatggagattgtgtattcagtgaaaggctgatcaaagacccaaaggaatgcaanagtttatctcttatctacctatgacctgcgagctgcccaccacccccagttgttgcgcctttccagacagaaccagtgtacatcttacacgtantgattgatgtcctgtgtctccctaatatgtatcaaagcaagctgtgcctcgaccaccttgggcacatatcctcaggacatcatcctgaggctgtgtnactggcatgtccttaaccttggcaaaataaactttctaaattg

SEQ ID NO: 502572 - DNA, 916 bp, Homo sapiens
  misc_feature (561)..(561): n is a, c, g, or t
caagtgcttgccaaaaaagttgtggcttgccaaacgaaagtgtgtgaggactgtcaacgcgcttcgggatacaatgacccctccacgcttggggcccccccacactggtggaacccgccgggcggccctcaaatgtgaccaaagggcattctgcctaagagctcccaaagtgggtccccgaagaaacaggctaggcgggaaaatcgggaggcccctcttctctaatcactcgctctcgggcgacaccacaggtctaaagcgttttctcgccccgggaatgagtccatgagcaagcccctcgttagacaagaagggttattcaaagatcgccctcttttggagagtgcggcttcaccacgaagcccccccccggaaagttgcggagagtttttcctaccgcgcccactctgcggtctgcgccatcacaagaaaaacccccccgcggccaccaccccggaggcggagagcgcacctcctgggccgcacgcccaaaaaactgggggtcaaagagaagaagaacgccgcctacccccccccggaagaaccaaacccctgggcgtngaactacacccacaagggagccgtgccctcggcaagtaaaacagtcgagccagaatgggcccgctgtgaccacaaggaggcgagcgaactcctatcggggggacaataaagcgccccgggtttcccacgatccctgcaaacggtggacagatcagaagcacgtcttgtacatgcgttagcacggccaatgtggcataaatatgattactggcggcgagacccccccctgtgctagaaacctgcgcccttctcgctgtgcaggcgtttcttgtaaatcggatcccccaccaacgcccaaacaaggctcgcccaccgagaagaaatttttacaagaaaccataaaacggacaaaaca

SEQ ID NO: 502573 - DNA, 436 bp, Homo sapiens
attattggaaataaccacgtctcagcagtgctagttctcagtttggagaatgggaaatcgaaaggatcagattcagagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcatctccttcagtcctgggagggggtgacggaaccagcagtgtgtggagaccagcttcaaggagcggaaggctggcttgaggccacacagctggggcggggacttgtctgcctgtacttcatggggggacggctccacccggcctgcgccactgtgttcttaagaggcttccagagaaaacggcacaccaatcaataaagaactgagcaga

SEQ ID NO: 502574 - DNA, 116 bp, Homo sapiens
cggtccccgccgggagcagacagatctggtaaacttaatggtctctgctgtattaagttcaagtcttcatggttaggttttccggggccagaggaggttgagatctagttccatag

SEQ ID NO: 502575 - DNA, 374 bp, Homo sapiens
tttttttttgagacagagtggactccgttacccaggctggagcacaggggcacaatctcgactcactgaaacctccccctgccaggttccagcgattatcctgcctgagcctcccaagtagccgggaccacaggcatgtgccaccatgcccagccaatcctgcacctccagtagagacagggtttcgccatattggtcaggctggccttgaactccgaccccaggcgatccacccgccccggcctcccaaagtgctgggattacaggcatgagccaccgcacccagccattttcaaccataaacatttattctgctaaataaatatatactatacttatataaagcaaagaggatttaaatttctcctaattgt

SEQ ID NO: 502576 - DNA, 185 bp, Homo sapiens
  misc_feature (10)..(10): n is a, c, g, or t
ttggggggcnaaaaaaaaaaaggttttttggcccctaaattccccaaccttgggttttttgggcaaattttgaaaaatttttaaagggcaaatttttaaaaattttttaatccaaaaacccgggaactttaaaaaaaggtcccgggggcttttttaaaaaaaaaggtggggggtttgaaaattta

SEQ ID NO: 502577 - DNA, 296 bp, Homo sapiens
cgtttttgttactcttgtgagtctcattttattttaaaatacaatgtttaaaagtatacatagtaacagactttctttggggaggggaggtagattctgctctagcagacgtacctcgctttatagacacccgcttgattccattctgagagaggaccgagaataaatagttatcccgactgtgaacagggcagacttgacggggattctaacatcaaggcgctttcgatatttccacagccaacatgcatccactagggtcatatcacagtacgacttcagcaatgaatattcct

SEQ ID NO: 502578 - DNA, 752 bp, Homo sapiens
  misc_feature (752)..(752): n is a, c, g, or t
agcggagtggcggcggagatggaggagggaggccggtgataatgtgtcggtgcaggcccagcagtctccaggcggcggcccccggcggcacggacaagaaatgcctgatcggcgatatggtagacgtgctgggatgccgcgtggagcaatggaacgaagatacaggagcttgtctgatagaggtataaacatcgttcaagatgaattggaggatgctcgttgtacacgactagggtgagaatggatacatcccgtgttatcgagccatgcgctggcagcgaatttgctgaatggtccgacttcggttcgttcatacgactatatctcagtgacattcatgtgcccatagccatcttctaaattttcgtgacgtccacagatatgagcgaacatgaatggaaggtctatgagaacatggtccctggtggagaactaagacgtttgtgcatgctgacatcattctcacgttgtgggaccatgaccatgagtggggaggcgtgagatgccgtcaagatatccgtgatatatgggctccgaggacggaacttggtactgatggggtcagtgagtagtgtcaggcatctggcaggagaagtggctaaggagtggcaggagctgtgatgaccgcagagaaggtccgagcgtgagcctctgctcactctggtgacaccgaaatcggtcccctataacattggccacaatgcagagcatgaggcttgcgaactgttatggaaattgacgcaggtggacan

SEQ ID NO: 502579 - DNA, 643 bp, Homo sapiens
  misc_feature (347)..(348): n is a, c, g, or t
  misc_feature (397)..(397): n is a, c, g, or t
agcagtgtctcacacctctaatcccagcactttgggaggtcgaggtggacagataacctgaggtcaggagttcaagaccagcatggccaacatggtgaaaccccgtctctactaaaaatataaaaattagctacgcatgggccgggtgcggtggctcatgcctgtaatcccagcactttgggaggctgaggcgggcagatcatgaggtcaggagatcgagaccatcctggttaacatggtgaaaccccatctctactaaaaatataaaaaattagccaggcatggtggtgggcgcctgtagtcccagctactcgggaggctgaggtaggagaatggcatgaacccgnnaggtagagcttgcagtgagctgagatagcaccactgcactccagcctgngtgacagagcgaaactccgtctcaaaaagaggcaggagaatcactagaagctgggaggcagaggttgcagtgagctgagattgtgccagtgccctcctgggcaacaagagtgaaactctgtctcaaaacataaaggccaagtcattttccccattaaacatgttattaagacaatacgttgcacattatataattaagtgtccttaaatgttggtgactgaatttggtcaggtcaccaatattctg

SEQ ID NO: 502580 - DNA, 289 bp, Homo sapiens
  misc_feature (46)..(47): n is a, c, g, or t
cttttgatttcttttaaccctcacccgcggggcgggggtttttttnnggggggggggggtccccccccccctctctccgggcctggtgtgacaaaaaattctccccccggggggggatttttgggttttcctttttttttccctttggtttcccccctttttccccccccggggcccttgggatttagggagggtttggggggggggccccccccccttttttttccccccccccccccccctgtttttttggcccctttttcctttaaaaagggggtttttgttttta

SEQ ID NO: 502581 - DNA, 1542 bp, Homo sapiens
  misc_feature (1280)..(1280): n is a, c, g, or t
cgggttccggtgttggtgggtggtcttctaggtcgtcgggggtacgggctggtcgcgtagcgatggctgctggtggccctcgtctgctggccggagggggtgacttcttgtcctttgagctgcggccttgttgcgctctggcgctgtatgggggcgtgtgtgccttctgaggggggatttcgtccccccgggcgtgcgtgggttccctagttgggtatgtgttggtgccggctcgtcttttgtgtttgctgcgggtttgtatgtgcggagggtaggtggttgccccttggagttctgtcgtaaaaggtttttctccccgctgggggggggcttttgtgagggcgtcttctgccctccatgtgttggggggattggtgccagctgggccggttgtgtgccctaaggggagtgtttcccaggggcgttcgccccaggggtgtgatcgcatgtgtgatttgtgggtcttgctgtcgcgtttgtggaacggtgcctcaagggcgcagagtttgggatgttctcgcccccgcggtggtgcgatgtcttccgacgtcgggggccctctatcgccgcacttgggtttgttgaggctgtgttggcccgctccgccccggagtggttttcttcccgcggttgtgtgagaaaggggtgggcgctggtgtttgtctggcgccccgttgttcgccgtgttggtgctcccgccaccgccatggtaggtgttgtgcgttgtgggaatttctgtggggcagcgcagttggtaggaggggcgtttccccccagttttgtggcgcgtgacgcggctgttggatgaaacgacttgggagttccgcagttgtgtggacctcagcggcccgccccttgggggccgcatatatgtgaggtcgtgtgtcctccaatcgccggtttttcggtgtctttgttttctatggtgtgtgttgcccccataggttttatctgtatggcgcttgcttagatgcgccccacgtttttgcgttttttgcccgccagcgcgtatttgggggcgcccagtgtgtgcgagttgcgctcgccccggagggtgagagaactctgtcgttcacaggctgagaaaggtgttgtgggtgccacttggtcacggtatataaaaggggcttatatttggtgttcactgtttagacgttgtgcctcgccgcaaagattttttctttccagaggccaccacaggtgctctatggaggcaccacccagcaggcacaacgcccaaaggctcttttcccctggagaaaggctcttgttttgtatcnctaagaagagttataaccccactttacccacacctgagaaggtatgctcttttatatgtaactccgctggggaggcactgtacacgaggctctgggtaatagcaccacgctttaccaccccacccacgagttcgtgtacctaccacgtcgggcttgggttttcaataccacgaacgttaattttgaagaggaaaaagtccaaaggtgcttcagccttgtactgtgtatatatatttaaaaaaaaacccaaaaaaaataaaaa

SEQ ID NO: 502582 - DNA, 954 bp, Homo sapiens
gctgacgggcacgctgactggaggctggcggacaggcgaaaggaccctgggcaggaccagaggagcgagagcagaagaaccacacccagcagcaatgtcagcggaagtggcacactcagagggggtagacgagtcagaaaaaaagaactcgtggggccctagaaaaggagaacccaacatgagaagtggtgaccctctcggagctcctgacaaggcaccgggcaccacgggaagctacaacgaccgggcaagaaaacacccagttgtgtcaacggacttcttgacggggcaacattaaagaagggcgctgtttaacgcagtggccaccacggcacttttacttcaacattaactcaagcctcgaggcaggaacaattggagcgcacccaaggaccattccagcctttgtgccctcttgtgtaacttccccatggagctgacacctgaaaaggtaggcgctgaccaaggacatggaggtaatcccttggggggaaacactgtgaggagcatggtgctgttgccccagggtttgcccagaaagttcgtggagcgattcacttacaattggggcaggaacgagcgggagctactgttggcccatgtcatacacccgctacgtgggggatctctccggggggccagggtgctgcaagaagggtggccagcgagcacttgaattcccccagcacaggggaaagggccccagtctacctggtcggagatggtggaccaggccagcagtaaggagtccaacggcggatgaagcctggctgacttgaagcaacgacgtcgggagggccacaagttgagataacggacgtacgcggcagggggcacgggccgaagacggggggtccggacagcgagaaacgcgaactccggggaaaaaggggggcagtctacaatgtgggaaccacaccggggagtggaagaacacaacccaactcacacaag

SEQ ID NO: 502583 - DNA, 146 bp, Homo sapiens
tacatactatcagcactgtaatctgggtgggaccatgtcacttgtacactggagaagataggcatttgagtggatgagagggcttatggagtgggaatgcaaaaattctctgctacggactttatcaggtgaacataacagacttg

SEQ ID NO: 502584 - DNA, 154 bp, Homo sapiens
gtatttaggcagctgcttaaactctgagcttccatattttacctgtataaattaggcataccatgtagtggtaggaaataaatgaataaatttgggtgaaacatacctagcattgtacttggctatggcatattaaggctatatttcctggtac

SEQ ID NO: 502585 - DNA, 279 bp, Homo sapiens
  misc_feature (2)..(2): n is a, c, g, or t
  misc_feature (86)..(87): n is a, c, g, or t
  misc_feature (109)..(109): n is a, c, g, or t
  misc_feature (207)..(207): n is a, c, g, or t
gnggcttgggcttgcgccgttgttgagaaagatgctggtttcgagttttggagatccttgatataaaagaaacaaagacctgcttnnttgttttgatgattccttggcnctaacctccgcttgtgatggaccctagaaatactgctatgttcggattgggttctgattccgaaggtttttcacgacagagtccttctgccctctgtnctggcacattggtcagtccgagagacgtggagctcgcccctctcgctgtggcggacgaggcccttcgctaac

SEQ ID NO: 502586 - DNA, 371 bp, Homo sapiens
ttgtgcattcaacgtaacacaaagacgccagaatcgatttgtttcacgcctctaatcttatattttcgtccaagtagaggcggacgggatcaccagaggtcaggagttgaagaccagactggtcggctgggcgcggtggctcacacctgtaatcccagcactttgggaggccgaggcgggcggaccacgaggtcaggagatcgagaccatcgtgaaaccctgtctctactaaaaatacaaaaaaattagctgggtgcggtggcgggcgcctgcagtcccagccactcgggaggctgaggcaggataatggcgtgaacccagaaggcgaagcttgcagtgagccaagatcgtgcagagcgagactccgtctc

SEQ ID NO: 502587 - DNA, 191 bp, Homo sapiens
gccgagatgtctcgctccgtggccttagctgtgctcgcgctactctctcttctggctggagctatccagcgtacttccaaagattcaaggtttacttcacggccaatccaggcggagattggaaggcaaaatttcccggaattgcccatgtgtccttgggttcaacccacccacaaatgaaggtggctctc

SEQ ID NO: 502588 - DNA, 826 bp, Homo sapiens
  misc_feature (310)..(310): n is a, c, g, or t
tcttttgtgacagagtctcgctctgttgcccaagctggggtgcagtggtgaggtctcggctgactgcaacgtccgcctcccaggttcaagcgattctaactgcgtcagactccccagtagctgtgactacaggcaggcgccactacacctggctaatttttgtatttttagtagagatgggggctcaccatgttggtcaggctgaggcggaggaccctttgcaccactgcactccagcctgagcaacagagtgagacccagtctcagaacaaaaaaacagaaacaggagaaaaaccatccatataagcanagaggtacttaaaatgttgcaaaactaaattccaaataacgtctgtggattctacaaaatctaggaaatacacatttccaataaatctttgtacattcatctgtaatgcatttccttaggtgatttgagtcctttaggagtaaatctgtatctttagctgtcccagaagtaatcacaggcgttcattgtctattcaatgacaaagtattgtgaactattctatgaaataataaaatatcagtgttttcagagtacatggccttttcagtagccttttcagtgtggtggcacgtgttcccagttctgccagtggatattgttatctttgatctacaactgggaagctaaaacccagaaagttacttgtctaagactatacacctccaagaaggcagaactgtggctgctatttccaactttctagtctctgaacatgtaataaagaactgatttccaatttacaatgaataatagaatttacaatgaataatataatttactataatataacaaccg

SEQ ID NO: 502589 - DNA, 1256 bp, Homo sapiens
  misc_feature (489)..(489): n is a, c, g, or t
  misc_feature (582)..(582): n is a, c, g, or t
  misc_feature (946)..(946): n is a, c, g, or t
taccctttatctccgtatagtatattcgtttattagtgtacgctcttgccttatgcttcttgttgtccttatctctactcgctatgtcgtctcccaagaagttctatactgatattattctgtactctctgactcgactgcactagtgtctgacttgtgtttgatccacaagtagtgctgtgctactactacacttaagtacacttgtgtgctcacgatggattcaacagatgggatactcaggctaaacgtctcacacaggtacgtcaactctgtgcgcggacgaccgtagtcatggattttgtcgaccgcatcctactatgacatctcgttctcatattacagcacgaatttttgaattatctggtgctatcttctaccctgtacttgtacatctctatggtttaccccctttttacgttagacaatctcttgaatcaaaacaccagcttggttgctcgtaatcgagcagcggtgggctaccttacntacgcttgacatgtgacgtaacgtcaaaaccctgtgcaattcttagtcatgcatcattgtttgccagtactgacctgttgcatggtttctcgngagatcatgatcgttagtccattcgtctctggtttccctccttacatggtagtcatcgcacgttttgccatcgcacgccatttagatccgtgtccccctacttgaaactcttcgtgccgttatgcgtccagttgcttcacgacaaccttaatgtccgctgcagactgagttacacgtcttaacgctttcgctatatgccccatcataggatccgggattgattaaccatgaatgaatgtctaccccatatattagtatcgcaagaccccgtctctaaagcgctacatacgactactactcacgatcatgtgactataatcgcacacttacactatatacacacaacacatcgtcgttgatgatnatcacgcggtgcactgtctgaacaaccagtagtccggccatctggccagatatcttttactcaattgagcttgcagtgctatgggtcgatacctgacgtcacctgtttacataactggtgtgtcggtgtccaatacctccgttatatacacagctgtgttattagacaattatagatccaccatccatcatcgattacatgttgtcactgatacagtctagacgatacgaactgccgttgtggtccaatcaccaggcgctaacactacttggatgtgctacttcatatattcctcgtatcagcacgccat

SEQ ID NO: 502590 - DNA, 516 bp, Homo sapiens
  misc_feature (17)..(17): n is a, c, g, or t
  misc_feature (70)..(70): n is a, c, g, or t
  misc_feature (189)..(189): n is a, c, g, or t
acaaagaggagggaaanggagcaccgaacgtgtctagtctctagttcctgctgggaagatggagccgccngaatgtgtctagtccctagttcctgcgggaagatggaaccgccatcttgaacgtgtctagtccctagttctgccgggaagatggagccgccatcttgaacgtgtctagtccctagttcntgcccggaagatggagccgccatcttgaacgtgtctagtcgttagttcctcccgggaagatggagccgccatcttgaacgtgtctagtccctaggtcctcccgacattcacccgtacaagctcccagctggcttgtgtatgtctgcagctcgacttgacaggctgttcattgttagaaaatgacttggggctgcttttcgttaaggagaaaagctgccgggcgcagtggctcacacctgtcatcccagcacttttggaggctgaggcgggtggatcattaggtcaggggttcgagacgagcctgaccagtgaaaccgcgtctctact

SEQ ID NO: 502591 - DNA, 195 bp, Homo sapiens
cgtctccgtgtatgttgctgtgtaatttattttgctcaacaagataaattatccaaataaccagagtggaaattaatttacagtaactacatgccaccttaagtactatgctctattgcttaaatgtcacttagtgtgaactttattgtactgggtaatttaatttcttaaattaacttttcttcaaacactatc

SEQ ID NO: 502592 - DNA, 394 bp, Homo sapiens
ctagaggatccctgcattcccgggacgctccgtcctgccctttgctcctctcctatgccttcccagtgctggctccattttgaaccactccggacacgcaggggaagctagatcatccatgagataaatacggatgtacagaagcaatggattaacgaaggaggtcatgggcagtgtggcttctgagccagtttaggttcctggggatagcagacagtctactgcctacgatacagactgaaccttcctgctcactttctgtcctatctcttcctgcacccttataaaccatttgttagtagatcattatgacatcatctgctatggctccttcttttcaccggacttactccgggcctccgtatcactagctgttgccttttacatcctgcta

SEQ ID NO: 502593 - DNA, 171 bp, Homo sapiens
aacaagcctggttagctggggtgccaggcctccctcaggcagcaggcagggtggcatggcaattcaagggtgttcagtccatgttcagctatgtttccagtgtgctgagcatcagtcagtcagtggtctgtgtgtgctaggcagtttcaagtttgcagtagtcaggcaatg

SEQ ID NO: 502594 - DNA, 357 bp, Homo sapiens
  misc_feature (319)..(319): n is a, c, g, or t
tatattgtttattcaccataatttaatacagtaatgttatgccttttacctttttaaattcctatgccttcaattaaaagtgaattacaggctgggtgtggtgtcctcacacctgtagtccccagcactttgagaggcccaaaatgggaggacccacttgagccctaggagtttgagacccagcaagaccttatctctgctaaaaatttaaaaatattatctgagtgtggtggtgcatgtctgtagtcccagccacttgggaggttgaggttggaggattgctttagcccaggaactgcaaggctgcagtgagctgtgntcaaaccactgcactccagcctgggcaacagagcaaga

SEQ ID NO: 502595 - DNA, 350 bp, Homo sapiens
gaccagaatattgctttcagtctcccccaaaagaaaccagtacccaaagcagcactcctgatttcccccattcctaatctccactgctgccaactactaatctaacttactgtctctatggacttgcctattctggtcctttcttataaatggaacgacgcaacatgcagcccatggttttctggctgctttcactgagcataatattttcaagattcacccaggtggtaacacatatcagtgcttcattcctttttatggctgaataatactccatggcatggacagaccatatttgtcttatctgttcatcactgacagacatttgggttcgttccattttttggctg

SEQ ID NO: 502596 - DNA, 132 bp, Homo sapiens
gatcgctctggagatcaggattttaagaacacctgagcaacatagtgagatcctttctctaccacaataaagcacttagccaggcctgatggcatgcgtctgtagtcgtagctacttgggaggctgaagtgg

SEQ ID NO: 502597 - DNA, 349 bp, Homo sapiens
gacttcttttttttgccagtctcctttttatatcatacagctctgccataaacttctcagcgtctgccaacggtcacctcgccacactcgcaccaggttgtccgccgtagccagcaaacagagtctgcccatcagcagcccaggccagggacgtccactcggctcgttctgccctgctcctggtactgaccacttcttgcttcacctcatccacaatgatctttccctctaaatcccccatctcgctcgcggggcctgtggcgccacacacccactagcggttagggcctgcgcacacggcgttgaccacgtccccccatctaccgtgtacaggcgctcgccctcgttg

SEQ ID NO: 502598 - DNA, 594 bp, Homo sapiens
gctgggttctctgctcagagtatcataagactgaaatcaaggtgttttctgggctgaattcccacctggaaactctaagtaaaaaccctcttccaagctcattcttgttggcagaattcagttcattacagatgtagcactagaggtccctgtttccttgttggtgatcatctagggtccactcaaatcctagatgttcctgcattccctgccacatgccctcctccaccttccaaccagcagcagtgcttcaaatctctgacttcctccatctctgacttctaaacccagatttaaagagttcatgtgattgggtttgttggcccagataatctccctattaaagtcaacttgggactttacctctgcaaaatcccttttgccatataatgtaacaaaatcacagagtgatgtctcatcattttcacaggtccaaactcaaggggaggagattatataagtcattgggggtcattctagaattctgtctaccacaaggactctcagaaactatagaggaaattaagttgaaatttaagaagccaaagaaagaaagaaggaaagaaagaaagaaagagaaagaaagaaaggaag

SEQ ID NO: 502599 - DNA, 651 bp, Homo sapiens
  misc_feature (615)..(615): n is a, c, g, or t
catatcatcagagaaaatcatctcactaaaggaagacagggaggaaaaagaaggaaaacagaccacaaaaacccagaaaacaaataataaaatggcaggagtaaattcttaattaccaataataccactgaatataatggattcaactatttaatcaaaagtcatagagtggctagatgaattttaaaagcaaacccattgacttgtttcctacaagaaacacacttcccctataaagacacgtgtacactgaaaataaaaggatggaagaatatatcccatgtcaagggaaaccaaacaagagcaaaagttgctgcactgatatcagacaaaatatatttctagacaaaaactgtaacaagagacaaggtcgctatataatgataaaagggtcaatttagcaagaatatataacaattttaagtatatgtgcagtcaaccctggagcacccagatatatgaagcaaatattattagaggtaaagaaagagatagacactaatacaataatagctggagacttcaccccactttcagcattaggcaaatcttttagacagatattaacaaaaaaactcaatctgcactatagaccaaatggatctaatagatatntacaaaacttttcacccaatggctatggaatataaa

SEQ ID NO: 502600 - DNA, 1134 bp, Homo sapiens
  misc_feature (332)..(332): n is a, c, g, or t
gaaagcgaggaaggaagctcctgccccgtccgtaactgtctgatagccataggcgaaggctttaaaggccaggaaggcagatgttgaaaggtgtccgacagtccaccaacagacagaaggaagcatccggcacgtcaactccacgcttccggcggccgtaagacactgcgactccggagactagccgcaaattatcgctcgtgatggagcgcgtcccaggagaaacagagcttgaccacgtttgctactcattcatagttatccgactgatccactgatgtctgccattgaagaagatacgaaagacataacaacgacagcttgttgttcanttggtgggagtgttaacacgcctaagcgaagcaccaggattaatagcaggcctgtcgaagcaaggctgtgatgacgatgtgatgctggccgaaggtcaaacaaccctgattcgggcctgatgggagaggacgaaggcatatgttcgactggctcctgattaggatggctcttggatgttgccaacaaaattggggatcgatcgtaaagctggagtccagctgggctaattctgaatatatagtatatatatatcttttcgaccatggaaatagaaggcacctcaaatcttgcggggacccacaaggcggggaggcggaaacaggacgtaacctaatagtgggcgctgccccaaaccgggattcctagacccagattgctgtgcccacaggggaagactggagagatgccccataagtggggagctcgcaatacactattcgcaaataaacacgccaggtaaaaccgtgctataacgtgatcgttgcaacacacaccacacacagtagtgaacacacacaacaccccggtgtctgtgtgtcacacagcgaagcgcacataactcgacacaacacaagacactggacaaaacaagaaggaggggaacaaaaacaaccacacgacacacaaaaaaacacacaagagaagcacgaaaaaaaggacaccacgcaaccgcagagaaaaaaaagaaagaacacaaacgcacaaaaaacatacttaaagaagaacgaaaaacaaagaacaagaagagaaagcagaacgaacccacccaaagaagcaaaagcaaaaacaaaccatgtaaca

SEQ ID NO: 502601 - DNA, 467 bp, Homo sapiens
tacctcctcgtgctcgggggggtctaatatataaccggggcttttttttttgtggatacccttccatgtttccctcggattagaagcccctcattccccccctggctgtgtgtggcccccccactcattggttagtaccccccggcggtcgctcttttcacgcctctcgttcgcgggttctttttcctctggtgcccccgcgggtgcgcatggtaaatcactcttgttctcccacgggactacttctgtggcctctctgtgggccctcttttggggcgcactcttgagaaccctgtggtgccccaaaaacgcgcgtcgggtgctcgcgctgccccgtgatttcccgcgggtaatctttcactggggccccctcgataagaaaagccccgcttttcccaaagaaaaaagggtttttcccccgaccattttccccttgggggggttcccaaaaaaattttttcccccca

SEQ ID NO: 502602 - DNA, 540 bp, Homo sapiens
gcgggcgcagttgatcacgcctgtaatcccagcactttgggaggccaaggggggtggatcacgaggtcaggagatcgagaccatcctggctaacacggtgaaaccctgtctctactaaaaaaaacaaaaaaaattagctgggcgtgctagcgggcacctgtagtcccagctactcaggaggctgaggcaggagaatggcgtgaacccgggaggcggagtttgcagtgagccgagatcgcgccacgtgatttccagcctgggggacagagtgagactctgtgcctcaaaaggaaaaggaaaacaaagaaaaggggggtacacattggtttggctctacgtgacagttaataccacaactcagaggcattttttttccctttcaattcttcttctaaatgtccaacacttttctgatttggtgattggaggttgtagataagcttcctgaggctccattgagacggtatatacgtgacacttaacagtctagccttcctcggtgcatatagatatatgatgggggcatcgataaacaccggg

SEQ ID NO: 502603 - DNA, 154 bp, Homo sapiens
ttcacatccagtccaagtctcagcttcttaacccaagaaaagagacattgcagagtgagtcctcccaccttgggggctggccaggcggaccaagagcaagtgttgttggggcctgccagtacagaggagaatgggcatgtgttgtgtgatgccc

SEQ ID NO: 502604 - DNA, 512 bp, Homo sapiens
gagcaggaaaacgaaaggggcctgataccccccatctgtgcaggtcctcctgctttgttggctcataaataaggttttggaagtaaagttcaacacccctccttgctaaagacaaaatgatgaatggaggtcattcacctcttctgagaatcgtgtggaaaaagacggccttattcttacaaaccgggggcctgggaccagcttcgagtttgcgcttgcaattgttaaagccctgaatggcaaggaggtggcggctcaagtgaaggctccccttgtttttaaagactaaagcagcgaactgcgccgatcccttaaagaaacaggccgttaggaatccattctccctgtgttcgctttaaacaaaacagtggtaggttaatgtgttcaaaagtccctgtccttactacttttgcggaagtatggaagtcccaactacccaaagatttttcagcctacaaattgtgtttaaacatttttaacccttgtttgcagaataaacagggcctttagca

SEQ ID NO: 502605 - DNA, 304 bp, Homo sapiens
ggactacatacttccgaaataatgcactttcagttttcactttaaagacaccacaagccttttaaaagccctatgaggtaaaatttataaagggtggagaacacaagtttgtagaatccttcccaactcccacttccatcaaatctcaagaaatcctcctgctttaaaacataaacaatctcacaggatttttattggaccatattgcggaaaggaaaactgcattcctattctttttgatactaccagttttacggattttgtttccacttcttgtcaaaaaaacacgtatgttgctgatatg

SEQ ID NO: 502606 - DNA, 1167 bp, Homo sapiens
ggctgcccgggcagcggctggacaggctggcgcagcgcaagcgcctggggtgaccagcgtgacctcggccacccagtgccggcacccaaggtctccaaagctagccacgaccccctggtcacccaaatcatcccacacctcaccacaccaacgggatcagtgggagtccagagagcattcgccagacatccctggatggccaggtgggcaatgcaggcccagagggaagaccgactggagcgtgacgagaatgacaaagcacatgttggcaagatcacccgtcaacacgccgtgcgaccgacacacacagacatcccacaggtgcctggacgcaagcccacaacatgtgacccatgacttgcacgaccaaatggacttcagagtgcattgacaagcagcctggacaacggatgagaacagaggacatccggggagacccatccaccaatccacataggggaacccccacatcgacatgccctcatttttcacgatccatttccgagaaaccatcccacagcgacacattgaagggccatcaccatattggcaccccggacaagacaacgaaggcatcttgtacatagccaacaccccaaagggagacattccatgaagacccccaaagacacaccattccaacacagacagaggacccaccaaagagcgcacgactagcaggcaattagcaccaaacaaccaagagcatagcccacagatacgaacccaggacggtatccccaaaaaagtagggagcccacacacaaggagcccggatgcacccaccaagaacaaccccacgccccacgcaatatacagcggatgacagaggagcacaatccgagaaggccgagtggcagcaagggacacacaaggagatggccagaggacaacagagcccgcaacaagacgtactggcccagcgagagcaccagaacagaccaagaagccatgtgaaacaagcacccgaatccacaaacaccgggcgattgggacgagaagagacccacggcagggcccatgggccaacaggcggacacagcaggaaaagcggatcccgcgcaaagacgcacagcaagacacaccccaataacccaaggatacaacgaggggaacaacggagacccgatataacaacccaccacacacaaacgtaccgagatcaac

SEQ ID NO: 502607 - DNA, 850 bp, Homo sapiens
  misc_feature (584)..(584): n is a, c, g, or t
gtcatatgtatgtacagtgggataaccttggtcctcagggacagtgtgtgactctagtggtcttcctatccagtctcttgcctaatagatatctgggacctctactggctttaatgacaggaaataatgttatgttgaggttatgcttccttgtcatttgctgattgttcctactaagaatgtaggcatttcgagagttagatccatgcctttcagccattttgagaataattgtcagaaggaatgaaattatgcagaatgtggccaattatctcttgtatcaatctggtatcttttggcagaaccctcgatgtactataaacttgtgatacagttaaaagacaatatatagtagtagtagtatattcttgacatgcattaaaatagcagccctcgtcccagctaatcgtatgccatcttggtattggggaacgagaaattcccaaatatagcccattgtctgcgtgctggtgttcccccgatttgtatgggatcccggagttcccgtgagtgttcgtgtggtaaactgatattgtagaacaatcggacacacggagactgatatcacgactactgttctagangagctgagaacattagtggcgttgtaactactacgtgagactcctaacgttgaagactctccaaaagcaaaacagtttggttctaagatcatttatcgtgatgtacgataacacagggtagaagaaaccttgtagtgtctccacatacatgggccaatgtcgaattgccttgttggtttgccacccacttgggctatttcagtaatttacttggggacaattgcttatatttggaaccactaaacaaacaaaacacccaacccaaa

SEQ ID NO: 502608 - DNA, 388 bp, Homo sapiens
  misc_feature (12)..(12): n is a, c, g, or t
ttcttaatgagngctaaggatgacaggccctgtgtcactgttttctagcgcaatctctcttgagaacccaaaatcgtgggcagctggttcctgatgcaccaaggttttctctgggtgaaaaggaaagctcactcgtcctgggagagggcctcggatcgccaccaccgctgctgtcgtctccactaaagaaaccttctgtactttcttcccagttacatattttgtattgtattgttttgttttaaacagtaatttacttaaaaaaaaaaaaaacaaacaagctgttatgtactgggcgtggtggcacatgcctgtaagccagtcttggctatgtagtaagcatccgtgacattgcaacataataaagcaaaccccctgtgacaagttt

SEQ ID NO: 502609 - DNA, 324 bp, Homo sapiens
agtatttttctgagttaaaagcataactaaagttacttgtacgctttgctttctaatgcttttactgagtggtaaagatgagccacctatttttgtataatagccagatactattatactccgaatacaaatattgaaaaaatgacaggaaaacccctagatcaaacttggtcaatccatggcctctgggctgtatgtggccccaggatgactttgaatgcagcctaacacaaattcataaactttcttaaagcgttgtgagatatcataagggcaggtttaattctcttctattccccacaacagcaatcgaacgtgaaaggg

SEQ ID NO: 502610 - DNA, 119 bp, Homo sapiens
taaacctgatctattgatgtttgctgcactggctgtccaggatgaagtcattccttttcagcatgcaggtttcaatgggctggatttctggggcattcacatgtgctcaatttcaaccc

SEQ ID NO: 502611 - DNA, 271 bp, Homo sapiens
ggtacggcagctatccggttcactcacacctaggcattgtgcgatgacatcattgtgtcggttctgatccgatcacagtatctgtaaagatcatcttgcaggcatacagcataaactagagagctgcaccatgttctttctaggcctttcataaatagctttagcatcctcagcacttttgtccttaaaaatcaagaagctcctggaagacttctggatataccaggcttgtaccaaattgaaccggatagcttgcggggtaccgagctcg

SEQ ID NO: 502612 - DNA, 419 bp, Homo sapiens
  misc_feature (31)..(31): n is a, c, g, or t
  misc_feature (114)..(114): n is a, c, g, or t
gaaagcaagcaggtttgagaccctggcagancaggggagtggttctctctggtccatttccctctaagaccctggaaactgctgctgtgtccctttcagtgctgggcctagagnctgccacaagttgcagatgtggggtcttgggaagtagatacgttcatcttagtatctctcaatgacaatgtccactgattgactggaaacgtttggaaaaacacaaaaacaagttggaaggaaattacttctgttgttcaggccacacccttgtcccttcttcagtctctaccaacaagcgttttgccttatgggtgcagctcaccggcagctgcctcattcatttcccaggttctaagagctttctatgggggcgggtacctcggtgcgcattagggaatgaggacgaagctaaaattggacct

SEQ ID NO: 502613 - DNA, 214 bp, Homo sapiens
  misc_feature (146)..(146): n is a, c, g, or t
  misc_feature (185)..(185): n is a, c, g, or t
  misc_feature (205)..(205): n is a, c, g, or t
tttttcttattatgaactatattttcctgactctttgcatgtgtagttccttttgatttcaagaagtcagcatcttgagcaatgaaaaattatttcaacaaaattttaaatttgtttaagaggtgcatattctccagagcagtggncctcaacctttttggcataatgggaccagtgtcatgaanaacaatttttccacagactnaggcaggaa

SEQ ID NO: 502614 - DNA, 616 bp, Homo sapiens
ggttggctgggctaatcaagatgtggaggtaacaaaaaacattgtctacgaagtcacctgccaatacacaatatttcccttggtttcagagcagatagggcaactgaaaacatctcctatcttgtgctgccacataggaaatccacacttgggcaaactgatgtacaggggcattttacagcacccattgtgcaatgcagagtctctgggtaaaggacagtggttccttctggaagacacatcatatttttgcgtcagagtgaacattcaatttactgcagatggatcatagtggtgttctgatgccatgcctaagctgggcatactgccataccacaagttcattccagcaatgtactgagataactgctcttcttagtctcaagtctccttggagacagtccaggtaggttttccctactttctaacagctcttggctatctccttctggactctgcagttcatttccagattccccactctcctgacaatgctcctctttgattcaccctgaaccctgtggaaaagaacaaggaatccaggcccttcttcaagcctagtgtctgatgtacagacggtgggcatccaacagcacccacacttgacttaattttt

SEQ ID NO: 502615 - DNA, 812 bp, Homo sapiens
  misc_feature (418)..(418): n is a, c, g, or t
gcggtcagactcccaggtccccgggtgccggccaagagggcctactcaagctcttccagatcggtaaatcaaccgagcgagaccccggtccacccgggacgcgcgcggcctgtcagctggccaagtcaaagagccgcggcaggttgctagcgaccgtcacagcaatagtctcgatgggccggctgattgcagcggttgcaacaagtagccggagcatctcgccgtcgatcacgggtcgacagacaccaggactcgtgtagggacgtgtggtcgcgaaccgaagggcccgctgcctagtggcatgtggagcttgcccaagtgtctagctgatacgctccatctgttgatgacttggcctatgtgtactcgtggacggcccgagagcgaagctggctgtgacagcctcttgggaacgccntctctcacgcgtgacgctctcgttgcgttggcgtccatccatgcgcctatctttccatcatgcaagagggcattatagtagttcattcgaaggcatcggggctctcatcattcattgtggtaggacccacaagagttgtcaattgcacatgtgcagacttcagactagccaagtggcgtgaagagctttgggacttgacacacaacggctacgacctagctacgggcgaacgagaacatgttcttgtggtgccccaaggcttcgctgcttgggttacctttgggggaaccccaatgttgccttccgttgaaggtgctgccatatcctagaacggacaatggaatcttgcaatgcgcccaggatttttggagggggtggaagactataaggataa

SEQ ID NO: 502616 - DNA, 317 bp, Homo sapiens
  misc_feature (1)..(2): n is a, c, g, or t
nnttgactgattgctgttgcagaggtttcgcacacagactctttgaggtcaagatggttgatatccaatatttttaggcgggccaaacatacagagaaggcaagatacactagaaatttaaatggacattacttgctatcaaattctacgtgacacaagacatgtcactcccatggccagaaagcctaaattgggaaacagttgttagcaaaccctttcaaccatctaaacgaaaacacacaatttgaaaatgcacagaatgttttgctgcgttaaagcgcatggagactcttgctccaatttaaggggggggcccc

SEQ ID NO: 502617 - DNA, 646 bp, Homo sapiens
  misc_feature (100)..(100): n is a, c, g, or t
  misc_feature (125)..(127): n is a, c, g, or t
  misc_feature (135)..(135): n is a, c, g, or t
  misc_feature (141)..(141): n is a, c, g, or t
  misc_feature (143)..(143): n is a, c, g, or t
  misc_feature (146)..(146): n is a, c, g, or t
  misc_feature (160)..(160): n is a, c, g, or t
  misc_feature (162)..(162): n is a, c, g, or t
  misc_feature (164)..(164): n is a, c, g, or t
  misc_feature (166)..(166): n is a, c, g, or t
  misc_feature (179)..(179): n is a, c, g, or t
  misc_feature (187)..(188): n is a, c, g, or t
  misc_feature (212)..(214): n is a, c, g, or t
  misc_feature (219)..(219): n is a, c, g, or t
  misc_feature (222)..(222): n is a, c, g, or t
  misc_feature (225)..(225): n is a, c, g, or t
  misc_feature (233)..(233): n is a, c, g, or t
  misc_feature (237)..(237): n is a, c, g, or t
  misc_feature (357)..(357): n is a, c, g, or t
cgccgcgggcatttcttccactgcccgtctgagggaacgctaagtagtgtgtccggcgccgtgttccagctccgcgttgttccgcgagaaagcgagaggncgagcccgggctggtgcgatggccnnngtggtggncaagcngnaanggccgccgttcatnancnangcggccgtgcggncaacgccnncgtcctggattattgccggacctnnntgtcngcnctntcgggggncacngccggcatcctcggcctcaccggcctctacggcttcatcttctacctgctcgcctccgtcctgctctccctgctcctcattctcaaggcgggaaggaggtggaacaaatatttcaaatcncggagagcctgtaatatttgttccaccccctgctcctcattctcaaggcgggaaggaggtggaacaaatatttcaaatcacggagacctctctttacaggaggcctcatcgggggcctcttcacctacgtcctgttctggacgttcctctacggcatggtgcacgtctactgaaatgggggcccgggggacttttttaaaaaaccagatcgggaggactgtggccagcaattaacaccatgtagacttccttcttaagtggttgaattcgctgctgtcctgtacgttaa

SEQ ID NO: 502618 - DNA, 124 bp, Homo sapiens
agtgtcctgggctgtgcatgggtggtgaatcaatgtccatggcgcacatgttctccaggaatgtgtcagccatggttgcgtgcagacacgatgggtctagaatgaaggcagtcccgggttcact

SEQ ID NO: 502619 - DNA, 846 bp, Homo sapiens
  misc_feature (176)..(176): n is a, c, g, or t
  misc_feature (178)..(178): n is a, c, g, or t
actgggctgaagttgaaatacgaatgcattcatcagtcaatcaattaaaaccctagcactcaaatgctcattgcatgtgggcattctcacaggcaccaggcaggccacagttttgtttggtctcacctcagtacctgagccattcagggaagagagaacaagagcaacgtgagcananatatcccgacctcaaactgtgcactggatttgctttctggtttttaagaatgagccttaatgtacctaaaaagggccttgaatggtcagagatttggtcttagtacaatgtctgcactaattcagaactccagaaaaggccctcctctctacatcctttactctgtaactcgaccttcagtcttttcataaatccttattcctaaatgggaggaaccatcttatctctgggagaaactgagcaataagaagcatgaacttgctcacctgtcctcatcttacggcccctttcctggtctactatccatccatgctaacctcatcttttgtcctatgctggcctcataaagatggagcttacactttggagaagagaagagctcggaaacagttagtaagctatttaaaagtgagcagaggagtcagaagtgatgagtaaaaaataatttacacatttctcagtctggatgatttcaagaattgtgggaccatttaaagagacaggggagctggaaggacaggagtccatcagtggtcaaaagaggactcctgtgggtaaatgtggttcacaacaagaaataagatacctggaagggcaaatcagaagccacagaaataatgtgatcaaaataatattaaggaatactgaccttcagggatcaggaagga

SEQ ID NO: 502620 - DNA, 1618 bp, Homo sapiens
  misc_feature (1571)..(1571): n is a, c, g, or t
accccgtctggtatgccgggcgggacccaggcagctgcgtccagccaccggcaacaagaagacccacctgacggagctgcagcgcctcctggacacgggcttcgacctggcacgatcttcaagaacttcgtcgtagatgctgcctagggttgcattgaggccacttgccgctctcgcacaccgcatgacatgccgccttgcttctcgaactaaagaatagtgcctcagcgcgtgcccgacagctcaccgcgcgcatccatcgtcctgtgcaacaacaaccgctcacctcgtgcgtcgttcatatgcgagttaagggctgatcggatccgcgcccatccgatgtgccattggcgtagctgcggataggggccattgcggcgtggccacaaggcttcttgcctggagattctggagacatcattttgtccctaggagggactcggggggcgtagccagcgcagggaagtgcatacgggtacgcaccccacgcaaggcgaatgtcccttgcggcgaagcggtgctcatgcttctgtgctccacacaaacgcattccacacacaagtgcttcaaacccatcggtagggaattgagggcaaacatgggaggcgcatgtgctgatggcgttggctttcgcagtcatgattcaacgacaagtcgaagagtcgacaagggcgtccttggacaattttgacggacttattggaataagcttatcctagacgtttcaagtcctgtacgcgttttcacgaatttcctggtaaagaacgacgcacgcccatagaggactgttccgaggactcactattgtccccacttgcggcccttggtgaacaagaacggggattcccgatacaggagcagataggagagatcccccaatgaggccggtcgcgcatagctcgcaacacatttgaccgtgcatttgaacccccggggtggctgcacgaacatagcgcgaaagataggaaaaagcctttgtgcccatatggacccctatggctcaccaccaaaacgcggggcaccagctcacacaagaactaacataagcacgcgttggcaccaagatgaaaatcaaggggtggagaacacatatcaaagcggagtacacaagaggcgattgctgtaagttgacggacccacaataagacatatgaaccacacacagcacaaagcacacacatatggagcaccacatagcacgaagagcctcgagcagccacaaaagacaaacctatcgacagtgcgaaaccaagcaagaagacccacggaaccaggccaggaacccacgcggaactgggcaagagcgcagactacacggcggtgagctagctaaacagccaacgcacgcgcagcggagcatgaagcacccaccccagcccacgacacaagccgctagtgcaaccaacacaagagagcgaaccatagggaccagatcatagagagccacacagcagcaagaacagacgaggtaccagctagagcgcagacaccacgaccgagccacgtgagagcagacagcaaagacagataagggcagagcacgataggcaaaatgcacaccgaatcgcganacaacaatacatagctgcactcccagcaacagactaggtagctagac

SEQ ID NO: 502621 - DNA, 737 bp, Homo sapiens
  misc_feature (350)..(350): n is a, c, g, or t
  misc_feature (375)..(375): n is a, c, g, or t
  misc_feature (438)..(438): n is a, c, g, or t
  misc_feature (634)..(634): n is a, c, g, or t
  misc_feature (636)..(636): n is a, c, g, or t
gattacaggcgtgagccaccggtgcccggcctcgcagatttctttatcaaatgatgttatcagttctgcagttcatgcaaaagactgaaacatcttataatttatacgtggcctaaaaactattcttcttaaattaggtattgatttcaaaacatgccagcttttttgattgcggattagttaatataagaatttttttaaccattgtaatttactacctaagtgatttcattcagtctgtttgcttcagataaacctgtacgatcaatgactctcaaatctttatttctaggtccagcctctacctttagctccagacttgtatatccaactgccagtaccatatatantttgggtatttactaggtatctcanatttaccacatgctcagtaaatgataactcagtaaatgatttatccagttgttcacaacaaanaccttggggtcattcttcacttctttctcttgtaccctaaattcaatgttttaattagtcctataaactctgtcttcaaagtacattatgaatctgaccacttagcctcaccttccccagactacctgagtcaaagccaacattatttcttacatgagagactggattagacttaccaactctctcttggttctgngnttcttcacaccattatgggggatttactgatctacaccggtttaggtagttgctggctaaatttctatgaatccattcatttcaactcggtttacatgctt

SEQ ID NO: 502622 - DNA, 654 bp, Homo sapiens
  misc_feature (350)..(350): n is a, c, g, or t
  misc_feature (375)..(375): n is a, c, g, or t
  misc_feature (621)..(621): n is a, c, g, or t
gattacaggcgtgagccaccggtgcccggcctcgcagatttctttatcaaatgatgttatcagttctgcagttcatgcaaaagactgaaacatcttataatttatacgtggcctaaaaactattcttcttaaattaggtattgatttcaaaacatgccagcttttttgattgcggattagttaatataagaatttttttaaccattgtaatttactacctaagtgatttcattcagtctgtttgcttcagataaacctgtacgatcaatgactctcaaatctttatttctaggtccagcctctacctttagctccagacttgtatatccaactgccagtaccatatatantttgggtatttactaggtatctcanatttaccacatgttgaacttgtgatttttcttctacaaccatgttcctctggtgtttctcatctcagtaaatgataactcagtaaatgatttatccagttgttcacaacaattaggactattaactgtgagtagtaagagcatatgtgaaagtagccactagaggatgcctagaagaagctcactgggaggggcccatagttgagtatcataggaggctgagtagagctagccagtaggaggagtnagagaggagaggagagagagagtaggagaggga

SEQ ID NO: 502623 - DNA, 217 bp, Homo sapiens
ttcatcgtcaagccaattagacaattctgttactgatagtttaggactttcagtttcattagcaactttcaagatgtcaagcaatgctgtaatatcgttagtgttcttcaattgtgccaatttaatagctgatccaacgccgaacgggataccatcctgctttaccgttaccaccttatccattcccttaacaaaccgaattgaaaactggatttat

SEQ ID NO: 502624 - DNA, 1662 bp, Homo sapiens
  misc_feature (705)..(705): n is a, c, g, or t
gtggtgtgtggactggctggcgtgtgtgtcggtggtgctggcttcgtgttctgtttgttgtgtgtagtcgtcgcttcttgctgtgtgtgcgttgatctcgttgccgtctggattttatctttggtgtgtgctcgtgtcgctagtgtgtggctggtctcgtcgtctcgtcgttcgtaggtgcggtgctctggattcggtgggttcgttgttgtttggctgcttctgatgtgttgtctcttgcgtcgtctggcgtgcgggggtggttaatagagcaggtctcttcttgtgggccgccgcctcgctgttttcctgccgggggaagccccttcttcgccgcgcgggtttgttgcccctccccatgaggagtccccccgcggcgctagtgttccttcccctccttcgcagcgattgtttatcgcctatttgctcgccggggcaccggagtgatccctcctgtttgttcgcacgccgggggtacccgctcgtttgttgcgccactctttgcgcccctctttttttggggggccccgcgcctatttgtgagccaacgcggtgggttcgacacgaaaacgtccgccgccgcggtgtgggtagcactccgggtctctccggggtaatttctccccccccggggctttatttctcgttctggtgcggcccttcgacggcggtggtttcccccgcgtggcagggaggatggttccngctgtttgctcccccatggagggcgccacgtgtgtggcgccgcccgcgccaacacccaccgattggtggggcagtttattttcttgagtgaacacctgttttgactgtcggggcgggcggactcggaacccgccatcgcgggggtggtggttagtagacacacaacgcgagtgtgtccccccttttaagtagtgttccccgccagcgggcacatatggggttcctacaccgacggttgcttccccttggagagagataaaaatattgtggcgcgcccacacatctgtgttttcttaaaaacaaagagcgcgcacacaatggccgggatatcttcacatgctccctatacacacatttgtgtgagacatattattttcgcggcgttcttatgttgttgtttgtttggaagacacccatcttttgcgtggtttattgtcgccccgagctgtggagatgttgggtcgggcgcaccacataccaccagcgctctctattgcgcatctcttcgcagatccacacccaggcgccttatagcccacatctcttctcccaccccttgttaactgtggacatctccacgcgtctaccagcgcacacacccctggcgtataaatattttttatttgcttgaggccgcgcattttcttatagttgcccccgggcgtggtcttctcaggcgtccttgggcgtccacggatggtctcttctcttgcctcacgctttccacaagggcaccacgggcccagattgtgagctcttgtccctctgccacttcatagccccacaccagaggtgttctataacctcttttaatagaattgaatctttcataaaatatggttttagttggtgggccagtttctttaagctgggaattgtacaattcctcctgtaaagttttttcaacccgttaccctgccactctatactaccataaaggatggttttgggtgtcca

SEQ ID NO: 502625 - DNA, 983 bp, Homo sapiens
gcgccttggtggtccatgagaatgtcatcagttgtccccatctgggtgcgagctgcatggaggttcagagacgtgtgtggggaggaaatgctgtgcagtacgtgtacatggtgtaggtgagaaatcctctgcatcgaggtgtttgtagattcgccctacggtccctttgcactggtgtcctatcattttccagacatccagagtccttggatggtggctagtgcgaggagagctctgaggagtggacatgatgcggagcctgggtatgggtcccccagaagggaaccatccaaggtggattcacgacgggggaaggatccccggacctgatgctgatacactgcctaaagcctggagattgttgtcgttctcggacctgaaaggaaggctctccatggcaagtcgggtatggtggactggtgcgtaacagcgtgaagcttgtgtgtggaaggaggttgccttcaagttgtgaccgagacttctcttaagcttgctgcaatgcatgggtgagtccagcggttgccgcgggagtgcgtccatgacggtgggccatgtggggcagcccttttcaccagggctgtgggcttttggaccagaaggcacgtaccccctggttcttgcgggcggtccaatggtgctgtttcaggaccagaggtgcctctcggcagggggcgtgccttggtccttattcgggactatgtccttgagccttgagtttgttgctaacatgattgctccttgggtgaggcgggtggggtgtggctgactcaccaggattcagggtgcagaggggaactggacgctggagttcctgctgtgggcaggtgaaggtgaaagtggcactgacctcaagtcatatattggccacgaccgctgggtttgagaaccccttgacagggaaacccttggtggggccgaatgtacggaaacggagaagttgaggccaaaaaaaaagtgggcgaatatgggaataggtattcaac

SEQ ID NO: 502626 - DNA, 1457 bp, Homo sapiens
  misc_feature (720)..(720): n is a, c, g, or t
  misc_feature (915)..(915): n is a, c, g, or t
ggtcgaagcgaggacgtggtgggtcctctggtgcgagaattccggatttgccttgggtgcttccggtaggagcggtaatcaattgtagctgagcaagcacaggaatgacctaacaatatccatgtttactatcatactccgtggaatgggtgatcacagggacggctcgaacgatggagccgttcccgaatgactgggtgtgtggcgtgaccatggtgcatggcgcatcacggtcataggaaccgtgtcagaagccgagaggctcgaggagaagacataggtgacgatccagacacgtggatcgatgcgacacaagggacaagtgataggcgtacgagaaagatcggacgtcggtttcttgtgattattgaaggattaacttgcatgggagtcgagtagatgtagatgagagtaaaagggcgtagcatccaaaagggttgcttgctcatctagcaggagaccagtagactagattggatggtgtgccacggacttggtgggggcccccgggatgttcgcagtcgcataggggcgtcgagctagcacactcaggctagttgaattctttcccatgataggtaatgtccgcaaagaaaacaattatagagatacaatcagagggtacacagcacccaaaggaaccatacacatttatattacaccaagaggcaatgttacaggaggagaaggtcaatccacaagttacacgcagagttcctncgcgaaaggagaagccagcccgagtatttggagagaaaattccggtggcaagcattggagtgtgataggacaaagggcggtggaatttccaccacgtaagcatagggcgaaaaggaactaacatctggttcgggcggcaagccccacaggcgcgggggataagcacctactctggccgtgggggtttgtataacnccaattggattaccgaagaggcaagttcgtgtccgccactcacattttccttcgcgtattatagggggaggccagtgggtatacaaatcctccatggcaatatgtatggtgcacgccacacagcaggaacatagggacacagacaaattcctatacagaaaggcccctgatacaactttcggcgctttggaactcagttccactccaggcaagcggaaacaatcatccctggccagttagcgtcagctagtatccccatggtgaaacgggggctggattccacgaaaaatgggtttgtgggcccacaggagaggtaacctgagctctggaccaggcaaatagggggcttaacgcccagaaggctggggtatggcacaatccaggggtagacgcccccaaattgtgctaattacatttcaagcagcggggttacacaaaaagcggaagtgtaccgtgtgaacccttggctcactggtagagagagagaacagaggacttctcacacccctttccaccaacgtgtgccttggacaacagtcggg

SEQ ID NO: 502627 - DNA, 257 bp, Homo sapiens
cgaacatgttgaataagtccgggcgacattaggccttgccgcgcttctcgcggaacccttcgcgaccaaagaaggctccacactgtgcacagaagaagtgttcagggcgccacgtcctgtcaagggctggcaccactttatccaggatggggccgcagcagtagtagcagcgctggagagaagaggttgtggtagacctttttacagtagggctggccatcccgctcgaagaagtgccggaatccgatctcctcctg

SEQ ID NO: 502628 - DNA, 166 bp, Homo sapiens
acaggcaagcggcgcccgtaaaaaacagcaatagtaggcacacacaataacaaaataagcatctagtaaaaagtaaaactagactagttccactaagatacagagcctagctatgatacacacgccacatagtaccaaaactagaaggtagccgcacactagataa

SEQ ID NO: 502629 - DNA, 619 bp, Homo sapiens
  misc_feature (29)..(29): n is a, c, g, or t
  misc_feature (71)..(71): n is a, c, g, or t
  misc_feature (99)..(99): n is a, c, g, or t
  misc_feature (101)..(101): n is a, c, g, or t
  misc_feature (117)..(117): n is a, c, g, or t
  misc_feature (144)..(144): n is a, c, g, or t
  misc_feature (178)..(178): n is a, c, g, or t
  misc_feature (187)..(187): n is a, c, g, or t
  misc_feature (204)..(204): n is a, c, g, or t
  misc_feature (207)..(207): n is a, c, g, or t
  misc_feature (226)..(226): n is a, c, g, or t
  misc_feature (230)..(231): n is a, c, g, or t
  misc_feature (240)..(240): n is a, c, g, or t
  misc_feature (263)..(263): n is a, c, g, or t
  misc_feature (272)..(272): n is a, c, g, or t
  misc_feature (281)..(282): n is a, c, g, or t
  misc_feature (286)..(286): n is a, c, g, or t
  misc_feature (301)..(301): n is a, c, g, or t
  misc_feature (331)..(331): n is a, c, g, or t
  misc_feature (426)..(426): n is a, c, g, or t
tcccttgactttgacttctctatctagcncagcttctttctcaccctaaatgtatcccagtacacttagantttcccacatttgttcataatcattctntnacaaacttcatatttntataatcgaggcctgtaatatatcatntaaataattgaaaattgaacattatgttgaaatngcaaccatntcacaccattgaaaagnccnaatatatcagaagcagagnactnnctgaacatnacaccgaatcacatgaatggatnactaggccntgaggggannccgncccttagaaaaatgnagagtatatatatcttcagggctgtgaatnccatactagttatcaatattttaagatcattctgtatatacatattttaaattatgcaagcaaactaggaggagaatgtgcaattttgagggatncctaatttgcattcggttaggggatatttttcaacctcttgctttatactctgatatggggtgtgtttatgaacttgttaatgttatttaatcatgcagatttccaatcagtgtattgctcatttactgacaaaaagggaaaattcgaaacacagaaagggaaaataaactgacttttataatgaaaaaaaaa

SEQ ID NO: 502630 - DNA, 232 bp, Homo sapiens
gacgcaagtgtagaaaactgatcaaaggtacaagctgcttttgttgcacgccaggcagcagaggtaaaatggtgtggctcacaagactagggtcttgaggaaggatctgaggggctcaagaagtagggaaaggatgaatcctggctagtgccagtgcctcgcaggctgaagttgaaatttgaaatctgcagcataaggttccagcacctgaagggaacagctggtgaaaagc

SEQ ID NO: 502631 - DNA, 307 bp, Homo sapiens
tagaagatgtgtaatctaggtaactcggcctttggcgtatcggtgtaaattctcactagtatacagatagtcccatgatctgggtccaataggtcatccaaattccagcggtgatcgccagagatgggtacacagtgaggcaccttatagatgatatccaattcctcaatggagtatttggtcaatctttatttatcccatagatgcaggggatatcagagcgtctgtgagccttccaccacatcactaaggtcatcatctgtcccggcaatacgtagagtcacatcggcataatgaatctagtata

SEQ ID NO: 502632 - DNA, 461 bp, Homo sapiens
gatgatacggccaatgaatacatgaccgtgaaacgcggggcctcacgctccttcatgacctttgagcgtttgaagcaggaggtgtcagagacagtaaccataggcataagtataattgtgtcgtgcaagcgtacatagcgacgctcacctttcgatcgatccatctcggttcgttcctactcaattgtgaatgcagaatacatccaagccgtggagtgtgccccactaattagggaacgtgatgctgtgggtgatagcgcgcgctgagacacagtgtaatttaaccctatgtgttgattgttgttggtggcccatgggttaattcctgctcagtacgagaggaaccgcaggttcagacatttggtgtatgtgcttggctgaggagccaatggggcgaagctaccatctgtgggattatgactgaacgcctctaagtcagaatcccggccaggtgggctacg

SEQ ID NO: 502633 - DNA, 269 bp, Homo sapiens
  misc_feature (204)..(204): n is a, c, g, or t
  misc_feature (242)..(242): n is a, c, g, or t
gtacttcaaagctcatgtttttttttaatgttttatttttattttttacagagatgagttctcactgtgtttttttttttggccgttgaacacccggactcaatcagtcctcccgtctgttcctcccaaagtgctgagattaccggcatgagctgccacgccttgatggaggctgagactttttggaatccctccctctctccntgctcctgccggatccgaagtaccgttttccctcttanaccatgtgcgtgggtccctcgccctgt

SEQ ID NO: 502634 - DNA, 740 bp, Homo sapiens
ggccacacttgaagaggctgagggaggcggtgtcgccgccgcggcgctgtcatggagctagcgcaggaagcgcgggaactgggttgctgggcggtcgaagagatgggggtgcccgtggcggcccgggccccggaatcgacgctgcgcaggctgtgtctgggccagggggctgacatctgggcctacatcttgcagcatgtgcacagtcagaggactgtcaagaagatccggggaaacctactctggtatggccaccaggacagtccacaggtccgtcggaagttagagctgggaaagctggctggtggaacccggcctggggggccaaaaattccagggaatctcggaccaagagccgtgaaacgcgtagagtgagagcagaagacatcgtgagcgctcagagacagcgggccagtggacgcaggcagcgtagcacactacaagacacccaagcgtcgagctctcctcctccgggcccaagctggggccatgcgaagacagcagcatacgctccgagatcccatgcagcggctgcagaatcaactgaggcgcctgcaggacatggagaggaaagccaaagtagatgtgacctttggatccctcacgtcggcagctctgggcctggagcccgtggtcctgcgtgatgtccgaacatgctgcaccctccgggcccagttcctgcagaacctcctgcttccccaggccaagaggggcagactcccaaaccctcatgatgacca

SEQ ID NO: 502635 - DNA, 265 bp, Homo sapiens
aagtagtcgtaatttgtataattaattattttttagtttatatttaataatgtacaaacatatgatgtgacatgaagtaaactttaggggaggaaccaaacaaaatacaccgaaacaacaagtaaacaaacaggtgagcagatctcttctctcctgtcaaagcagcaggctctcatcatgcatgcatccgtgcgtgtacatgcgtatgtatggccgttggccgcccggagcgagctgcggcggcatgcctagtcgcagcacatct

SEQ ID NO: 502636 - DNA, 174 bp, Homo sapiens
gcggcagagacccagtcaccctgaatctcctacctgaagctgcccaagccttatatcaccatcaacaacttcaacgccagggagaatagggatgtcttaaacttcacctgtgaacctcagagtgagacctacacctacatggggtggctacatggtcagagcctcccggtcagt

SEQ ID NO: 502637 - DNA, 548 bp, Homo sapiens
  misc_feature (168)..(168): n is a, c, g, or t
atggagaccaggctgagggaagggtgcgcagaagatgaggggcagcatcagtgcagctggcagcagaaccaaattctgcaggccaggacagtggctcccctttctctggggaaaaagggagggctgtgtctggccaggctgaggttccagatctgttgccatcatggncccttcagggtcctgggaaattcctggcttctcctaaatcagggtgaactgggcctccaggatcaggtctggagcaggcccaaatatagtcctggatctgcctggattaggtgccaatgtctgagtctgggttccagatcaactccagaccccaggctggatctggccccatttgagttctgtttccccttggagctgggctctgggccctgggccagcatctatccttgtgtagcatctgtcctgagctcagactgggtctccctgcatagttagtgttctttgttgggccaccagggtggggctgttcagagctgccaggtcttaaatccccccgttccacgttctcagactggggctccctgggtacagagctcgta

SEQ ID NO: 502638 - DNA, 351 bp, Homo sapiens
agagaatataaagatacaccatcttgcctgatcacagtccaagatgatcagtgatagacaggtcatctgtgtcttcaatgtggcacctccaccatgttacatgaattgtggatatttcatccaacacaggaccatgttacttctggggtaggctcacccgtgaaagcacaggctactgttagaactttgccttcatcaatgctgatatcagatggaagagcttcaattttaggcggaatacctcttatgcctgcttaaagcattttactagttgagctttccagtagtgtcatattagatattcccataaagctgctggaactcattgcaacacggtctctcagggtaccg

SEQ ID NO: 502639 - DNA, 366 bp, Homo sapiens
  misc_feature (173)..(173): n is a, c, g, or t
gtcgacctcggtggcaagccgttaccgtctattcccggcgggctgtccagcgacccgtggctgtaccgcgccagtgaagtgttgctgcaaacactggattgcccgattgatccgttgcaggaacaggacgcaatgtttgacctggcccaggcgctgaacaatgcctcgggatncacggtcaatcgcaagactttcgactaccgcgccgccgaacgcgcgcggaactttatccacagcgccttgggccggccgatcaccctcgatgaaatggcggagtacgcaaaccgcgaccgctgggcgttgtcgcggaattttcggttgttgttcgggaccagcccctatcgctacctgaccatgcgccgcctg

SEQ ID NO: 502640 - DNA, 459 bp, Homo sapiens
  misc_feature (15)..(15): n is a, c, g, or t
  misc_feature (67)..(67): n is a, c, g, or t
  misc_feature (70)..(71): n is a, c, g, or t
aattccccatggatnggaagcaaataagatatgatgactaaatgtgacctaatattccggattgcanccnngaactgaaaaggccattaatgggaaaactggtgagcctacattatacaaaataacctgatccagtgcctccttcaaggtgtccaagattatccaaagacataaaagaatggatgaactgccatagattggaggagacaatgcaatgtgaaatcctgaatttgaccctgaacagaaaatgcaatgtagtggagaaactggtaaaatgcagataaaatctagtttagttaatcatattgtaccaaagttcatttcttagttttgataactctgatggttataaaagatgttgacatgaagaatgctggatgaagtgtgtgcagcaactgtttgctgtttttgcaacttttctgtaattttaaaattatttcaaaataaacttttaaagaa

SEQ ID NO: 502641 - DNA, 160 bp, Homo sapiens
tgtttcatcatatatttcgtcaacagaaaccagtaactgatggtgatagtgattacagccagcctttatcttcattttctccaactgacttctctagacagttattcggtgagggaacagctgccgttgggcttccctgtgcacgagttgcattaataaa

SEQ ID NO: 502642 - DNA, 1463 bp, Homo sapiens
agcggaggatccgggattacttctgtcttcaggggtagagtacaggcttgccggtgggggatggaagaatgggatatgctgaattaagccccttgtgatgaccagttcactgtggtgacgctgtgatgcccgtggttcgtgacctccaagcgtggctcaataagagtccactctacatgccccgcgtacgcgcataggcatagactcattcgtctggtcgcgatccgtgctgggcaggcacaaccgaaactgcttgagagaagctatgaggaaacctacgagagatggcggagctcgagcattgagagcctctgatgtcgggtgatctacagtggcacttataaaatagaataaaatgctaaaagagtatgctggtaccacggtggcaaggttgatttctgatcatatcatgggcatcgtaatgcattccttacccagaactacttgcgtacggggaatgcatgtttggtcaccaaacggacaacaattcaagtgttgtacccacgttaatcttaaatcttgccagatggggacttgggtcccttcttgaagttccctccacaaaggctattgtctgaaaagaagccatggccacacatacatcaccccttcgttctctctgtgactctaatgtatacaacttgttgtgatttgatccactcactggagagacattgttgtcggttctccaagtaaagggtatgtgctcgacttgcattgcaaagaagagggcgacgggaaggcacaagggagagtggaaggaaagggagtagcaaacgtagtagagattgcggtgtacgaatatttagctgtttgactcttgctcgcataatggtatcttctggggaagtaatttccacagacatcggggttccgtgaacacattggcaacatactctcaggtttggtggaactatgaacctcccagggggggagctagcggagaaaaaggctttgcccttttgggaacactctcgagaggtccctgatggcgctctattcagagtgttgtcaaggagttggggcatcaggtggccagtggggcactaaacttccatgccatgtcctctacaggttcaaccacctacttgagcgaatgagggacacgtctgggaccgagtggctcccctcacaggaccaagaaagggcagtgagggcctaccgttgtcttgaccgacctttgagggttggtggggtctcaaagaataggaagtggttcgtctaggtacgacaacaacggagagagcagatgtcatatcctttgtaagaacagtgggcgattttgtgagggagcacatctaacagccagataaggaatgcgtcgcgaggcgttgcaagtagttccatgtagcatcaaactacaacccatgcgttacacacatatgggtggagctacactggccgcatagtattgttatacaccctcgttgtgccatattagaccaactatgatgtgttatccg

SEQ ID NO: 502643 - DNA, 1072 bp, Homo sapiens
  misc_feature (1071)..(1071): n is a, c, g, or t
ggacacctatctgtatacccggtagcatcaagaactgatgtgtggcttcatgtaaagcttacctcgtggcataccgcactcgctgtccttacagctccacattggcgtgcacttgattgatcgtttaatgggtgacaaggcaagaaagcccttgaatcacatcctaccgacaataactacagagtgatcacacagaccgtagccgatctgctgatacttgggcaattctggattgcaccatcctcactctctggagtgagttttgtgagacgtactgaagtgccataatggggtcaatgcattgtactcgattttcgcatgagactttctttacattcaaacatggagatctgcaagccaataggaacagggtgtacggtgggctgattatgatgaacgcatcaatcgagctcactacaagttcccgaaatggaacgcaagaacagaatgaagaaaagtcagggggactgcaaaggccaaatgttggtgctggcaaaaaagccgaaggaagtaaagggtgcttgcaagtgattgttaggctgtgagcacactgatggaatttttccgcaagaacattaattatactaaaaatcttcaataataaaatgaaaaataggagaaaaagaatggagaggcgtccagggaggaatttttcagggagggggggaaaaaaaaaatgtgaataaaagttggggaaagaggtagaataaagaggaattaagagaaccagtgagatttggtgaaaaaggtgggaaagcagcaggggaggacccaactaagacaggtgggacacaaatgtaacctggaaaaggacgcacgataaaacccggataagaaaccatcgtcgaacaaaggcccggaacatgaagaaaggagaacagacgggcaagagtgcacggtggaaccgcaaaccaaaatatgcaatcaacaacgatcggcacaacccaaaagtcagcaccaaccaaagactgagtgaaccattgcagaaacacacgagatagcaagaacaatacaaagaagataacaacacaaaatatcacacaaaaacatgatggtgagtttttctgatant

SEQ ID NO: 502644 - DNA, 241 bp, Homo sapiens
  misc_feature (3)..(3): n is a, c, g, or t
  misc_feature (16)..(16): n is a, c, g, or t
  misc_feature (34)..(34): n is a, c, g, or t
  misc_feature (36)..(36): n is a, c, g, or t
  misc_feature (46)..(46): n is a, c, g, or t
  misc_feature (50)..(51): n is a, c, g, or t
  misc_feature (55)..(55): n is a, c, g, or t
  misc_feature (57)..(57): n is a, c, g, or t
  misc_feature (59)..(59): n is a, c, g, or t
  misc_feature (72)..(72): n is a, c, g, or t
  misc_feature (74)..(74): n is a, c, g, or t
  misc_feature (77)..(77): n is a, c, g, or t
  misc_feature (91)..(91): n is a, c, g, or t
  misc_feature (99)..(99): n is a, c, g, or t
  misc_feature (106)..(106): n is a, c, g, or t
  misc_feature (110)..(110): n is a, c, g, or t
  misc_feature (118)..(118): n is a, c, g, or t
  misc_feature (135)..(135): n is a, c, g, or t
  misc_feature (138)..(138): n is a, c, g, or t
  misc_feature (158)..(158): n is a, c, g, or t
  misc_feature (162)..(163): n is a, c, g, or t
  misc_feature (190)..(190): n is a, c, g, or t
  misc_feature (215)..(215): n is a, c, g, or t
  misc_feature (220)..(220): n is a, c, g, or t
  misc_feature (225)..(225): n is a, c, g, or t
ttnattggtctagtangggcttagcttaattaangnggctgatttngcgnncagntnangcagagtggggtntngcngaccttagctgttncagaaacnaagtatngcancttactgngggctttgaaggctctnggnctggatttaacctaaatttntatnngattattagtataaaaggggagatagntaggagtagcgtggtaagggcgaangagtngtggngaggaatggggtgggt

SEQ ID NO: 502645 - DNA, 150 bp, Homo sapiens
tatggcttgtgaggagtagtgtagttgtgttaatatttcagtgggtgatgaggatagtgtaggagtatggggtaattatggtgggcatgcagtctctccccccccattttgattcagcctaccttatttgcttattgcccccttcctgtt

SEQ ID NO: 502646 - DNA, 126 bp, Homo sapiens
cggataggccccaggcagtatagagtagctgctgggaagtatttctcagattccagtgcaccccatgtatctagtagaaaacacaatgggtaattaaatatgggaagtagtttctaacaattggat

SEQ ID NO: 502647 - DNA, 159 bp, Homo sapiens
gattgagaaggaggagcaggctgcggcggagaaggccgtgggaaaggaggagttccagggggagtggaccgcccccgtggctgactttgcgcacccgaggtggctgactggtccgagggcgtccaggtgccctccgtccccatccagcagttccctgca

SEQ ID NO: 502648 - DNA, 1191 bp, Homo sapiens
gggcgccgcgggcctgcgtgctggtgcagcggagcacttcttcgacctcgtacctcctcgtcctgtgcggccggccggtgtgagtgcctgggcccgcgtagggggcagtcggcggctgcctccggcggacggtgcctcgctggtcgccctggtccggcccgcgcctcgagcaggcagtgcatccagtgcatccggagcccgcaccagacccccgagcacgcaagcagtccccagagacttccgcccgaagcggccggcatgcaagccaccaagcggcaggccagcacagagaggcaccgatcgtaccgacaagccgagagcgaacctgcgaggtagaccccccagagtgtggcccccctgacctaccgagtacgtccgatccaggaacgcatcaacctattaccgccgggaacgctgtggactcggagcacaaagaaggtgtaacttctctgaacgggtgcgaatggaaggccattcacatcagacggccaacagtccccaagattggcaaggggccaaggcatggatcccccattgaggcgcgccaaagggctgtacctagctcatatcgacgcctgtgagtcgcccgcaacaggcctattatacaacagaggccaccttccagaggactacacagggacacgcatcgggacgattaccatgggcatcgcttaccgcgagaataattccggacccaaagtgcgggtcggaccacattggtgattgcgacacgggatggcaccacgccattggtaccacgccgagggaagagcagagggaaacgcatcaccccaaccctccggagcggagccctggcgatcaatattccggcaccttatcacgggaatgcccccatggcacaacccacaaaccagggtagtgccatgggaactaggagcatagtgtgaccacccacattgactatagtgagaagcccaagacaaattcgaaatttaagagatagagccgtgggccaaatccgcattggcaacacaatacaaattcggaatggtgacgggtatgaaggcaaaaacggatggcaaaccgcaatatccatcacaacaacttggggaatcaaacggatatattccccccccgcaatggaacgggggcaatgtgcctaccacgggccgccacaattcgggcagaccttgggacacgatgtgggtgcaggctaccgatccgacggcg

SEQ ID NO: 502649 - DNA, 212 bp, Homo sapiens
actcaatattcatcacacgactatacaccaacagactaatcaactaactcaaacaaatgataacatacacaaactaaaggacgaacctgatctcttatactaagtatccttaatcagtttttatgcaacaaactacaaaattaaataaaaaataaaaaaaacaatgaaataataaaacaacaacaaaaataaacaaaaaaaaccaaaataac

SEQ ID NO: 502650 - DNA, 732 bp, Homo sapiens
  misc_feature (106)..(106): n is a, c, g, or t
  misc_feature (111)..(111): n is a, c, g, or t
  misc_feature (160)..(160): n is a, c, g, or t
  misc_feature (215)..(215): n is a, c, g, or t
  misc_feature (248)..(248): n is a, c, g, or t
  misc_feature (261)..(261): n is a, c, g, or t
  misc_feature (313)..(313): n is a, c, g, or t
  misc_feature (315)..(315): n is a, c, g, or t
  misc_feature (321)..(321): n is a, c, g, or t
  misc_feature (325)..(325): n is a, c, g, or t
  misc_feature (343)..(343): n is a, c, g, or t
  misc_feature (350)..(350): n is a, c, g, or t
  misc_feature (359)..(359): n is a, c, g, or t
  misc_feature (401)..(402): n is a, c, g, or t
  misc_feature (405)..(405): n is a, c, g, or t
  misc_feature (416)..(416): n is a, c, g, or t
  misc_feature (421)..(421): n is a, c, g, or t
  misc_feature (424)..(424): n is a, c, g, or t
  misc_feature (439)..(439): n is a, c, g, or t
  misc_feature (444)..(444): n is a, c, g, or t
  misc_feature (446)..(446): n is a, c, g, or t
  misc_feature (457)..(457): n is a, c, g, or t
  misc_feature (472)..(473): n is a, c, g, or t
  misc_feature (482)..(482): n is a, c, g, or t
tgttgttttctgttgattttaaacagagaaaaaaataaaagggggtaatagctccttttttcttctttcttttttttttccatttcaaaatggctgccagtgtttncaatngatggacaacagagggatatgctggtagagtgttaatggcctagtgganaaagctgctttggaatgcggggggtctatccttggacactacgcacttttataanacatgtaatgctatatgacaaaatgctctgatncctagtggccaanggttcaatcagtgtatataactgaacacactcatccattggtgctttggttntnaatggngctnaaagtaaagagcccatcnttggcangtcatccangtggtacttaggcatttaatctgggctcaaatggttgaagannggnggctggtccanggttnggnatggggtctaatgcngtttnanccatgatagangcaggcatggtggtnngctagtttnctggaaaagggttcaaatccttttcaggacatggtcgttgcaggattcctttcaataaaaatttttttcctttaaaaattttccaaaaagaacaggagtacgatacacacacgaaaaacatttttgtgggcgggccttgcgcctgtcgaaaagagtttttaaaccccatcggtgggggggcgcgggccccatctagtagtgaccactgggcaaaggtggtcccagggaaccggggacgagaaggcggggc

SEQ ID NO: 502651 - DNA, 383 bp, Homo sapiens
  misc_feature (4)..(4): n is a, c, g, or t
  misc_feature (9)..(9): n is a, c, g, or t
cggncttgnttcctgcacttctttaaaaaaatagttctttacatgctgaggttcatctatgcagggcatgagctgaaaacagattcgagaaaggctgttcctacaagggaaggtcctgaggttacaacgccggcatggccgggaaaacatggctgcagcgatcccagcttcttgctgcccacaggggtggcacatctgggcacacactgtgagctgctcagaggcactctggtgggcagctcccatcgcctcagtcagtgtctccgtcctcttcactgccttccaggggacttggcacctttggcgcccgtgccacctgccgtgagagcggtggcactgaaagttgtggatgggcaaggtgctcagccactgggccatggagc

SEQ ID NO: 502652 - DNA, 406 bp, Homo sapiens
aggctcctcagcctccaccatcccccaggtgatgtctggtcaactggcctgccttcagctagaatcctgttaggtcggtttagatgaatgctccctgatatttcctcttggtaatcttccatccactgcccctgaccctgttccctgtctataaatccccagttttccatggtgtattcagagctgagtccagtctctctcccctactacaagtccccattgctgtggtccccgtacctgtcatgatggtcctaaataaagtcttactgtgctttaatagggtaggcattgaaaaatttttttctttggacatcattcatgacaacatggaaacctattgggggacaggcatggactgtggcaggggtctttaggaggctcagctttctggaggggccctgagggc

SEQ ID NO: 502653 - DNA, 946 bp, Homo sapiens
acggcgtttgccccaataaagacggtcccttatatgggagtgtttttttactaggggacccgtgtgacccccacgccctctgtgtgcttcgcccgtttggtctcttcttgcgcccttaaacacgacagtttgctcgttccccctcccggggcgcctcctccattaccgggccgggttcctccccctctaaaataccccggcgccccccgggtcccaaaacgaaaactgtggcgtgcaccccgacaccccttatgcctttgtccgcctcttatgccatccctcgtagttgcggttgcctttcgtcaccgacactcctgctatatgaggcttctatggccataagttttctgggctccccccccagtctagataatcttggcaggccgccccaggtggctcagcgccataacacaatgggggacacccaccgcgacgaagcattcccgggcgaataaatggtaaaactcccccctcagatattatataggggaacaatgtgaaactcatcctggagcaccatattggttatcctctatgttgattatacagcgagacgccacccacgcttaatgcccccgaaagaaggcgctctctcccgtcatattggccctccaacattccaggagggaccacccccttttcaccaaaaaacagtacctggtttcacaagtaattcacttattaaaatatcgttgcgactatttccagcgtcccacggatccttctgaaacaatatttactccttgaataacatgatggtgccccccgcctaatatattaaatacaaatcattcatgacgaatttaacacatttcgcctcgctcatcaaactactcttggaatcacaaacgtagggccccccctcaataagtattctcccccccaaattgacttacgactaaaatagtttcccagagccaaaacctttttttctcccacaaaacac

SEQ ID NO: 502654 - DNA, 377 bp, Homo sapiens
atagaatgcctgcctggagttggtcctgcttttggtccacatcatgggaactgctaagagttcctgctggttctgtgattatacagtcatcctatttgggatgcaggatttgtatcattaatttttttcaaaagccctataacaattcgggagcccagaagggaacaaggcaagtacaagtttgggtgctttctatgcaagattttctagcttggatgaaaccttgacatcagccacacagttagttctttctcacaggctccatactctgtgctatgatgtgtgactctgagatttacggatgtatcttctctccaggcacttcctggcttcctttgataacatatgtaattagctatttcccttccctattaaat

SEQ ID NO: 502655 - DNA, 286 bp, Homo sapiens
  misc_feature (190)..(190): n is a, c, g, or t
  misc_feature (252)..(252): n is a, c, g, or t
cagctgttattgggctctgaggccctctcctgatccaaatctttttttgtttgtttgtttgagatggagtctcactctgtctcccaggctggagtgcagtggcgtgatcttggctcactgcaacctccacctccctgattcaagcgactctcctgcctcagcctcccgagtagctgggattgcaggcatnaccatcacacctggctaattttgtattttcagtagagacagcgttttgccatgctggccagntcgtctcgaactcctgacctcaggtgatccgccc

SEQ ID NO: 502656 - DNA, 1239 bp, Homo sapiens
agacaaccttagccaaaccataatacccaaactaaacgtataggcgatagaaattgaaacctggcgcaactacactatagctaccgcaagggaaagatgaacaaacttactaaccaacgcactaatatagcacaggcactaacccctactaccctctctgcactaactgaatttacacctagcaaactaaccttctgcacacggagacgccaacagctacatgacccccgcaacaccagcacgagctacctaagcaacagctaacaagcagcacacccgtctactgtagcaaaatacgcgggcaacgcattcatagcgctagagcgcgaccacaaccctacccgagcctggctgcatacgctggactagtcccaagcactacgaactctctacgctcccaaactaataacactctctgcccccacaagcaaccccctcctaaactcccaccttgccacacactccacacctgctacaagactccacaagccaggcaaacaagcatcatactatgcgcacaacctacacgaaacaacaaacccctggctcagaagaaagagataaaacacaactaaaaaccacgccaaatagcctaaggcccctcaaaaagacaaggacctatccaaaatcataaggataaaggccgcttaaccaaagtcttaccaaaacacccccgaacataacccttaacaacaacactaccccaacataccattaataaaccatgaaaacctcccttacaatatcccacgacaactaggcgcaaccccagaatcccgatactccaacgcccctacttacgacacagcaccacgcataacgcaacacccacgacaacgcagcagcgaacccaacgcacacacaccacaagtacaaccgcaacacagagaggaggcgacgaaaccgcacaccaagacaagcaagccacccccacagaaaagagacacacatccaaaagacctacacaccacgacacccaccccagaaaacaactcaaacacagcaaacacaaaacacgcgacggacccccacaaaaacaacacaagaacaaaacaatatcataacgacagccggaaacagaaccaaccgagcaacggacccgactgaccacaaccaccgacacaaaaacaacgcgggaaaaccaacaagccacacaacgcatgagcccaaatacatcgcgcaaaaacgcaaacaacaccaactaactcaacagcagaagcaccatccaacaacacaaca

SEQ ID NO: 502657 - DNA, 415 bp, Homo sapiens
  misc_feature (319)..(319): n is a, c, g, or t
tatcttcatagacatccattttttattctcccacgagataacaacatgtgatattttgtcgttactagtgcctggcttatctcacataacataatggcccccagttccatccatgtggctgcaaatgacaggggttttattttgtataagggcctaataatgttacactagtgtatatataccagcattttcttatatccattacatctagttgttggacactataggttagattccagtatttttggctatgtgctatatgtgaatatgtgctgagtataaacatagagagtgtagtaatctatatcaatatattgantttcctgatcttagtagatatatattccagtactaggaattgcagggtcataaagaaagttctattttctattttttaaggaacctccatactctt

SEQ ID NO: 502658 - DNA, 932 bp, Homo sapiens
caaatacggagctgtcatggccatgtatgtgctggccatgtccctggctgaacttcagtcgaggtggcacgcgagcaccccgtgcctccgaagaaccgctcggcgctattccgcctgcgtcccctagagtagctagctgtgagaggatgtggcttctctgtgaatctaggtcccattggtgtcttgagggaggagcttgtaagaaatgacctgagaagctattgtaaagagcgcaagtcccaggttccttgtcacaccatggcatcactcgttccttgacacgcattctcgctggcctcatctcacactccgaggttccctcagcgcttgtgtacccaatgctgacattggtgggggggtgtcacagaccctgctgcgagcccctgcggttggaccttggtatgtgctcgacactaggacttgcctgaatctaccatgggaagagatcctgcaacacgcaaaaactttaaagtaggattgcttctaattagtagatcttgaatacctacccgactctagtgaagacgcagtgctgaggttgtgaaggatcaacgagcctgctctggtttggatggttcccatttttgcttcgcattcaagggacacgctggggcgcgcattcccgtcaatgcccgggaaggtatgctacccagtgtcgtcgacaggggggcctgccggtgaacgagcgggcccgaccgtaccaaagggctccgtttaccagtccagtatgcactgaaacgttgccgaactttttttcttgctccatttgtgtttgctgactacagataagttttccgcaacgtttcaggtctaattttttcaagccgggtactgtccgcacctaagtaatcctaaaactattttgacttggggaaacttggcttttgtgggttcccgcccgctttgaaccaccaccgggttcctgtgtataa

SEQ ID NO: 502659 - DNA, 258 bp, Homo sapiens
  misc_feature (159)..(160): n is a, c, g, or t
tattattgtggggtattcaaatttttttttcccacaaccttttttgtgctatcggaaatgccccgaggttattgggaaaaccccccagtataaccccaccaggacattcctatatttgtaggctcattcatttctctaacagcagtaatattaaaaaanntttagagttaagagctttcgtttcgaatcgaaaggtcataatagtaataataccttcaataagcttggagtgaatatatggatgccccccgcaagaaa

SEQ ID NO: 502660 - DNA, 593 bp, Homo sapiens
  misc_feature (23)..(23): n is a, c, g, or t
  misc_feature (31)..(31): n is a, c, g, or t
gcacgaggtggggcttgccttgnccacgtcnccgggaaataaaacccccccgaaaaagggggccccgaccccggggtacccccccatatctccggggggggggcgaagggcgcaaaaatatttttggtgtgcccaaaaaccccacaaaaggggcaaagggggccgcccaaaaaaatttaccccacaatttgtgggggggtcttggtgtggaaaaaaaaaaaaattcccccccccggggggggatattttgggggggggggggggcggggggttttttttttttataagccccccccgccttttttttttttttgggggggagaaaatatttttttttttttctcccgcggggggggggggaggattattaaccccccccccctcttccccccccccccggggggggggctcttcttttttcttataaaaaaagaggggggggttttttttttttttttttaaaagaaaaaaaaaaattttttttttctttcctcttttcggcgagggggaggggtgtgggagttttttttttttttttttttgggggggggggtttttttttcttccggctgggggggggggggggggggaaa

SEQ ID NO: 502661 - DNA, 132 bp, Homo sapiens
actagaggatcccttaaagggaactcagctgtcattgacatttcaaccccaaactcctgtaagccagccagctacacatttgattgggctgtttttgacaaagtgtggaatactgtatctcaaatatattgg

SEQ ID NO: 502662 - DNA, 113 bp, Homo sapiens
agagctcgccccggactacatttcccagtgtggcctgcgctcccaagcaaccactcttccgcctgctcgcatctgggcttccttcccgggattttagaagacttaggatactg

SEQ ID NO: 502663 - DNA, 802 bp, Homo sapiens
tggatgtataaggcaggttttatagaaccatttagattcaacattaatggtagagtggcattttaccaaaaaaatgggtgtatttgatttgggtgctgtaaggcaatttgctaggacatgggataatcagattacacaaaatctaggcagtgaacaagtcttcatcctggcccaggaaatagcctattaaaaaatgctgtccaggccaggcacagtggctcacacctgtaatcccaggacttcgggaggctgaggctggaggattgcttgagttcaagaccagcctgagcaacacagtgaaaacccatctcaaaaaaaaaaaaaaaaacaaaccaaaaaaactggtccagctggtgggacttccagggatccagggactggctgggggatcaacgcccaagggattgttttccaggaggctctggtggaatttaagaatgctcgaaagagagtgtgttccaagaaggagttaagggtcatgacagaaattttactcccgaaggacaatctaagtttctgccacaagttacccggtggttgtctctgtccccacaacaaagggcccctttcacaagctctgtgcctcaaaaccccgtgcagaaagtccttcaacaaaactattaatgagactagtgaaaaccctatctcctcacatgggtaagagttgcagtggggcaggtgaccctcctccctgcccccatccttggcttcctcaagctccctgccaacctcgtggatacactcagggggaaggaaaccggcgacgcatagacctatagtacaacaggggtgtagtgaccag

SEQ ID NO: 502664 - DNA, 396 bp, Homo sapiens
  misc_feature (344)..(344): n is a, c, g, or t
  misc_feature (361)..(361): n is a, c, g, or t
  misc_feature (392)..(392): n is a, c, g, or t
cctgtagtccagctactccagaggctgaggcaggagaattgcttgaattcaggaggcggaggttgcagtgagctgagatggcaccactgcactccagcctgggtgacagagggagactccttctcaaaaaaaaaaaaaagaaaaaagaaatgacagttatactaagggactggctacacggctggggatagttgaggaggagctggtttcctagggagatggtttctttcatgatatgggagcttctcttaaagtcactacccaaggcagctatttcttttttttttttgagacggattttcacttctttgtttgcccagggttgggagttgcaatggccaaantcttcggctttaccttnaaccttccgcctccccgagtttccaagtggnttct

SEQ ID NO: 502665 - DNA, 441 bp, Homo sapiens
  misc_feature (13)..(13): n is a, c, g, or t
  misc_feature (23)..(23): n is a, c, g, or t
  misc_feature (46)..(46): n is a, c, g, or t
  misc_feature (66)..(66): n is a, c, g, or t
aacaacttatganatattacgantttaatacgactcacttataggnaaattttgccctcgaaggcnaaaaaattcggcacgagggtcgatgctcgccagcccgttgatccgccggatgaactcgatattgctcgggcaccacggcgcatcgggccgcaccgactgcatgtagcgctcgatcgcgacggcgtcgacgggtcgtcccacgacagcggcaggtgcacgatgcggttcggcacgcgcatgtcggccacgtcgggcaattcgcgctcggcggcctgcagatgcgccagcagcgttggcgagcggcacgtccgcgcgtcgaactggatctgcagcgagcggatccccggcgtcaggtccagcatgcgggcagccggtgcgcgtcgagccagcacatcagcacatgaaccgaaagcgcaggttcaggtcgagcataca

SEQ ID NO: 502666 - DNA, 283 bp, Homo sapiens
ttcctcaaaagtcacagcttagctgggcacagtggctcatgccgataatcccagcaattcagaaagctgaggcaggaggattacttgaggccagactgggcaatatagcaagaccccatctctaaaaaattaggcatggtggtgcatgcctgtattcccagctactcaggaggttgaggtgggaggatcacttgagcccagaagttcaaggctgcaatgagccatgattacaccacggcactacaaccttggttggcacagtgaggaaccttgactctttaaa

SEQ ID NO: 502667 - DNA, 109 bp, Homo sapiens
gcatcagccgctcagcaggagcggtctaccattaagtgagatagtgagatcgttcggccagaactctatcatcgcttacgataaaactggtgcggggtgcgtcggtctg

SEQ ID NO: 502668 - DNA, 171 bp, Homo sapiens
  misc_feature (63)..(63): n is a, c, g, or t
  misc_feature (139)..(139): n is a, c, g, or t
  misc_feature (161)..(161): n is a, c, g, or t
gactcgagacttcacctccagcaggatggtggtccacgagagtgaagagtgagccagcccttntggagcaggacagaagatatgcaaaatgtatatttttttgattcctgaccattaatacttaatgtccatgtgactntttttcacatgcaataaacttngctttgtttc

SEQ ID NO: 502669 - DNA, 417 bp, Homo sapiens
tcttgctgtttataaattgtatctgtatatatttaaagttagaaaacagaaaagacccagccgggcgtggtggctcatagcctgtaatcctagcactattgggaggctgagatggatggatcacctgagatcaggagtttgagatcagcctggccaacatggcgaaaccccatctctactaaaaatacaaaaaattagctgggcgtggtggcagacgcctgtagtcccagctactcggaaggctgaggcaggagaatggcatgaacccaggaggcagagcttgcagtgagccgagtttgcgccactgcactccagcctaggtgacagagtgagactccatctcaaaaaactcaaaaaagaaaaaagacaatgaaaggtgaaaaacaatggtaaaatcgtccaatgttattgtaatag

SEQ ID NO: 502670 - DNA, 662 bp, Homo sapiens
  misc_feature (245)..(245): n is a, c, g, or t
  misc_feature (263)..(263): n is a, c, g, or t
  misc_feature (312)..(312): n is a, c, g, or t
  misc_feature (333)..(333): n is a, c, g, or t
  misc_feature (472)..(472): n is a, c, g, or t
atatttctataacatttattttagtgaccttataatgtttctttgtattaaattattagattatatctttaggtaatattgttactaaattagtaggtaatacatatttttattcaaaaataaattgtgcatctaatgtctaccaattaatgtacttgtagatgtatcttatcttaacttgagtctttgctgcccctaatgaggtgtgaaggactcttctcccctggggaagtttttctttttcnggagggaggagggctttnccaggtaatgtgtctagagtgttgggcagaagaatctgggaccacaccncaccagttctctccttaatcnacgtcatttgccttctatcccagctatgtttccagtgtcctctgggtgtttccaagagcaacaagaaacgaataaatctctggtgagtttttatttgttcttcactttgttttacactgtattttctgagtttatgggngtctgtgaattaaaaaggaaaagtggaaataagtaaaactcaggttgaaggaaatatacataaataagataaagctgacctgtagatatagacaggttataaaagcttagagttgtctaagttgagtgcaaagtttcctctgatctttctgatgccgaaacaaaaaaggcagtcatgtttgttacgtgat

SEQ ID NO: 502671 - DNA, 244 bp, Homo sapiens
cctgtctctgagagtccactgcttctgtcctagttctgcttcgctcctcctcgaactcgctctcctcctcggtgtggcatctggtactgtggtactcggacccaggtcttcatgttgctctcggcctcggtgaactccatctcgatcatgccctcggccgtgtaccagtgcaggaagggcttgcgccggaacatgggcggtgaaactgctcgggagatgcgcttgaacagcttctggatggccg

SEQ ID NO: 502672 - DNA, 171 bp, Homo sapiens
gggtgggggcccccccctgggggcccaaaaccccccctggggttggggggtttgtttgaattttaacccccggggtttaaaagttttgtggtttttcccccggggggccccctcccaattttttttttttttcgggggccccccccctttttttccgggggtttttcccca

SEQ ID NO: 502673 - DNA, 603 bp, Homo sapiens
  misc_feature (245)..(245): n is a, c, g, or t
  misc_feature (263)..(263): n is a, c, g, or t
  misc_feature (312)..(312): n is a, c, g, or t
  misc_feature (333)..(333): n is a, c, g, or t
atatttctataacatttattttagtgaccttataatgtttctttgtattaaattattagattatatctttaggtaatattgttactaaattagtaggtaatacatatttttattcaaaaataaattgtgcatctaatgtctaccaattaatgtacttgtagatgtatcttatcttaacttgagtctttgctgcccctaatgaggtgtgaaggactcttctcccctggggaagtttttctttttcnggagggaggagggctttnccaggtaatgtgtctagagtgttgggcagaagaatctgggaccacaccncaccagttctctccttaatcnacgtcatttgccttctatcccagctatgtttccagtgtcctctgggtgtttccaagagcaacaagaaacgaataaatctctggtgaagagataccatttgacattttagagatggctgcatgcaaactcttgaaacatttgagtaagtacagtacaccagggagattcttatgactattgggataacaccaagatgtggtatatgctccttactcagggtccccataaatcaaaccaccaaaaatcaaatagattaaagaatgaattaga

SEQ ID NO: 502674 - DNA, 931 bp, Homo sapiens
  misc_feature (3)..(3): n is a, c, g, or t
atntggcaacccaaggagttaatcctaaggaacatccagtaaaaaaaaaaaaaaaaaaaaaaaaaaaaaaaaaaaaaaaaaaaaaaaaaaaaaagagagaggggggggcgcaccgcaagaatatctctcgcccgggggggcgcccgaagcaatcacggcgtcacaccagtagattagtgtggagaacgagggggccaccaaatggggggagcggaatttatattacggcagaggcgcgcggggcgcgcggcggtatatataaacaacagctgcgggggcgcgcggggaaacagcgcggcgcaacacgcgggggaactactctctggggggagacagaaggacaacctctcttactactgcgcggggggggggagggggacaacatattgtgtgcgggacacaacattataccctataagcgaagagatattatataagaggcgcctaggagggggagaaatatattataaatcttttagaagagggggtatatataggggtggtgtaacacaataaagagcgggatatatgtgtgtgcgaggaagaggtgagtagagaaaatatttgtggggagatataagcgagggagagatgttagatatatatgtgatgagagagactattatattatatataccggaggggggagcttatggtgtttgtgaaataaatcaaaccaacaaaaaaaaaaataaaaagataaaaagaaatagagcagaaaggagaaaaaaaaaataaaaaaaacaaagagcaggaagagagacgcgagggagaaacataggcacagcgagaataaaaaaaaagaagacagagaggaggaagaccaacaacccgagaggaaagagaaagagagaagacccgaatcaaacagcagagagcgacgaaagaagcagccaaagacaaacacaaacaaaacaacaccacaagccac

SEQ ID NO: 502675 - DNA, 181 bp, Homo sapiens
actgccgttcaggatgttataagatggtggtcctggtcaggccggcggcactgcttaacgaaagctgggtttcgccacgactcttgatcaagtacttgatgttgctcttcaagtgctcggttttttcccgtctgtgtatcaagtgctcaccacttccatttagtcatcagtccatgccggc

SEQ ID NO: 502676 - DNA, 886 bp, Homo sapiens
cccaggtcgatgagtccctgtcaaccgacatgccatggcctgggctcccgaggagggggatgcagaggtgatgcatgctgggtgtccagctgccccgtgctgccggggggcagcaagaaaagagcacgagcgctgcaccggaaacatgaaggacgagtacagcaagagaagacatacaaaacacaaccaaacaacaaaaaccaatgacaacacgagagacaacacaagccacgcaacagcaaaacaccaaaagacacaccacaaccacaaaccaacagacgacacaccacaacaaaacacaccagccagacccacagaacacagacaagacaacgcacccaaggagaacagcaacacacaaacaagaacaaacaaacaaagaaccaagagagcaccaacgacgagaaaaagcacaacaccacaacaagaaacaagcagaaccacagcaacacccacgccaacaaacaacagaacggcaacgcaaaaaaaccaacaagagagcacgagcgcaagagaagggagaacaagaacgacgacacaaggaggacgaaagcaagaacagacgaaacacaagcacccgcaacgccagaacaaacacccacacgcacaaaaggagagcgcctagaacgcccaggaaacagcgaaggcaagagaagacgacgacagcacgcacgccaaaacgcaagaacaggaacgaagcaaagccacaacagccaggacaccaaggccaacgggcagacgagaagaagagacggaacccacaccaagcagagaagagagacgacagaagagcacaagaaacacaagagacaacacaggagcacgagcccgagaaacccacaacgaggaaccaaagaagacaggcacgaacaggaaagcgcgcagg

SEQ ID NO: 502677 - DNA, 553 bp, Homo sapiens
  misc_feature (1)..(1): n is a, c, g, or t
nttactggcatttcttacctcgcttgacgtactatttttttttttgagagacgggagttcctctcgtgcccaggctagagcgcaagggcgcaatctggagcatctgagctcaccgcaacctccgccgggttcaagagattttcctgcttcagcatcccaagtagttgggataacagacacgtgccaccacgccaggctaccttggtattttaagtagagacggggtttctccatgttggtcaggctggtcttgaactcccaagctcaggtgatccacccatttcagcctcctgggtagctgggactacaggtgtgcgtcaccatgtactaccaaatttttaatatttttcatagaagcagggtttggtctggtggcccaggctgccctcaaatggcggggctcaagcagtcagctcaccggggcctcccaaatggctgggattacaaatttgagccactgtgcctggcctaaattttatttagtagatagcatggggtcattggggtttcatttcattaagttattggggatataaatacatagggataagta

SEQ ID NO: 502678 - DNA, 430 bp, Homo sapiens
ggcggccaggacagcttaatgaatagtaatatgtatctcttccttatgatttttttatctctttatttattttttgagacggagtcttgctgtcacccaggctccatctcaaaaaaaaaaaaatttgaataaggctgtgtggataaaataatagtgttgtaccattgttacttccctgtaataatcctgtggttacccaaagaaatgtccttgtcctaaggagatacacactgaaattattagggggcaaggggccaatttactcttaattcgtccaaattatatgacacagttgccccttgaacttggtttgggacctgcttgatccattttttttttttgggagtttccggccaatttttttttattcaaattgcagtcgtgtccaccctggtcccacaaacccccaattattatctcatttccatca

SEQ ID NO: 502679 - DNA, 234 bp, Homo sapiens
cccccaaaaaaaaggggggggggccccccaccccccctgggtttttttaaaaattttaaaaaggtccccaaaaaaggggggggggggtaaagggggccccccccggggtttagggttttctttggggtcgggggagggcccccccttttttgccccaatttgggggccgggaaacccccaaaaccggaagggggtttggggcccctttttttttaaaaggggttcccaacccca

SEQ ID NO: 502680 - DNA, 474 bp, Homo sapiens
accgatgagcttcacattttctttcctccttccattcccatgactaccaaaccagtgcaggttctcctcacttcactctaagacaacagcgtggccctcaaatactgtcacactcttcaaggctgtgtgagcacaatctgtctcatattctcttctgctgtcaccagatttattctaagaccgtttcttcactgttactcccctgtttctcaaccagttacacagaaagacgaatatccaggcatggtgtcatgtgcctgtagtcccagctactcaggaggctgaggcggcaggatcgcttgagaatgtgagattcagactgcagtgagccatgatcatgccaccgcactccagcctgggcaacagagtgagattgtctcaataaataaataaataaataaataaataaataaataaatgaatgaataaatgtggtctatccatgcaacggaaccctataaaattatcagcctt

SEQ ID NO: 502681 - DNA, 825 bp, Homo sapiens
agtacgcctctgacgccatacggcttggctccgtcatgagttcggcgccggcctcaggctccgtgcgcgcgcgctatcttgtgtcttccagtacgtgggcccgactttaacgggatcgcgatcgtctgggtgcactcagcgcgcgtcggggtccagaactacctggaggaggccgccgagcggctgaattccgtgagccggtcattgttctacccatctccatgccggtatgtacgccggtgtccagcgcccgtgagtgaacgcggtcgcacgttgacgtccagcgccggtcaggccggctgcccttctctgcccgatgtcctggccgaggtcctctggcattagaccttcgtggaccccggggcaatcaaggcgtgtgcggtcctcctcgtgtgcccggcgaaatctcacgcttcgttgatgcagactggtccgggaacttacgtgtgccgtgcttggccacttggttgtcagcggccgtggatgacgggtgccggggtgctttggaacgcatagcttattgcttgtagactctcgcgggcatactgccttggatatggtcgccaatgcagggaaagaccggcgcaacaccctcggtcggtgaacatcaacgacattcatgtgccttccagtccgtgtggagaggcccggtgtcgagccctgtgcatagcgctgcacccgggttctccggattcccacaggccagtgccaagaccctttgtgtacaccccccgtagatagaagcaggaaagctgtgcgggttctggcacctggactttggagaacccaggtctttcctgtatatgaccaggtcggaaggactac

SEQ ID NO: 502682 - DNA, 438 bp, Homo sapiens
tcctgttccttcatctttagtctgatttttgcctcagtctggtgaggacatcattggatagactggtgcaggcccgaaaaccactgtttggtaccataatattatttctacctggatttaagtttcatgcttaacgaaaataaggatctgcattcatttcttgagtgaaatagtaggtacaaattttatagtgtgttgcaaatcgtaggtgctagataagctatactatgaacagtttactgttaacacttttcttcatttgtattctgtggagtacgctagttaggagtgattttcatttgcttcatacagaatctgatgctttatataccaagccagaaactttaaataattgaaataattttattgtatttataatactatatttaatagttaatattcacaagatctctaagggtttcttagcggggtaccgag

SEQ ID NO: 502683 - DNA, 313 bp, Homo sapiens
actggacgacatcaggttcagtggcggtcactcgtgtgctgccgacagtgaactctgtgagttatcagtcgctgagctgtgagtgtgcctggagcgcacgcgctcgtgtatcactgaggtggagtggcgcgtgtgttgctcctatcccctgaaactccaaggcccacgctcatgtctcaagagcactttgaccccaattccacctaggtgctcttcacttagagtcagatctctaggtcctgtgatgaggacaaacaaagcgtcagtccgcgtccaagcaagggtcgagctcgatcgtaatctgcatagctgt

SEQ ID NO: 502684 - DNA, 103 bp, Homo sapiens
  misc_feature (60)..(60): n is a, c, g, or t
cgcctactactactactgccggattcaagcttttaacgatgtacggggacatggtacgtnttctctagtatgtctgagcaattaaatagattcataagcaaaa

SEQ ID NO: 502685 - DNA, 377 bp, Homo sapiens
tcataaaccctgtctctactgaaaagaaattaaagaaaaaaaaatccaggctcgttggtcaggtgcctgtaatcccagctgctgggtgaagctgaggcaggagaatcatttgaacccaggagatggatgttgcagtgagccaagatcgtgccaatgcactccagcctgtgtgacagagcatgactctgtctctatagggtttcgatgacctcatcgaaaccctgttttcaattctgctgtgtatatacccagaagtatatttatccctctagaagtgggactgctagatcatagagcagctctatttttaatttctaaagaacattcataatgttttccacagtggctaaacgattatttattcccatcagtagcac

SEQ ID NO: 502686 - DNA, 471 bp, Homo sapiens
gcttctcacccgtgtagtcccatctgtcctaccgaaacaggcacatgctgtcattatacacttgggtatcctccagagacccctctctgccccacaaaagttgaaaggtccgtgaacacacacgtactacatacttaaatcttggcttcgctactcagcttagctgctgcagttaccttatctgtaaaaggagactaatagtaacttcctcatatgcttcttcaatccccataatcgtattaattccgtgaatgcttatttagcaaactactatgtgccaggcattgttctaggtacagggcactgtggtagagaacaaaacagtccatatcccaataaagcttctatttcgggagcgagagagacagtatatcactatctttaatacattacaatgagtgatgctatgtgccacagcagaatggggaatgagggtgctaatctctgtagggtgacttaacagatattgac

SEQ ID NO: 502687 - DNA, 427 bp, Homo sapiens
  misc_feature (258)..(258): n is a, c, g, or t
atttacttttctcggagcgcccatgtgtggtacccggaattcgccatatggcccggggaccagtaccctagggtaacaagccaatcttttttaagtctttaaaaataggggttccaacccctatttttgggaaaagaactccccctgggggcgccccccttttataaaggggttttttttttaaaaaaaaataaaaaaccccccccccggtcttcttgttgtgaaaacaacccccgcgagaaaaaccacccgcggggngtttgtttttttatataaaaaaaaacccccccccccagaaaaagaagagaagaaaaaaaaaaaagttttttttatttataaaagaggcccccccccccgggggaaaaaaaaaattctcccccctttttattttccccccccccccccccccccccccgggggggggggt

SEQ ID NO: 502688 - DNA, 202 bp, Homo sapiens
  misc_feature (102)..(102): n is a, c, g, or t
  misc_feature (120)..(120): n is a, c, g, or t
  misc_feature (133)..(133): n is a, c, g, or t
  misc_feature (175)..(175): n is a, c, g, or t
cgagtgtcagggacaaaagcctccgcctgctcccgcagccggggctcatctgccgccgccgccgcgctgaggagagttcgccgccgtcgccgcccgtaaggntctgagagccatgtcggncagcagcctcttngagcagagaccaaaaggtcaaggaaacaaagtacaaaatggntctgtacatcaaaaggatggattaaac

SEQ ID NO: 502689 - DNA, 1030 bp, Homo sapiens
ggactcccatgttcgttcttcactagcctgggcctgagcggagcgagaaggcccgtgagagctcagtaactcgggtctgagacgcgcagtttgcgccgaggccggtactcaggctacgggagagcctgggttaccgaccacttgtagaacatgcgtacgggaggatcctgatcactattggctttgtgcctccctgacgtcgagggtagtatacccgggggatgctcctcgcattaccgttgtcaagctacaatagcgcgatgtaaagaaagatccagcggctggtagctccgcaagttctaatgcgtctgccctttgaggtattgtgctggacgtcaacccacgttggttgccacatcgaatgactggtgcgacttcgtagcggtcaatgtcggcggttgagtgtcatctcgtgacccctggcaagccatacttgcagagaggcttgtgtggctgtgcttgcctaattgaactagggcaccggggtcctaagctccttcgcgttgagacagccgtgtgatgcaattgtttccaaaccaagtggcgtggcttcgtgtgggaatcgcgcgcaggaagagaactctgcgttccttggttgccgtggaaaaggtcggggggacccggactggggggaacatggagtggactccaaaagatattcgaaagcgctgggaaccaatcgttaaggaggttttctaacccaaaacatttcgctcggttcccctcggaaagaacttggagaaggcgttggggatcgcttcgggagggaaaggcagaggtggcgacttgggttgggacccctattttggtggtgcccgtgcggacaggaaacgcccaggcaaggaacaacggggtcttgggcgccaggcaaagtgagttgtcgatcggtccaacacctttgggctacgcaattcgcctgagcccacgaaagtttccgtaaacgtgtcctcgtttacgacgaagttcgttggaggggtgttggcacctggtgaaattggcctagggtctgcccttggagtacagtgccgta

SEQ ID NO: 502690 - DNA, 113 bp, Homo sapiens
gattgatcgccgttctggtaaaaagctggaaggatggccctaaatctttgaaggtctggtgattgcttgccattgttgatatggttcctgcaagcccatgtgtttgagacttc

SEQ ID NO: 502691 - DNA, 233 bp, Homo sapiens
  misc_feature (129)..(129): n is a, c, g, or t
tcgtttgtcgtaagcagatggagcttgttatatttactgcctcatagggatacgtacaaggcaaggggtaggctgatgtgttttgtcacgggcggttgacgaattgagtgtgacgcgcgtcgtataccnatacgccgtcctagcttttaacgagtacctgcggcacagtactacttgacccagccgactgggggtcttcgaacactggtgctttagcggaagtcataagctgg

SEQ ID NO: 502692 - DNA, 960 bp, Homo sapiens
  misc_feature (183)..(183): n is a, c, g, or t
  misc_feature (264)..(264): n is a, c, g, or t
  misc_feature (392)..(392): n is a, c, g, or t
  misc_feature (429)..(429): n is a, c, g, or t
  misc_feature (611)..(611): n is a, c, g, or t
  misc_feature (620)..(620): n is a, c, g, or t
cggggcatctaaaaggggaacctttctaactttgccctttgtggccaagccgcaacctttttcaagcccccccgggccttaagatgcactttctttccaaccctaaagtgggcttcttgaacctttggccttggccctcgcaagttccattattacaattcaagacaggcctcaccgggtgcngtcactttaggattgttgaaacaaagacaatttctcaaagtttcccctgaagacatgccatctctagaaccttttttctcncagactctaccaccacctttgttcctagagccctctgctggcgagtcgagaacattattgcccagaaggattatgtgtttatggattattttgccccgcctcaggagcgcaggaagtcactaccattnatattctaaaacagacctatctatgttcataggactnctgatgtgtcagataggaatcctcatgagagatcatatgctttgtgccctggaccactgctgctctgggttctcaggaggaacaggcaagagcagcttcattctaagcctttccagtgacctcagccttgcttctcttctacaacactaaggctcctctgtcagaggaggtcgtcttgtttntgcttcatngcatgacataacccttcccctcaagctgttcctatatatacatgcacacacaaaataagccagacagatggcaatttgatcttcctttttagaacacaaaaacaacaatcgggggaaaacggggatctcgtgtgaaataccacctgacccaactatattaaatatgcctctcccagcactttaccccgagagtctgatctcaagggttatcccctgtaccctcaggaagcctctaaggtgctaaagttgtagccctcaaatgtgcacatgtatctgctaaggaccgtacgtagtctctaccactgactaacccgaaacagaaagagaccacacaactaca

SEQ ID NO: 502693 - DNA, 1609 bp, Homo sapiens
  misc_feature (1337)..(1337): n is a, c, g, or t
aacagcacagagagagacatcagaagaaattcagcaaggggatgacaagtataaaaacaaagtgaagaaaagggccaaatctaaacagtcaggcagtcaagcagcaacagcagcaacatctaacagcagtcaaagcaacagcagcattccaacaaccatacatcagcaacatgcacagcaaacagcaggcatagcaggtccaaggcagtcaacaggcacagggcggggggtggcacacacatagttcaacagcacacacacagcacacaagcccagtcctagcatttcgtcacaagggcacacacagcatccagcgcaaacagggcagtcagcacagctcacacagcagcacagtctcaacaccagtatcagcacatccacaagcagtcacatgccagccatgcatccaccagctaaacacaggtcacagggcacacacacggcatcagcacgccgccactacatccccagggcagttcagcagccacatcgtgcatcatcaaactacacacagggtcacacaccacccagttcatcacatcagcccagcacaccaagcaggcacatgcaagccagcaacagtcaaggcgaccagcaaagccaggacagcaagtgcgcactccaaagcacaccccaatgcaccagcagcatctgccagccagacaaggccacaggcaagtaaccccatcaggaataaccagcagcacaccagagcacataacaagggcagcacaagaagcgcacgggctccacccgcaaagccccgaggcagcagcacaagaaaccaccaacccaaggccaacgatcccaaacgacagtcaaaaggatcagcgcaggaagcacaaggcagggcaagaagaattccacggggagcttccaggcagcagcaaccaagcacacagtccaaacaagccagcaaacaccaagaggaacccacacttaacaggaacaaccccaaggacagaagctaaccggaaggcctaccaacaccaaggaacacacccgggaacacacacttaccgcgggcagacagttggcacgcaacccacacgccacctgggtccctccctaacaccacggtcccggcggcatccacatcaacatcaggggctcacaacagtacaccaaggcgcggggcaacccaaccacagcggggcggggacagcacgggacctcacaaggatcccgctatcttccacaacaaatcattaaacaccaccaagggccggtgcaggagcacaccctggcacttccacaggtgcccccccatgctgtgacgccccatcagggcgaggctgtaccagccgcacaacaacgaaaccccccacgtggcgtgnacaagcacacacccgccccgaaacacacagcggcctcgcacacaagatccagtgaccagtgacaaaacagcagccacacacggcgcggcgaaaaaccacgagcaccgcaagaacaaacaccgcgccgagcagcgacattagatagcaacacccgcactggaagacgaacagatcagccgacgcaccaaaacgaaccacatacgtagagaccactcaagctcagaaccagacatagcaggccacacaaccagcgaaacaccgacaggatcaca

SEQ ID NO: 502694 - DNA, 269 bp, Homo sapiens
gaggcggatcacctgaggtcgggagttcgagaccagcctgaccaacatggagaaactccatctctactaaaaatacaaaattagccgggcttgggccattcaacgcctccgggccattcaacgcctccgggccattcaacgcctccgggccattcaacgcctccgggccattcaacgcctccgggccatacaacgcctccgggccattcaacgcctccgacggaatggccattcaacgcctccgacggaatggccattcaacgcctccg

SEQ ID NO: 502695 - DNA, 1255 bp, Homo sapiens
gagcagaagacccccatcagggtgcggggtgcgggttgctggctccacgtgtcgctggcgcgtcggatgcagggtccagggaagcgggatcgtcggtatcccaatgccgtcgcgtgctcgttcctcgctacccagtagctctgggtcggtgggcggcgtcgtgtagcggctggtgttgggacgcggggtcttgtgcgctgctggtcgccgcgggttgttagcagtagaatgactactggagacctgcgcatctagtgacccccgggactcactagttgtcgccgttgaggcctgtagagtctatccggtagacgcttgttgacccggggacctggtcttggctcgctgcagggacctgggacttgtggggtcagtgcaccagacgtgactggcccgggtcggtccttgacagcctcgttacgattgctgccatttggattgttcccatgggccagtcttcgtaaccgcgttggcgttgttgttcctttccgactccgtatccgaaggtggaatggttgcctgtaccacgttgggttaggttacgtagaccagaaacacaatgtgattggtacttgacccctttgctttatccctcaaggtaggtttcgcaggctgttggggactttaggtaatcggggctgtgaacatgcagaggaattcccattatttttctaacttcgttcctaggcgtttgccaccgagtaattcatgggcgtttccttctatctcaaaagcaatacagggacattggcctaagtacgttctattttgaagaatatcctgaagtccgttaattgagcagcgggtgggaccctcccctgaagaggtctaggataccgttggcgccacattacgtcacgtcggacgcagttaccacagagctgcgcatcacgatcggaggccaacagctttgggtggccatcggcaacccattggccgtacttcactatataaggggttccacattgcgacaggcaacacccaacgttggttttccacccaagagttacgtcttggcctatatggaggcctgctgccaacacgcggcgcacaaaaccccactttttccataagcggtcttccaccccagatgggaatccattccagacgacaatttagtgcaaacaccccccgtggcaacgttgcgctgcccgtcccgtaaacttccccacaatctcctttctgtaatacacaactgggttcctagccccgagggccccttcttctggagcctcttcataacggttcctgcgct

SEQ ID NO: 502696 - DNA, 390 bp, Homo sapiens
ccgcgcctgataaaaatgtgcaagaaaatcgccgtgcgccacctgcaaaaacaaggggccggcccttccctgcgcaaagaccctgacgccggactacaccataggctgcaagcgcgtgttgatctccaacgactactacccggccctgtcgcgcagtaacgtgcaggtggtgaccgacaacgtgcagcgcattgaggccgacggggttgtcaccgccgacggcatcaagcacccggccgattgcattatcttcggcaccggtttccaggccaccgatcccctgccccgcaactgcatcatcggccgccacggcatcgacctgatggacacctggcaagacggtgcccatgcctacctgggcacgacggtgccgggttatccgaacctgtt

SEQ ID NO: 502697 - DNA, 1815 bp, Homo sapiens
  misc_feature (273)..(273): n is a, c, g, or t
  misc_feature (277)..(277): n is a, c, g, or t
  misc_feature (1815)..(1815): n is a, c, g, or t
ggtgctatgctcctgacccggcaatcaccatgtggtgaatgcttttcctatcatgcggggcatgacagcgtgtgtccctaccttgggcccaggtctgactggcgtagcttcatatcgggtccggagactgtgggcattccaggctgaatgtgtgctagggtgaccgcagtcgaaactacgtaccatcggtgttgtgcggtgcggcagcgcaccacgctcttacgcatcactacatctcttcgtgtcacaatcagtgtgaatgtcactcgcgantcanactacagtctgacgcacgcggcgtgtctgagactaaatcttgcagcagtcagtcttcgcgcacgctcatatcagagtctcgggattggccactcgcaggcatcactgggcagatgggtccccccagtcacactggacacagaaacttctatacgactctcatgcagcctcgttatcacttcacccttgcgtgcataccgtaggcgtactgtgtttcgtgccgacaactacatcgtcattagtcacccctggtggaggtgccaccgtgaatgaccacgagtataggcgacgatgatggggaagaactacggatctgtgaaaccccctaccctccgtcttagggcaatgcggggaaattctccagcctacacgccatcgctccttgggaaacgccacgttcgccgaccaaggagcaccttataccacgaggtccttttcctccccggtgttaggctatcccctaacgaaggaccgtagttgggtgcttgcgccgtgccgtcaatccctggggacgtgcgtgggggccatttccaaactcttttccaacttccacctaggaaaactagaggtatgacctgccgacattctcatttcatagtataatcggcacccttcaatgtgggggccaattaggaggaccccacgttcactaaaaggccaatagagggagaactccccctttccttattccgtttacactcgcaaatggcccggcttcccccctaaaagggtttcgattccatgtgaccaagggtccccgtaggcggttttccgttacgcctcaccttttatcatactcctccaagtatttcccccttatggaacctcgggactcgtgcggacaaatttctcaaagttcaccttatagcgtaaactctaacacgtccaagggaaacgcgtgggtttgagcccctttctccaaattcggagcctggaggacacttatatccttgtacaagagagccccccccccgttactgttggcaccgtggtacggtgggaggcaagggccccgggaaataagtcctatatatagacccagatatctaggaacggttaaggttttcccttagagctttaaattgacccgaaggatccacatcccccattagtacagagcggcttttcaaatatataatggcctcttaaaatattccctgtgacctcccacgggcctctatccgagcaagagtaaaattccttcccgccggggcacttgtggtagcagcggggtagcccctcaccctcaccgtgggatgacgagcacccattggaacgacccaactgtcttcggcgatgaccccataaacgcggtttggtggcggtccctgaaagccctcttggcagatttccacatattggcgcgctctcggacaaagcggtaataatgcagcgccgagagggagagaacacctgggaagaaataaaaggcggataccccacgtacaacacggcgtggtacacgaggggaggacagaatatatcaccagagcgtggtcgtcagagaccagcgcggacaacacacgggaggggatgagn

SEQ ID NO: 502698 - DNA, 310 bp, Homo sapiens
ataatgaatcgtccagccactgtggagatctccatatgagaacatgcgtttatctgataactcacaaccctaccactgctactctcaacacgttcacacgaggcacttaagaagtatggagtgacgcctttggttcgagtttgtgatgctacatattatacagctccagcttgaaaaacgacacggaactcaccgtactagacttgagccatttgactgactggagcatcacaccaataaatcagactacgtcactacttggtataacacctgtataaaacccaactttcgagacgacgagggaccgact

SEQ ID NO: 502699 - DNA, 321 bp, Homo sapiens
tcatgtgcatagtcatgcatgacgatgcaggtgcagtatcatttccccccttttacaagtgagaaaccatagactgagaaagctcatccacaccccacgtatgcctgctacaaagtcacaggttatttacaccagatggttctcaaagagtggtaagcagaccaaaagcatcagctagtacgcaatgcaaatatctcaagcctccctatagacttcctcagaccgctcggaggagggcagcctacccacctgtgattcagcccacacccttcacggtgattttcctgacttctacagtttgcgaaccactgctttacccta

SEQ ID NO: 502700 - DNA, 213 bp, Homo sapiens
acctcactcaagatcgcaataactggtggggcttcgcccacctcttcttccctaggtcaaaagccactatcatctgatgtgttagggatgggactgattggcagaaataaatcagctcccaatgggagcccacgggaactaaagtagggtccaagaaaaacaaagggagctattccacagagctgaccttctgcccaatttcattcctcaaac

SEQ ID NO: 502701 - DNA, 220 bp, Homo sapiens
tccttgtccaatctcagaaggcatgagtggttagctctgagaaacccatgaaatacctaccccagctttcagctgtgaggctcactaagcaagatggtcggtcctgcatccaccttggcacagttttggggcaacctgacccagatctccaagcccagccagccacgggtgccctggggcagagctcaaggctgaccccagcggaccctgttctcccgac

SEQ ID NO: 502702 - DNA, 125 bp, Homo sapiens
ggtcatttgggtcaaaatttttttgttttattttggttttgattttttttttccccccctgagggtatgcttagttgttgagtaaaaaaatttgggcccattaaaactttttttgatgtaatata

SEQ ID NO: 502703 - DNA, 119 bp, Homo sapiens
agaatgattgcgtgatgaatgaagtatgaactgagtcatggtaagcagatattgatggtgatggtcaagttagactatgaagagtttgtacaaatgatgacatgcaaagtgagaggcct

SEQ ID NO: 502704 - DNA, 1143 bp, Homo sapiens
gatggcggcggctgtaggggttcgtggccggtacgagctgctcggcttggctccgggccaggtctggctcctcagctctttccgccttgctgtagtgtggcggcacgaggggccttcgggcgactacgcgactggtgatcgtcacggaggacggagaaaatccgagcagctaggtggattcaccaattgaacttgcaacgcatcctcatgacctagtcatattactgagacaagaagcagcagtgaacctacctcaaagaattagagaagcaattaggttgctcaaaaaattcacatagaagagaatgagggacgaggagagacatggactggagacagagacagtaatcacagaacgacccagactgcagtcaaaggcaaggtgcccgttagcgggacctggatctatactgatggcacatacataactttggagacgcaaagacatcagtccgtgaatgattatatagacacagaatctcctgtccctccagacccagagcaacctgatggtactaagaattctagaacttccagtatagtatacatgcgttgtcagcacttgagaggtgtacaggagagagttaatcttgctgcacctactggtaccttaacagaagatccaatcttcaacatatttcatcgtaaacgggtaggcaaggagtcatagaatgacataggtcgacatcattcatgacgggcctacagaggaacactttcctcgtgcggtactggatacacatgtgttcatgtcacactgggacgaattcagaatgagcatcatcaagggtagctaaaatgttgccactgggagcaacttagattcgtactccagggcagcacatataaaacattgcccgggaacaaacgctggcacaccgttcttcacaggaaacacacgtctatctagataataggcggagcaaaggggccccaggacacacccgcgaagaaacgggacaaactcgacaacgcggccacaaccaggcgcggaaaggacaataggaacgacgacagaagaaaacaacacacacagagccagcagaacccacacatgtgaacacaaaacgcagcgaaacgacaaacaaacgggagcgaaggaacagaccaaaacggagaaaagtgagccaaaagcacagaaac

SEQ ID NO: 502705 - DNA, 114 bp, Homo sapiens
cggcagtgcgtcagtgacgtgctactctgcgttgattctcttcggttgtcagcagttcggcgcgtgtgcgcgggcccacgagccgtgtgcagccagttccactcgtcacgccgg

SEQ ID NO: 502706 - DNA, 304 bp, Homo sapiens
ctgccgccaggaccgcatgaagttcagtgctccatatctcatataaaccttatagttttagtagttttaatttcagccattctaactggttatactaacattatggctccaacctcctaatttctcatgatacaccattaactcagacagtcaaacaggttatccacgtttcattctcattaaactgtaaacggtttaaaactttaaaactagcactggacagcactgttagcacttgttataaaacttattcactgcctgctctacctactccatatcattcactccttctatcccgcatatt

SEQ ID NO: 502707 - DNA, 264 bp, Homo sapiens
agagggaggagaaggagagagaagagaagaaggaaaggggaggaagggggggagaagaaaagagagagaagggaagaagagaaaggggagaggagaggagggggaggagagaagaagagagggaaaggaagaagagaaaaggaggaaagaggagaagaggaaggaggagagaagggaagagagcacaagcacacgctcactctctctctctctctctctctctctctctctctctctctctcctcgtgcagaattcggcacgag

SEQ ID NO: 502708 - DNA, 944 bp, Homo sapiens
  misc_feature (285)..(285): n is a, c, g, or t
ggaagagacattcatgaacaaaggaagaggtaagaggtcaagattgtgtcagctgtctgcagctgagaaggatgccaggtcccagttccagctccatggaagatagatgcattgagctccaccacagaattggatgggcactcaggaagtagagaaagtgcaggctccaggccctgtgaaggaaattggcccatggttcacagtgaggcagaaggctccagtgagtcagtttgtcgtggctgctgctgaagtcccgtagggtaaccgactcgaattcttcccagngattcacggagtcgagttccagaacaaatccctgacagttacaagtggtgctagtcctgagagaactagcgacctggtcacaggactatactgacctggaggtcacgggtgccagtacccaagcacgtggtgaagggaaacgcaggtctcagtggcccttatcagcagctccattcgtgtggccatgctggaggacaagatggggagcgcgtcctcatggcaagggaagctcacccaagaagatcaacactgagagttctcgtctggagtctcgtagcccgggaagtgcgtcttggtgaacctgagcaaggtgggcgagtatcggtcggacacgccatcctggatcgcgagaaaggagcccatcgtagattgagcaaagatcacacaacggagctgctcgaatgtgcacctgtgggatgagtgagggactcagtgcggtgtttggcatcaggtcttaccctttgactaatctagccatgacaggctgcataggcgaagactgagaagccaatgatgctgaaagtccattgtacattcttgaagatcggcgtggcaatgctgaagggttctcaccttccgagggccaagcgaattggaccctgccaggttcaaacattctcccggggggctagtcacggttataatgaccagaaggcaag

SEQ ID NO: 502709 - DNA, 1045 bp, Homo sapiens
agcgggctgcgtccgccgtggagcggcggcgcaggcggcgaccgggagcgcggacaacgcggctgcggctaacccgccgcccggccggctgagaccctcgcgcccctgcttcctggggcccccgccccccgtcgccgtcgtccggcgctccttccatcacagaactccccggggacgaccgggacctgtccctgtggccccaatgccattcccggatgctccatcccatcgtcatccatcagcactcagccttctctggccattgggcgtcccgccgtgcgcggcactcggcaatgggcacattgcgttcccacgttcccggtggaggcaaaacggtatccattaggagattacatgataaaaggcctgcatccagtattccaacaaacgagcacgacatgccggcagccctcacgactaggagagccaacggttccaccgggttacacattcattacaccagtggagcccagttccctgtacccgtaacaccttacacaatggtgttacccgttttggcgtgaacagccggcccttggcgccgctaccgggggcgcgaacgggcgacgacgcgactagcgtacccacgtacacgaaggcgcagtccaattgggcgcaggaccccgggaccgcggccgccgagacggggaaaacaggggcagggaaagacaagagatgaccgcaaccaacgaagaaaaccccagcagacgagcacaaaccagagtgggccaagcggtatagagacagggcacaggaatgtgacgcgcacaaccacctatgttcaaaaggagcgcagacagaaaccaattcccagaggccacagcgaaacatgggtagtggaatatatcgggccctaaggcaatcaggcaattctgattgcgaccaagacacaagatatcaagggctgacgacggcaatcagacacaaggggcccttgagccagtactgggggacaccacagcgatgcaaaaggatgagttggcccacccacgaaacggatttacggcggcccattggccccggcaggcacgtttcgaacgccaca

SEQ ID NO: 502710 - DNA, 202 bp, Homo sapiens
cagcacgaaggcgttggggcgcagttgcggatccagaagggcataaagtgagctgaacctgccaagcagtgtgatatcagcttctcagatccagacgactcctaaattcaagctggtcatctgtcctgatgagggcttctacaagagtgggaagtttgtgtacagttttaaggtgggccaagggttaccctgcaatgatccc

SEQ ID NO: 502711 - DNA, 124 bp, Homo sapiens
cgttcaagctcaacacccactacctaaaaaatcccaaacatatatctgaactccttcacacccaattggaccaatctatcaccctatagaagaactaattgttagtattagatcacatggcggt

SEQ ID NO: 502712 - DNA, 364 bp, Homo sapiens
  misc_feature (24)..(24): n is a, c, g, or t
  misc_feature (52)..(52): n is a, c, g, or t
  misc_feature (56)..(56): n is a, c, g, or t
  misc_feature (187)..(187): n is a, c, g, or t
agaccaaaggccgcccccgcctgntggggttcctcccagcaccccagcttgntggntgccctttttgccttttggcctccagttgggtgtgggggggcggagcaaggcgggggacaaacgcagcccctttttagcgatttaggcctggcaaaaggtttggccccaagggcctccttttcccaggggntgccaagtcctggccctggccctggcatatcaccccgcactgtggggccaggcaccactagcctggttcaaatattccccagggagactgttgtgtgctgcccgcctgcctggtggttttcccccagccccacatcccctttggaaaagaatgtaaaataaacctggacccaaggga

SEQ ID NO: 502713 - DNA, 881 bp, Homo sapiens
cacgcagcagctgatgcgggtctacggtgccctcatgtggtcctagagcaaggtcatcagcacgcccgaggtactgagcgtctacgtggctccttctgggcgcagccgctgagaacacggacaaccgacggctcttcgagggctgaggcccaggtacctcttcagagacatccagagcctcccccagaatggtcagcggtgcgccagctcaagagctcatcaagcgaggcgaggctggccaaggtgtgatgcctagcatcatacagctagctgatgaaggagatgccaagtgtattcggaaagggaaagcaagatgagagagcttatcagcaggatagcgggacactctaacttttcaggcgtactcgcgacgatagtaccgagagtattctgcacggggaacgtgcccgtgaagcgtcgatggctaatgcaaggaacagctctgagaactatgacatgtcaccagaatatccactcgcttgagacggcccaaggcatgatctgagggcatgtgggacaagaatgcttgagcaaacaaggatcattcgcccctttcatagacaacctacagtcaagcaccagagtagtgacgaaccagaagccacggcccaaaggccatggcattgggtgtgccatgggccgggcacgccctgttcggaagtggggacacacaaccacggtagggggggccccccgtattccaaaaacacaaggggaggcataacagggggggaaaggggggttgacccaatagggacagcagcgcctgcccataaccagaaggggcacggcaacgctgcggagattcgatgagatccaacacacgatacaaaatgccccggttatagcagaacagaacgcggcactgcatacagcatctg

SEQ ID NO: 502714 - DNA, 340 bp, Homo sapiens
tagaggatcccccttaaagggcacagaaattataaacttctgaaatttatggagagtagtcagcagctcagtgacctaagcataatatatctcatttgcagagctatgtaagacctattgagtaagcttatttcctagtatgtttaatcccactagaatagaaagcagattaactctaaaacatgtatcctatttatgtatcctaagaatttacatcattcgaagaatatcttcatttacttatatctctatggtcctgtcagggtgagaaatttttgagtgtttgattggttttcaagcacactaactctcgggtgttctaatttctgtgcccttttct

SEQ ID NO: 502715 - DNA, 182 bp, Homo sapiens
tccagctggccccatggctccctgttgtgaagaattccatcacgaagaatcaatggctgttaacacctagcagggaatatgccaccaacaacaatgaatggggatccgggcgtgggacgaacctggccaaggaactcaaagacggcagacatgggacaccatcgactggaaaacaatattta

SEQ ID NO: 502716 - DNA, 357 bp, Homo sapiens
ttccggcgatggcacagagaccctagggcaactccaccccggagtacccccaccaccttcgggcaggcactagtcggggcgactatgctgcgcagatgaggctggtatgttgcaagcatccccgggaataaacttgcgtgaattatttcgttgtctgtatcaggtagcacacgcaacattgttccccaccacggttgcgggggagagatcacccgtttgttcacaccacttcctgcgggcgggtagagcgagggaagtatctcactctatgaacaagggggggggagggtcaccacgagaggcgggacgtcgcccgatcccccccccgggggccaaggatctttcgccccaacaaga

SEQ ID NO: 502717 - DNA, 659 bp, Homo sapiens
tgggcgacgaagctggcccccgaggccccccggtccaacgaaatggtaacaaaccggcccaggccttacggtcagctagccgcaggccgctaacccccgtgaggaggcaattgcaggtaaactgtttgctatatcaggtggtaggcaacagaaagtacacgctgaatactctgctcaaggccctgcggtgtttgtacttacagaagtacgtgttataaaaggcaaagtcttgttttgtaatttgtggatgttacattttgatatcttgttgtacatgattgtatagggtcagccatgtatgttaatgatactcggatcgaccataagccagccttcggagcgttactctgtgcctagctctctgactgttgacttgctggtggtggagccatcgttgcattatgaatctcaaacggatgaaaaaaaagccttgtacacaaaaaagcagtagatactgacaacagagcaaagccgaatcttacttgccgagcattaccagtaactttttgtgtgtaatgtacttagctggactataagtagttgggcttgaatgagatggttaaaaggccaaagataaaaggtttcttatagatgtcctatctttgtctatgaagttgctggttatttttttggcaatgtctgacgactgtgtgaagcaa

SEQ ID NO: 502718 - DNA, 262 bp, Homo sapiens
atgcatatgtatgcttcaccaaactatggattatgacaaagaaaatgtatataatagaatagggggagaatattcgcaactctccacagtacagatttgactggtatcataagatccagaactgcaatggagctccagaggagatgtaataccttaattactttgattgaaagagaaaacatggaactagaagaaaaggagaaggcagagaagggagaaacgaggaccaaagccttcaacacaaatgcatcccactgggtgg

SEQ ID NO: 502719 - DNA, 193 bp, Homo sapiens
gattctgggcttaccatctagaaagaattctgcagacattaccaatgaaaggagcctcaaaatcttcttcatagactgatctaccttcgagacctaaaatcattgaacatctggcaagcatttcttattgcgcctctgtctacgacttctcctttccgctctcgttgcaatcatatccaatagtttatgctgt

SEQ ID NO: 502720 - DNA, 104 bp, Homo sapiens
tttcccggatgaaaaaccccgtttccatggttttgacccttcctttttcccggctgtcaaaactgggttttttgattttgcccctacattatgcctctgtggga

SEQ ID NO: 502721 - DNA, 508 bp, Homo sapiens
  misc_feature (21)..(21): n is a, c, g, or t
  misc_feature (26)..(26): n is a, c, g, or t
  misc_feature (65)..(65): n is a, c, g, or t
aggaacagcgggtaaggcccncaggnaggagcacctcagccggaggggagaaaaacgggaccagncccatccacaacggcaggttcttccagcacgtatggacagagacaatgaacggctggtatgtgtggcactctttgctcctgctttaaaaatcacactaatatcattactcagaatcattaacaatatttttaatagctaccacttccctgggcacttactgtcagccactgtcctaagctctttatgcatcactcgaaagcatttcaactataaggtagacattcttattctcattttacagatgagatttagagagattacgtgatttgtccaatgtcacacaactacccagagataaaactagaatttgagcacagttactttctgaataatgagcatttagataaatacctatatctctatattctaaagtgtgtgtgaaaactttcattttcatttccagggttctctgatactaagggttgtaaaagctattattcca

SEQ ID NO: 502722 - DNA, 953 bp, Homo sapiens
  misc_feature (177)..(177): n is a, c, g, or t
gttctgaagtgaggggctggcttgttgtgtgtccgctcgcccccccggtggctgtaaacggtggggcgccttattattatattttggccccacacacccctcggtttggtgggcctgatttgttcttctgttgttgtaaagacggtttggtagtaacaaggggtgtcgttgtctgtnttccttgtgtgcgggccccacacatttattttgtggtgggggcgtacttttttctggtggccttgctttttcttcccgccgaggaaccgacctgtattggttttctctctctcgcctctctgagtatagggttcgtcgcccccctctacgattagagtgatcgtcctcccccgtccggggtcgccccgtgtgggtgattacctcccccccgaaagagagaagtgtgcgggccttttcttctctcagcgaccgcctctctatgcctccgatgcgtctgtcgttgtgggaaactactatatgttgagagagcctgcttcgatttttgttggtgagaattgattctctcttttgttgttctctcaccacagacagaaagaataccacctctgtgaggagacaccacacttttgtgttgtttcgctctcgtccgagggtggatactcgccccctctgtgtggatgtctttgggggcgctacagagaagacactctgttgaattactcacaatcatggtgggtgaatactatgttctgttcctcgtcgtgcacccttctttttgttgatgaagattatttattggtgtattttgctgtgggggggaaacacgtactcctcctccctctcgaaaatacattggggtgtcacgccgaagcagtaacccccccgccgtatcgtgttttttgattttttttttttctccatttttttaaaaatttttttttttttcaaaggattttttaaaaaaaaaaaattttccggaggtttttaccccgaca

SEQ ID NO: 502723 - DNA, 1037 bp, Homo sapiens
tgccatggctcccagtcattttggaatagtgcccgctgcgggtggatcatctgacgtctcttgagattgctgggattggcatggaaatgagccactgtgaccggtgtgggcaccactttatttgaaggtatgtatcagcccatagctaaggtgttcgcctctaggaggttcccaatcgaagatgtgaaatggatagggatctaggaaacaacacactgaggacttctagtgaagactatcttataacatgaaatctagatgcgtactatctgtccactacttgaagcatagtgctaggatctgcacgtggaagccatatcatttctacaaattactcgcaatatgctctagtccatatagggtaagaaagtaagcttcatgatctctttctggtagtgcctccacgatgctgactttccgactaccggggttgaacattccccgacggagggtcatgagtcacttgatcgagaacacgtcttcacaaacctagggaaggcgtatgcgctataaataggaggcatggatagttctttgctctaaagcatactgaattattacctttatgactggcaacctctatctaggttgaattccactgatcaggcaacatgtatgtatgcctgggggcccactcattcccagaaaagacggacctggactcggaatgtctggcttatttcgcttcaattctatgattggcacattatcgtcgtgagtcttcaggccttctagagtaccggagcccgggagggatcttcgggggctctggttctcctaaaagatcccatgagttcatcgtatttacgacgtggctagggatctcgctgtagtacggcccatggggatgaaggcgctgtaacggagtggaaagtaatccacactatcgtgtgatactttgggagctggaacgccgtttgcccacaataagctgggtaacgctgggtacacaccggtgccatctaagtgccccatacacggtccaattctgcgtgttccgttttccccagggctcccggataactttagaaccgtct

SEQ ID NO: 502724 - DNA, 157 bp, Homo sapiens
gcctctctgttaactacagcagagttgtagtcacagaattctaaagagagaggacctggatggtgcatggtggatggaggtgtatggagtgcatgtctactctagactagtgcttaccttatatgactgtacagagccagcagtgtctaccatactc

SEQ ID NO: 502725 - DNA, 230 bp, Homo sapiens
gtcaaaccaacaacactgacttatgggatcattaaaaagtagattagagttagaatcctagagttgggattttgtcttaaaataataggatgacaaaagtaattaagggtaaggtttagattgctattggaaaccacgggagggcctgggccctgtgaagaagatacgctgggcctcactgaggtccacgaatgaaagattctgtcctaacacataggagttggcctatg

SEQ ID NO: 502726 - DNA, 936 bp, Homo sapiens
ttcttggaagaagtcacgtctgagggtgtacgttcggatatgatcatgcgagattgaaaaagatccaagccaggaagatgggcttgaacccaaactgcattatcagtgagtacctatgcctgcagaggatcagctgtagcatcctaataggtacagaggacttgctggtgttaagtggatttggtcagcgaagatttgatggagaaaactttggttgcatgctggtttccgatttgggagcatccgagtcgcgggttaacatgatcgggagattccttagccgttttagaactcggtggttgtagctctcatttttcttcccgtcatcgtcccgtccgatctccagaacaagccaaagagcgaaccaggagaaggggccccaagctctggatattgaggaaccccccaagagtcacgtaaaaacccatcaacaccagttggctaaggctggcccaaacaagttcaagaatctggctccttgtgaattgtgggattgggccttcggagcctggtcttaaagaaaggagcaggccattcaaatttgggttcaacgggaatgaagccccccaagatattacttgtgacctttcattgaaggaccaactgttccagagattccaagcctaccaaggctcgtaacttccaggacgctgactggactctctcattcaaatactgggtccagctccttcggcgcaggcagggttacgtggtcgtggcgcctggtatccagccagtgcccttcacggttccttcgggcctaggcgagcaggcccgtgctcagcaggcggcgtgattgtggctgcattgatcgttgtgctggacagccgtgtccaagcaggcgggtcggccgaggttcggcggcggtggcccgagtccgaagctcgtcaactctgttcgccaccggcggaggtgccccgggagtgggcgcacctt

SEQ ID NO: 502727 - DNA, 185 bp, Homo sapiens
gcgcgattccctggcctccccctgcggacagtgaacctcgccgagggtcaataaagaagattttgccctctttttctcacctctcagccttatgatccatggtgcccttccatggcctttcatgggtgccgaaaccgggaggggacacctcttaagcccccccagaggctcagggggactcccct

SEQ ID NO: 502728 - DNA, 1137 bp, Homo sapiens
  misc_feature (58)..(59): n is a, c, g, or t
  misc_feature (82)..(82): n is a, c, g, or t
  misc_feature (245)..(245): n is a, c, g, or t
ccctaaggccctttgggctcattcagctcctctgccagggagcccagagatggcagcnngggagcaggggtgagaaggtgangggggggtattggcagaagcgtggagctggagtcagaccttccttcctggctctggcactgagcgtaagagcggctcctgctctctgactttggtttcctgttggtgccacattggcgcggggccagaagctgctgagcagttttcacttctgcgtctcagcnccggtgattagctggttggccaatatccctgggcagcctccccgctgaagcctcttccccctcgcagagtcagggggcgctggccggcaggctgcggagcttctccatgcaggacctgcgctccatctctgacgcacctgcccctgcctaccatgaccccctctacctggaggaccaggtgtcccaccggaggccacccattgggtaccgggccgggggcctgcaggacagcgacaccgaggatgagtgttggtcagatactgaggcagtcccccgggcgccagcccggccccgagagaagcccctaatccgcagccagagcctgcgtgtggtcaagaggaagccaccggtgcgggagggcacctcgcgctccctgaaggttcggacgaggaaaaagactgtgccctcagacgtggacagctagggtctgctgcatctgcccccttcttacctcgtgccctgcagggctccagggctatttggagggaccttgggctgcacatctggcctgcctgcaccagctgcctgggccccaccctcctgactcctgctgatggttaagggccgggagcagatgctgccaaggccacatgcagggatgcacccacaatgtaccaaagcaggctgggcccagggttctatttattgccttgctctgccctctcccttccccggttgtgggacaagagccctccctgaacccctgcaaccctccctgaacccctgcaaatgaaaccaaacgtccacctgggtgtgttcattccttcctgtccttcaaagtacttgatagcctttcataaggcctggcacatgtgtcctggttgtgtgtgtgtgtgttggtgagtgaggtcaggtttgcgagtgttttgataaataaatacataaaggggca

SEQ ID NO: 502729 - DNA, 760 bp, Homo sapiens
cgacctcatcagtgagctgtccctgctggaggagcgcttccggacgtgcctgcttccccttcgccttctgccgtgattgtcagtttcctgaggcctccccagccacgctttctgtacagcctgcagaactgtgagtcaattaaacctcttttcttcataaaaaaaaaaaaaaaaaaaaaaaaaaaaaaaaaaacgaacaaaacagaaaaacacaaaaaaaaaagcacaagaaaagcaacaaaaaaaagtaaaatgaagaaaaccaaagacaaagaaaacgaactagcaagagcggagagggcagtcacaagagatagctagactagaacacaccatacaacaagaggcagcaccggagcgcccgcgccgcccagctatgacatcacgcggagccgggccggaagtaaccactcgtgaaccacgacgcacccacctcagcccgcccataggaaagcggataccgacatgcaagcggggagacatcaatactccgataaatggagcagctctgagcacacgccaccacgcgcagcatgattacttgaccgggtaacgtgactccaacctccctagttgcgccggactgttccgaaacgacaggtaactgcacacctcgcccccaccgtgcagctgacacgaaggcacgcaacaggacgcgaaaccagctgccgacccccccgactactatcctggcagaccgaacacgaagcgcggcaccgatacacacaactacccgacagacggtaagaaacacgcagaa

SEQ ID NO: 502730 - DNA, 136 bp, Homo sapiens
acgtgtactggttagggaaaaaaacaaaacgaaaacattccaaatgcatgatccagctgtgtgtttccactccttgggagggtgccatccacattttaacagtaccggtgcctgagaatataattttaaaaacgac

SEQ ID NO: 502731 - DNA, 1090 bp, Homo sapiens
  misc_feature (49)..(49): n is a, c, g, or t
  misc_feature (67)..(67): n is a, c, g, or t
  misc_feature (72)..(72): n is a, c, g, or t
  misc_feature (79)..(79): n is a, c, g, or t
  misc_feature (96)..(96): n is a, c, g, or t
  misc_feature (98)..(98): n is a, c, g, or t
  misc_feature (117)..(117): n is a, c, g, or t
  misc_feature (123)..(123): n is a, c, g, or t
  misc_feature (146)..(146): n is a, c, g, or t
  misc_feature (159)..(159): n is a, c, g, or t
  misc_feature (169)..(169): n is a, c, g, or t
  misc_feature (172)..(172): n is a, c, g, or t
  misc_feature (178)..(178): n is a, c, g, or t
  misc_feature (181)..(181): n is a, c, g, or t
  misc_feature (184)..(185): n is a, c, g, or t
  misc_feature (187)..(188): n is a, c, g, or t
  misc_feature (201)..(201): n is a, c, g, or t
  misc_feature (203)..(204): n is a, c, g, or t
  misc_feature (220)..(220): n is a, c, g, or t
  misc_feature (225)..(225): n is a, c, g, or t
  misc_feature (248)..(248): n is a, c, g, or t
  misc_feature (255)..(255): n is a, c, g, or t
  misc_feature (261)..(261): n is a, c, g, or t
  misc_feature (267)..(267): n is a, c, g, or t
  misc_feature (273)..(273): n is a, c, g, or t
  misc_feature (279)..(279): n is a, c, g, or t
  misc_feature (296)..(296): n is a, c, g, or t
  misc_feature (298)..(298): n is a, c, g, or t
  misc_feature (311)..(311): n is a, c, g, or t
  misc_feature (313)..(315): n is a, c, g, or t
  misc_feature (336)..(336): n is a, c, g, or t
  misc_feature (338)..(338): n is a, c, g, or t
  misc_feature (352)..(352): n is a, c, g, or t
  misc_feature (377)..(377): n is a, c, g, or t
  misc_feature (394)..(394): n is a, c, g, or t
  misc_feature (408)..(408): n is a, c, g, or t
  misc_feature (416)..(417): n is a, c, g, or t
  misc_feature (421)..(421): n is a, c, g, or t
  misc_feature (424)..(424): n is a, c, g, or t
  misc_feature (462)..(462): n is a, c, g, or t
  misc_feature (489)..(489): n is a, c, g, or t
  misc_feature (510)..(510): n is a, c, g, or t
  misc_feature (513)..(513): n is a, c, g, or t
  misc_feature (515)..(515): n is a, c, g, or t
  misc_feature (547)..(547): n is a, c, g, or t
  misc_feature (559)..(559): n is a, c, g, or t
  misc_feature (582)..(582): n is a, c, g, or t
  misc_feature (598)..(598): n is a, c, g, or t
  misc_feature (601)..(601): n is a, c, g, or t
  misc_feature (623)..(623): n is a, c, g, or t
  misc_feature (632)..(633): n is a, c, g, or t
  misc_feature (639)..(639): n is a, c, g, or t
  misc_feature (642)..(642): n is a, c, g, or t
  misc_feature (652)..(654): n is a, c, g, or t
  misc_feature (658)..(659): n is a, c, g, or t
  misc_feature (664)..(664): n is a, c, g, or t
  misc_feature (672)..(672): n is a, c, g, or t
  misc_feature (675)..(675): n is a, c, g, or t
  misc_feature (679)..(679): n is a, c, g, or t
  misc_feature (688)..(688): n is a, c, g, or t
  misc_feature (729)..(729): n is a, c, g, or t
  misc_feature (731)..(731): n is a, c, g, or t
  misc_feature (734)..(734): n is a, c, g, or t
  misc_feature (757)..(757): n is a, c, g, or t
  misc_feature (760)..(760): n is a, c, g, or t
  misc_feature (783)..(783): n is a, c, g, or t
  misc_feature (800)..(800): n is a, c, g, or t
  misc_feature (804)..(804): n is a, c, g, or t
  misc_feature (852)..(852): n is a, c, g, or t
  misc_feature (867)..(867): n is a, c, g, or t
  misc_feature (889)..(889): n is a, c, g, or t
  misc_feature (899)..(899): n is a, c, g, or t
  misc_feature (912)..(912): n is a, c, g, or t
  misc_feature (934)..(934): n is a, c, g, or t
  misc_feature (944)..(944): n is a, c, g, or t
ttttgccccccccgggccccttaaccccattttatccccccccccttcnaaaccccgggggaagggnatccncaagggnggttccccccaatcccngngagggggccccaacccccnattttngggggtaatccccgggggtcccngggggggggcccnttttcatggnaancaaggncgnatnnannctcggaaggggantnngaatgttttttttttntttcnatgtatttttttttgtatttttntatgtgnacactnacccgngtgtcngacacngggactctcggggtccncnttcgcaggtatgnannncacacacacggatactttctntntcattgacacattnatggacacgggtcgcttgcggtgtnacagattgaagggaaanagacacatacactntttgactnntganggnggtctaactttaccgccgtctttctctactgtatatgngtttacggtgaacgtatggtatataanagtaacttgtggacactctcncangnatcgtttggtaacacgacataagtgtgttctntgacttgacatntcgtctcctcctcttttcttaanctctctcgtatgctcnctnacatggtgacttcacatggggnctaattttnnggaggngtnttctctttgnnnactnntaacntttcttgnacngtgncctttctantctagccggtctcgtggtgtcttcctatctctctttttgtncntcnttgtctgtatgtgtttttgttgnctngtgatcagtttgtggccaaggtncatttgtgtatccattngtcnggccgttggtctcttagggtttcttttttatttgtccttggctttggnccttcttctctttcncctgggtgtggtgattttagcntttttttttnttattattccttnttggtttttatttttttttttntttttttttntttgggtgtgttcattccttcctgtccttcaaagtacttgatagcctttcataaggcctggcacatgtgtcctggttgtgtgtgtgtgtgttggtgagtgaggtcaggtttgcgagtgttttgataaataaatacataaaggggca

SEQ ID NO: 502732 - DNA, 1109 bp, Homo sapiens
atagacctacgggctctggagggtgggggactggttaaaacacatgcaaacaaaaaaaaaaaaaaaaaaaaggcaatttgtgtgttttttattacccattttataatttttattataaaaggttgtggaatgtgttccagggtttgtaaatgtggggccgttgtgtgaaagcatataaatataaatatacatggtgaagagtatagagcccaaatagtgaggatttaaatttatagtgggggagtgttatatttgtccccctataagaactcgtgaaagagtgtgaaacatatagtatatggggtgagaagttaaatttattacaagtgtgtttaaagacgatttttataatgtttcctctataagaacaaatttgtggggaaacacaattatattaatatagtgggggcatagcttgtgtgtgccccgttgagattataaaatatagtgttgtgaacgggcatatagaaagagggcgcctatcacagggggtggtttatatcttgatggacacaaaagggagagtgttgacacaaagagtatattatatatgaggcgtttgtaggaagaaaaaaagggtgtttgttgtgtgggccaaaatttctttatagagaaaaaagtaggaagcggcagaaatctattatatgagaaaaaatttgtgtggtgggggggagaaatttctgactatcaccggggtgtataaagaggtggaagacgtgatgattctgtgtgtgtgttggagacaaatattttttctatcccccaaaatatgtctctgtagcacacaaatgctgtgtgggttattcttctgcccagaaagtataatttgtgcgaaatatacaagagggtgaagtgtgggtgctggaagacataatggaacgttttgaggaaactaccgttgtttatacgcagatttaaaacttaaaagggtggtgtagagagagaaaaaaaaccgcggttgttagtgtggcacaaagggtggagaaatcgtcgtgtcacgcgataagatttcaagaggtttaaagagggagaatgtgtgggacaaaagaggtggtcgcacgacgagaaagtgtagaattggtggccgttttaggaacaagtggaggaca

SEQ ID NO: 502733 - DNA, 726 bp, Homo sapiens
gcaagccggagccctggggttgggcagcactcggttccgtgcaactttcaagtgagttgcgaactccgccctgtaggccggtgctggtggcccggcgcgctggaaccgcggcgacccgctccagcgcgggaccagcagcaagggccgagcgccaggttctccgcggcagaaagggcgggtgggagctgtaactgccccggccgcggggcgcgcccgctcccaagtcggcttcctccccgccggggccgctttgcctcgggtctccccattctccaggtcccctgaactgcacagtcggaggccgtgggcggcgggctctgcctccgccgagggacagccggatcgcccctctgcttcccgcaactgccctgatcaccccccgtcccagcccttgagtgaacgtccttctgagcggcttcctggggtcctccccacgtcccaaaggccggcaagatggtgtcctggatgatctgtcgcctggtggtgtgagtatggccgccctcagacctcctctaccccggggtgccgtcccgcccctgtggtggaagctgtggacgtttagtgggaggaggaactttttgagctccaccctccagcactccatgcaagggttaacggacctgtgggcttgcacgcggtgtttggggcaccgcaggctacccgcccccccaagcctcgttggctgagaacgacccctgccgcacgccacacaccctgcaaacatta

SEQ ID NO: 502734 - DNA, 132 bp, Homo sapiens
tctgtggctctattcaggtgactctgtcctagtggcagatgagatgagtgctacccaatgagttgttgtggagcctcctgcctggtggatggtattggagggcagagccacatggagtgtgagaccatgtga

SEQ ID NO: 502735 - DNA, 614 bp, Homo sapiens
cgaggaaaaccgtgtgctattagccatggtcaaccccaccgagttcttcaacattgccgtcaacggcaagcccttggaccacatctcctttgagctgtttgcatacaaggtcccaaagacagcataaaattttcatgctctgagcactggagagaaaggatttggttataagggttcctgctttcacacaattattccaaggtttatgtgtcagggtggtgacttcacacaccataatggcactggtggcaattccatctatggggagaaatttaaaaattataacttcatcctaaagcatacggatcctgacatcttagtccatggcaaatgctggacccaacacaaatggttcccaatttttcatctacactgccaatacgtgatggttggatggcaagcatgtggtgtttggcaaactgaaataaagcatgaatattgtagaggccatgagacactttggatccaataatggcaccatcaataacatcaccattactaactattgacaactccaataagtttaacttatattttatcttaaccaccacatcattccttctataactcaagcacccctgcaccccattacttccagtatcctatttttatcg

SEQ ID NO: 502736 - DNA, 1015 bp, Homo sapiens
  misc_feature (603)..(603): n is a, c, g, or t
agcgggcagcgcagcccgcagaagcacggtcagcgcacgtgccctgcgagacctgtcaaatcttgtgcctagccggctctgcccgtcccctggggatgcccgaacgccccggcagccctcacctcctcccgccagtctccatgccatagtggctgctttgagtgctgcgagtcagagtgtctggcgagcgagtcccctacgcctccctggctggccacgcatccgttctgcttctccagaggggtggccgttacttcgtgccggcgtgtgggcactgttgtgcttctctggcagggcatcgcagctggcgacttcttgatcgagagcatcgatttctcgcagcgcatacagccaggttgacccattgaccattgcgatgaagcagaagcgtagactacacacatttgacgtgcacgtacttgttcagtcctacttgggacacctttgccgtcgcattttactcgttcttatagatacttgcggacatcgattcctggttgggccgcaacgggccttgttaacatacacatcataggtgccaaggcttgccacacacgaatcttgtcaacgagtgacgcttctcagaacagcaatactccgtcnttctggttgggacccggaatggccattcacgctgggggagatagttgcagctttgttgcacttgcaacacttgatagtggcgtactgcgaagagttggccctgcgcttggggtcgttgtggcagcgtagttcgttcgatgcggtgtagcccccaggttgtactcattcggtttctatcaaaccactatttgggttccagacttttgttagacacgttcgattccaagtttcaacccgccaggaacgcgaatcgcggcaaccacccgggtgtgttcggcatgcaagcatcctggttgttgtgcacttagtcccggacaaataagcgagtgaattccattgtcccttttggaagaatgcctctggcccccgcgaagaacagtaatggtgtggttccttgctccctgggagaaac

SEQ ID NO: 502737 - DNA, 298 bp, Homo sapiens
tatgaatgaagtgacctcacgtcccgggggtggggccgtctgaaccaggcgcggtccctgcagacagcgttctggcttccagcgagggtgtggccctgggccgctgtgggtgggcccatagggcctcatacaaagtcgcgccccaaggggctgcacggataatattcagggggctgcactcgcccagagtcacttgtgtcaaagcaacgatcttctcttacttctcttgaagaaacagcgacatttgttttcatcggccaccttcacctttgcaggcgctgatatcggtgcgttggag

SEQ ID NO: 502738 - DNA, 397 bp, Homo sapiens
  misc_feature (397)..(397): n is a, c, g, or t
gttgagaatgaaaattgtaacccatgctggctctattgttcctgaagccacgtggccaaacgataaaccagtatgtcaactctgactacacactttgtatatcatcagggagggagaaacttgcctgtatctcccaatatctaggaaagtagcactttgataactacattgtctatggtttttaagagactccctgtcaagaagatgtttttaaaaagactggcatagaggaagtgcaggatatactcacagatatgcattctgatttttaaaaacaaagaggctgacaagacatattaatttgattttacatatctacagagggctcttgtagtcctaaaggtgcccaaaccatatgaagcccccctttaaaggagatcaattatctccatatctn

SEQ ID NO: 502739 - DNA, 1787 bp, Homo sapiens
ccagcggtctggtgtgtgtgcgggttgccgtctgtcctggtgtgtgctggtaggtcccttgtcgcttgttgtgtcgtccggttgcgcccttggtgggctgtgttctcgcctagtcgatgttgccttggtcgcgtgtcggtggtgtctgtgtgccctctgcggggtgtgtggatctctcgtcgctggttttttcgtcggtgggtgtgctcgtgcatggtccgctccttgtggggtccctcgtccgttgagcgtggtgttgtccgctggctgtggccacgtgtggctggtggtgtgctcgtgtgtgggggctgcatgtcggtaggacgcgctggcttgtcgatggttgcgtttgcgtgtgttgcactggggtgccattgtgcgagctgtcctggtggtgcgtcgttgtctgctgctcatgcgccgctcttggttggcggtcttcttgcggtgtgccagatgtgatacgggggtgtaccccgggtcgcccgccggcggatgtagacgcctctcgtcgggtgtggggtgaccgagtgccggcttgtgtatgggcgtcctgttgtcggggcacgatgcgtctggtaatgtggactgtctctggggagaactgggcctggtagccgcctgggggatcggcgagcctggtttctgccctgtgcttaggcacggcggtgagagttgcgcccgcctcggcgggggtttggaccccttgcgttgtctcccgggggtgcgctgtatggagacggtgcgtcgggcggtcccatccgagggccgcgttgcggcgctccgtcctatggattcgacgcctaggggccggcctgcgtacgttgttgccgacaaggtggtgccatggtcccgccgagtgttgtaggttcgcgtagggtctggcgagggagccaagtgtcattggcgcctagtcggttggcccgcgttgtaggtgagtgtttggtccagggtggaaggggtccatggcggggacatctgacagggtggaggggttggtgcctctcgctagtgctgggtggccccagtgggattgtaaggggatggcagaagggggccggacgtcctgtcgtggcccgtgtgcgctagcgatgcgctgtgcattcgacgagtaatggcgcccagagggatgtgtcgtcttaaggggaaagacccgcacggatatagcgcccacgcatgttgcgatgagagtgtctggctgttactggtctgtgcgcggttgtccatgggaatacggcgcccttagggcttgcccctgtcgccaccagggcctctatgtgccatggtcttgcatttgtctccggggcgcaatgcgcctcatcggtgcctgcgctcctagcgccccgtagcagcagtgtcagggtcttaggcccttcgccccctggaaaccatcggatgcgcgcctggcaccgagggactgtgggctcctagtcccatgcagcccagcccagaaggtcctgtgcagatctttcttgcagttgtgatgacaacactgatcaaatgggcccacgcagccctgtcgtgcacctcagcacagccttgccgcagccacagccctgcccccagggcactgcacatgccgtgtctgggggccaaactcaccccagttgtccatccttgttgatcctgtgacgtccccttggcctccagcacaagcagcgtcgctggccaattgtgtgcctgccttagtgactccgtggttttgtgaggcgcagagtgtgtatgattttgcctcagaaactaatacatccggtacgaccaagctttcgttctttctggtgttgtga

SEQ ID NO: 502740 - DNA, 199 bp, Homo sapiens
gaatctagagttatcccactgtaccacaaacaggacaaagaacgacttgtataatgattgtttatgcttgccattcattctcgcatatcaagacttcgtatgcatggcttcaatgtgcttatattaacaaagaagcctgtacatatatcattatctgtctactcgctagtacctgtgcctgtcgccatatacctttgat

SEQ ID NO: 502741 - DNA, 392 bp, Homo sapiens
ttttttaacttttattttaggttttggggtacacgtgatggtttgttacataggcaaatctgtgtcatgggggttttctgtacagattatttcatcacgccggtattaagcccagtacccaacagttatcttttctgctcctctgcttcctctcaccctccactctcaggtagaccccagttccctgttttttaagttttcatttcctcatgaaagctcctgtgtgatataaaaactaacattaaagaaatgtgtttgctttacccaagttaatctgtcttttcttttaaggggcctcaggcatgagtataggatgggaagaaaaggtatttcttttctcctacatgtgcaattacttttagacattaaaaagcaaaaacaaaaacaaaaac

SEQ ID NO: 502742 - DNA, 226 bp, Homo sapiens
ccccccgggggtttttaaaaacccgggggccccttttttagttttgcggggaaatttcttttcccctgggggggggggggggcccccctttttttcccgcccgggggggtttttccacccccaaaaatttttggggttggggggggttccccaaatttttggatttaaaattttggggatttttttttaaacccccccccggggggtttgttttttccccccccca

SEQ ID NO: 502743 - DNA, 376 bp, Homo sapiens
  misc_feature (246)..(246): n is a, c, g, or t
gcagttaattacatttatatataatttttatatgtggtgttaagggttcagcttttttcttttgcatgtggatatttagatgtcctggcatcattgttgaaatagtattcttttaccattaattgtcctggtacacttgttgaaaatcagtgacccgtaagtgtccttctagactctgacctctgatccattggtctatatgtctgtcctcatgccaataccatactgtcttggttactatagctntatggtaaggtttgaaatcagaaagtgtcagtctttcctcctctgctctttttaaaagatcatttttggctatttctgagtccccttgcacttcccatatgatttctagaattagtttggcaatttttgc

SEQ ID NO: 502744 - DNA, 204 bp, Homo sapiens
  misc_feature (38)..(38): n is a, c, g, or t
  misc_feature (59)..(59): n is a, c, g, or t
  misc_feature (91)..(91): n is a, c, g, or t
  misc_feature (121)..(121): n is a, c, g, or t
  misc_feature (155)..(155): n is a, c, g, or t
  misc_feature (158)..(158): n is a, c, g, or t
caattgtttcgcaattcggcattttgaaaacaaatttnccgtggaaactttaatttgtncttgaacagtcaagaaaaacattattgagganaattaatatcacagcataaccccacccttntacattttgtgcagtgattattttttaaagtctnctntcatgtaaggagcaaacagggctttactatcttttcatctcattaa

SEQ ID NO: 502745 - DNA, 120 bp, Homo sapiens
gccatccccggaatcacgtacactgccacaatctaacctcctcggactcctgccttcactcatttacaccaatccacccaatctatctataaacctagccttgtttgtacacttgcagga

SEQ ID NO: 502746 - DNA, 226 bp, Homo sapiens
acaataacacacaccaagtcttgttactagctagctacacagacacacacacactataacacacacaccaagtcttgttactagctagctacacagacacacacacacactataacacacacaccaagtcttgttactagctagctacacagacacacacacacactataacacacacaccaagtcttgttactagctagctacagtcgacgcggccgcgaattta

SEQ ID NO: 502747 - DNA, 266 bp, Homo sapiens
ccccaaagttccctttttaacggccctttctttaaaaaatggttggccttttgttccctgcccccctgggtcctttcaggaagcctgccttaatttccgggggggggaaggaggtggggaaaaaaatctgaccttttcatccgcaggggcaagaaaaaaatttgccattgtgacttgcctggggaaaatgaggggggcaggtttttagttgggaaaggttcccctctttgggataaaatgatttaataaatctctttaaaacctta

SEQ ID NO: 502748 - DNA, 114 bp, Homo sapiens
ttgagtcgtcggcgccgtaccggcggccgctcagctccgacgcacgctcgatgaccgggaacatctcgtcggtctcgtaccatttgctcttgatcctggagcaggtaggccacc

SEQ ID NO: 502749 - DNA, 458 bp, Homo sapiens
  misc_feature (9)..(9): n is a, c, g, or t
  misc_feature (47)..(47): n is a, c, g, or t
  misc_feature (133)..(133): n is a, c, g, or t
  misc_feature (228)..(228): n is a, c, g, or t
  misc_feature (231)..(231): n is a, c, g, or t
  misc_feature (444)..(444): n is a, c, g, or t
  misc_feature (448)..(448): n is a, c, g, or t
agggctggnaaaaaaccctgctctgcttttggcccttggaatatggnaaaccttaaaccactttgttctccctaccacctctttgcccttccctaccccttcctccccttcagtcagtgtcccccagggtccnaccctggctagagttagaaggcagaccctagcctttggaagcagggtggcctcccagagccttgcccataaaaaggctgaaggcagccgggcgcnagntgtcacgcctgtaatcccagcactttgggaggctgaggcgggcggatcatgaggtcaggagatcgagaccatcctggctaacgtggtgaaaccccatctctactaaaaatacaaaaaaattagctgggcgtggtggcacgcgcctgtagtcccagctgctcaggaggctgaggcaggagaatggcgtaaacccctccagcctgggcgacaganatanagctccgtct

SEQ ID NO: 502750 - DNA, 161 bp, Homo sapiens
gggggggggggggggcccccccttcttggtttttttttaaaaaggggggttttttttttttccccccttttgggttttttttgggaacctttccccccccctttttttaccccaaaaattccttttttttaagggcccctaacctttggggccctttggga

SEQ ID NO: 502751 - DNA, 862 bp, Homo sapiens
gcggagcagggggatctacgagcggctgtgcgttcacgctcgatgtctgcggtacgctccgcttcctctgcctaggcgacgagacgccagtgggctacaagcttccgatcagttgtgctattctcaaagatcgcgagtggctcgaagggaagaatactatattggactcctcgtcgggatatcccgttggtcgagcgttgatctcttcgcgctcgcaatggtcatcttcagaactgaccttgtgccgcatggaggcttgcgtctcgaatccgtagagtgactctactgaggccactagaaggctcctggtgacagtgagtaagactcgctatagttgcggacaggggtgtcctcatccgagtcgtaggtatgtagaccaaccttccagtaacaagcttgttagcagttccgtggcgcactgagtgaacgaccatgagactgtagtcgtcaaccagaaccacgaggaagatgttgacagagactagatagatcctgagatgggcatcggagacacgtaaaatggggctctgttagtctaggtccgggggagacgtccctatcctctgcgggtttgtgcctcgttggcacatgtgcgttggaagcaacgcgtgatcgcctgctcgacgcaacgaggagggctcgctcctgggtgtgccaagcctcgatgggacattacatctcgagcgagtgaatcttcctcgtcatctttttcgcttggtcccatttcaccgtgcgttatctccatgatccatatattcgttgcgagggggcactgatgccttggtaaaacttagcattgggcggtcgcatcgagatcttgtgattccttcccgtgcacgggtgcaagtgaagtttgcaggaa

SEQ ID NO: 502752 - DNA, 269 bp, Homo sapiens
  misc_feature (18)..(18): n is a, c, g, or t
gtgaagtgtgattgcttntatttgcttagacatccactgccataaatcactattttgatgggcggttaaccaagaggattggtgatcgccgccctctatttcgctgtaacggatatagcgcgtgctgcccccgagtttaattatgctatcaaccatattgcggctgtaattgacatcggtaacttcatcgtcggtgccgtgaaatacccagactggtaatttaattaatttctgcgcgtactccgggctgcctgctccggcgatagggg

SEQ ID NO: 502753 - DNA, 154 bp, Homo sapiens
gagctcggtccccagtcttgctagaacactctgggaaacagtatagctaggaacagatcagctatcctattagagggacaaagggactggtgcatttattcctcatttcttatccgtcattggttgagagcagcttctagggatactaagtgaa

SEQ ID NO: 502754 - DNA, 749 bp, Homo sapiens
  misc_feature (368)..(368): n is a, c, g, or t
gggcgaggggcatgaggggttgactgagcgttgcgagccttagctttctcccgaacgccagcgtgaggacacgatgtcgcggtctcccgctcactgcttgtgggccggccacctgcctggggggtgctctgcgtcgttgtcctgcggacaaagaacacgaaccagcacccgaaggtgacgatttagcgcccaatctccaaatgtaacctcggcgccggtgactgtccctccccgttgtcaccatttccggcaccagaaaccttgtgaagtgtcgaaaacagctgcgttccctgtttaaatgtcaagcgtgtgtaatactacctgtttgtggatagaattgtacacgatgagaagctatctgttcacantaactcaccagttagtgatggtcacgtggggaacacgaccagacttctgtccgtttccacggccacctccagtgccaacagccaattctaccaggtacaaccaaataacagtgttgattccaagctcagaagctgtggggaaaagtctacctttgatggcaggccagttcatttggaggaatggtcctggtctgtgcgtgtgcaggctgaaatttccttgctttataaattcttggaattaaagaacgaattaccacactctggaaaagagacccctttgattataaggctggggaatcatttgtgtaacttcactggaggcaaagtaatatctttaggaggccccatggagaaggatcaggattttaattgccgggtgga

SEQ ID NO: 502755 - DNA, 235 bp, Homo sapiens
tgtacctctgggttgcagttttggtggtagtagaggggcggaaaccagactgcagtgcattgaggatgagtaagtggtgaaaaatgcagaaaatggatacataacaacaacatggattactaacaagataaggtggctgggtgcagtggctcacacctgtaatcctagctctttgggaggtcgaggcgggtggatcatgaggtcaggagatggagaccatcctggctaacacggt

SEQ ID NO: 502756 - DNA, 991 bp, Homo sapiens
agagcactgggttctgctgatggggcagtgcggcatacgccgagaaatccctggcgctcatgtctctcttcattctagaatgatagaaaatcgattctcttacttaccaaatatatcctgtatcgttactagaaatattgtttagaggttcatttattaaccaggtcatattcgttgtcatgattcaagattctcacgagatgtactagtgaggagcttagatgcagatatggatggagggacgtggaagtgatataaggtttggtagaaaatatgactggaggctatgaacatgcaagcttcttgcatgagaaataggttccatggtcgtctcctcgaaaacagaggagaaacggaataggtgagaggctcgtaaataaatcacgcacttggtaatggggcaaatgataaatgtggtttaacatattgcacattgctgtaggagtgtagagataaaagttataagtctatagaaacagttagtctgggtagactgtacacaatcaattttgaatgagctgtagtcttttattactagagacgattgaattctggccgtgatctcctggtagctaaggagggattctcagtgattgcaaggcagaatcgggtcatctaaaaggcctacgtactggcgtgcgttgactaatggcttcaacgaaaactggtaaagattcactttgctgggtggcaggatgtacccactcctggttgctgacctggcgtttgaccgtgggacgactcggagagaatcagtagctccgcaacgcaaaaatgcgatgtaaagctgcctcgggcatccaaggtgtaacccacgctgtcttgtgggaaccgcctctttttcgcgacacctggggtctactaagacgccattgtggcacacagcgtgtggctctaccttcgggaatacggttcaacagcgcgatgtcacaaccccgtgagcacagcattaatcttacgcgcgccacaacaaacgtgtccttcttccacc

SEQ ID NO: 502757 - DNA, 809 bp, Homo sapiens
tgtggagagagtgcgaggtcaggccatgaacttgggagatggtgttaaagcttgaaactgaattactggatggaaaaaccaagctaatatgtctccatatgaacataaatcaaaaatttctgtgaagatgggaaataaggccaagattgaaaattgtcctttaggaacaaaaactggcacattctaaaatcaagacaagatacttgtatgggagtgaaaaacttttgcaaaagaagccagttggttcagaaacatcacaggcaaaaggtgaaaaaaatggaatgacttgtcatccactaaggattatgtaaaccaatgtatagataaagactgtcttcatatccagaaagagatttcactggaaatccttaatatgcagaagactagaaagcaccgtaaatacatctctaggtagggtaaacagaagcctcacaaaaaaaacatcacaggtgaaaagatgaagagcagttgggtgtctaaaaacaagagcaatacaaagattttgatgactgtaaaccacgggaaatagatctctttccctgaggtggaatgaaaggagggcaaaagtcaatatagtctatatttgaaaaggcattctaatcagacaagatgagacattatggattttcagaaaatggatggtttatgtgggcagggaaatcacttgtttaatgacattggagctttaacgatatggtggagcggcgatattcaagttgggggggatgtaaagttgtgagaagagaggagaaataaagttgttggagaaattgaagagggtgtagtgggacaatgaggtggcaacaggc

SEQ ID NO: 502758 - DNA, 157 bp, Homo sapiens
  misc_feature (54)..(54): n is a, c, g, or t
  misc_feature (148)..(148): n is a, c, g, or t
tacaatcgagctcggtaccatacctgccggacatctggctgaatgcagtacggnctggtcgaactgaaccgcgaagccatcgccaaggcgcgcgtgatcggcaacccgggctgctacccgaccaccgtgctgctgggcctggccccgntgctcgacg

SEQ ID NO: 502759 - DNA, 117 bp, Homo sapiens
cctttgtcagtgatctccaactcacacattatattctacgcatacactactcaccagacgctctcccgcttttcatcaatcgcccacatcactcgagacgtaaattatggcgtgaat

SEQ ID NO: 502760 - DNA, 128 bp, Homo sapiens
tctgcgtgggttgggcggtttatttgtaaggaatgtgtaaggcattttggtaagtcgaacgggagcttctttttccaaagaggaaactcagacagaggtgccctcctttgagctgctgccgccccgcg

SEQ ID NO: 502761 - DNA, 100 bp, Homo sapiens
gcttcccaaaatgtccccccccccctttagtagaattgggaagttttagcccatacccatggagggaatcaggaataaaggcaggctggtctcccaaaga

SEQ ID NO: 502762 - DNA, 132 bp, Homo sapiens
gtcacagtaacacgactggagctcgggcgattctgcttatgtgcagccacccaggcctctgcaagcagtagaaggcttcaggaattggactcgaccatcgggcttcagcgctataatcatgatgaaacacag

SEQ ID NO: 502763 - DNA, 1376 bp, Homo sapiens
  misc_feature (241)..(241): n is a, c, g, or t
  misc_feature (501)..(501): n is a, c, g, or t
  misc_feature (510)..(510): n is a, c, g, or t
  misc_feature (917)..(917): n is a, c, g, or t
tcatttaacttttttaatgggtctcaaaattctgtgacaaattttgtggctcaagtttgtttctccatttaaaaagttacgtgatttttaaaaactaattaacttaaaacgtgccacacgcaaaaaagaaaaccaaaggtggttccacaaaacatttcctccttttcctttcttgaaggtttttacgatgtgcattgtgtttatctctattatacaccagtctcttttatacttacttaanacttataagtgtggccaattgtgaaacaccacagttctctgtgaagaaccggtgttcttctccaccactgtgtatttaacagaaggtgtgcggtgtggcagggttaatttaggagagattaattattctcatttatacgccttctcttgagcttctctctgtgggcagagacctttgtgatagaccctgttgtccaggcttcacagcgcacgcccctctcttgtgtgtcccacctgtgtgctttgtgatgtagacccccncacaccgcngacaagctgtgtgtcgtgtgtctctcattattcaccagaaacacacgacacaaagagcagacccacacaaggggtgtgagatataatgtctctgtgagaaaaaagactctctctcaaaacaccacacatgttggcgcttgtgcccagagagaacccatatattcacaccacaatgtgggcaggacatctcacccagagagcttctcagagagagattttttatggggcgcccattctcttctcccagggctttttttttacccagagacagcgggggaggacatccaaactctttttctccctttttcaaggctctactaggcacaaactgttgttgccatgttgccaaatgtgttgtagaacgccccggtgtgttgttgcgacaatctcccaacatcataccagangggggggcacatataaagccccgggccgccctatattttgtaggggccctggagaaagtgcggttcccaaggggaatattaaaattcctaccgctttgtgagaggccttgctttcgcaagagcccccgcaggtcgttcgtcgctttcatcccactttggggggacgggggggtccctactcttctctggcgtctgtgtgttccacccccaaggcacaaaagtgtgtttttgtccccaaacggaacggaaaaacaacatcccgtttgtgtaaacggaaagccccactttcttctgtcacacttttgatagccccccaaattttttgttccccccagggagaaaaagagaggctacactactcctcaaaagggatttcactgagggggcaaccattttccaacacgagcatatttaatactatccccgcgcgcggtattatcgcgctgttaccagagtggc

SEQ ID NO: 502764 - DNA, 926 bp, Homo sapiens
attagaatataaacgaataaaccgtctaaaaattaaacgagtgctcagggagacattctcacagttctgaggttaacgcgtggcagtttcccctgagctctccttcctgctggtatgtaaggcgtgctttgcttcctctacaccttccgccatgattgtacattccctgaggcctccccagccatgcataactgcatacaacttaggattcataactacatatatacggatacaagggcatgaacagaaaagcggccattctggaataccttgtgccagattaaccagaccacgcagcagaactgggagacaaacacaccagacgaccgcaccggccgtataatcaccgccaacaaacaagtgcccgctgtaccccggctaataacaacataacgaagcctcgcattacacaacaacaagaactacctgaatacttaatagactcgtcaggcacgaatatccccaggacgggcgtcgtgtcagatatagtcgttactacgatgccggctaggtgaatttatataaatttaccgtacacattcaacactaagtcggacggaccctttcaataataattaaatgcgccggaaagagcccgaggagcgcctcgccggatgggaaagcggagactaagaaaatatggcacggcgaggatgaagaaaccaggaagagtccgcgcgtacctaaacggagttgtggcgcatgttatataactctagccgagcacgtcgcagggtgcacctgagggggtataaagaaaaactgtggtcttggcgaatgaagacacacagcgacgccggacagctgatccgacaatggaggcccggtcaatacaaaaacagggaatgaacccgaaaagatatgttaagttacatcagttattagaagaagcctccataacatacatccacaacacacccccatac

SEQ ID NO: 502765 - DNA, 200 bp, Homo sapiens
ggatccccagattagagtcatagggaatacacgtgcaatgctgagagcaccagtctgagaagctacgctcttgagcctcctggtcagaaccatcataatatgacaatttgatagcgtcgaaatgcacgttcttcttatcccaataattctcattcttagtcaactcgatagatgatttagctgtcaaagatttaagaagg

SEQ ID NO: 502766 - DNA, 519 bp, Homo sapiens
agtgctctgctctgagtagtgtccacaggacctgtgctcatactcttcgggtcacacaaccctgtgggcgctcaactttttcacccactttggcttgtggggagatggttcgcgctgttttgtgacaagggcttgggagtggacaggattaagtgggaaagtggagtccacccttaaggttctggaagaatcttacacgggggcttgaagacacacttcccacacccagatgtgggtaaattcagtgcgcttacacaattcttagctcagagaaaggtccattttcggttcacaaggaaaggaaccttcctataggctttcctgggttggtataacgcgatctggtggttatgccactctatcttaagaactgtgcaagctcaactgtgaacccgaatatgtgaagggattgcgtgatgtgagggaagctggaatttaaggagctgagccacacatgggtgtggcgcgtgagtcaagagacctctggttagaccctctctactgtgaacggctgtgccg

SEQ ID NO: 502767 - DNA, 134 bp, Homo sapiens
agaagcagaacattcagatgtactatatacacagttcttaaacacgccaatcatttccataaggccactggctcatgtatttctgttgaggcagaagtcactcttaggatgtggtcttacatatctgcagataa

SEQ ID NO: 502768 - DNA, 187 bp, Homo sapiens
  misc_feature (138)..(138): n is a, c, g, or t
gagttcgcgccactgcactccagcctgggcgacagagcaatgactccagtctcaaacaaaaaaaaaaagagtttgacgtggtttcagcttggaccaagattttttcaacccttggccatttgacaccttgtggcccanaataattctctttggctggtgtgggggcgtgggtttggagcattggata

SEQ ID NO: 502769 - DNA, 838 bp, Homo sapiens
cccgaaggtgaaagaattgggcagacataccaaggcccgtgagtgtggaaacccgcataaatccttttgaggaaaagtcgagaaattttaatagaagggggaatttaaaattattggaaagagaatgggtggtttgcggaacccctcttctttgtcccgcgcccccacgaggtgtgtcctgggcccccgcggaaagatgctttgcaacccgataaaataaaagggggggttaaaaaatttttaggaaaaggaaaattctgtgatctgtcccatggtgtaaaatcccgtgaggctggaggccaccaaagtgcacctcttccccctcgagggagacccaatgggaccggaagagctcgaaggcctctgcgggaaaatgtcaaatgtgaggaggctggtccaccccccctgggggaaatcacccccccccgtccgccccgagcagaggctctaatatcagcagatggcccccccctctgaaagatgagaaattctgtgaacgcataaagagttgttaagagaccactcaagggccacagggttaaattataagagttgcgaagaaaattgctctgtgggtgcgtcaccccccaccgcggttctcgcaacaactccacatacagggtaatgagccaagtggttgagagaacctccgcaagagcggctgggagggaaagtgaggtgaaagcacgccgtgagattgctgagagcaccacgacccctccaaacattggggaccacattattgtagaaacattcccccgaaaataaagtcccaccacagaaaaagggaaaaaccccaaaaaaaatgaacccccaaaaaacccccccaaaaaaaaaa

SEQ ID NO: 502770 - DNA, 109 bp, Homo sapiens
tattaagttcttggggccgaaacgatctcaacctattctcaaacttgggcgcctgtactgatccagagctggcatcggagccagcgagaactcagatggcgacatggtg

SEQ ID NO: 502771 - DNA, 211 bp, Homo sapiens
gaaaagtggaccccagaagtcaagcattttctgtcccaacgtgcccatcatcctggttggggaataagaaggatcttcggatgatgagcacacaaggcgggagctagccaagatgaagcaggagccggtgaaactgtaagaaggcagagatatggcaaacaggatttgcgcttttgggtacatgagtgttcagcaaagacaaagatggagt

SEQ ID NO: 502772 - DNA, 390 bp, Homo sapiens
gagatcattgcctaaataagtagtttataaaatagtatatctgggccgggcacagtggctcatacctgcaatcccagcactttggaaggccaaggcaggtggctcacctgaagtcaggagtttgagaccagcttaatcaacatggtgaaaccctgtctctactaaaaacacaacaattagccaggtgtggtagtgcacgcctgtagtcccagctaatcggaagggtgaggcatgagaattgcttgaatccggaaggcagaggttgcagtgagctgagatcgcgccactgcactccagcctgggtgacagagcaagactctctcaaaaaaaacccccaaaaaaaccaactatacatctgggcatggtggctcatgcctgtaatcacagcac

SEQ ID NO: 502773 - DNA, 850 bp, Homo sapiens
  misc_feature (15)..(15): n is a, c, g, or t
  misc_feature (89)..(89): n is a, c, g, or t
  misc_feature (132)..(132): n is a, c, g, or t
  misc_feature (152)..(152): n is a, c, g, or t
  misc_feature (190)..(190): n is a, c, g, or t
  misc_feature (213)..(213): n is a, c, g, or t
  misc_feature (219)..(219): n is a, c, g, or t
  misc_feature (244)..(244): n is a, c, g, or t
  misc_feature (259)..(259): n is a, c, g, or t
  misc_feature (281)..(281): n is a, c, g, or t
  misc_feature (292)..(292): n is a, c, g, or t
  misc_feature (300)..(300): n is a, c, g, or t
  misc_feature (332)..(332): n is a, c, g, or t
  misc_feature (349)..(349): n is a, c, g, or t
  misc_feature (358)..(358): n is a, c, g, or t
  misc_feature (364)..(364): n is a, c, g, or t
  misc_feature (376)..(376): n is a, c, g, or t
  misc_feature (383)..(383): n is a, c, g, or t
  misc_feature (394)..(394): n is a, c, g, or t
  misc_feature (406)..(406): n is a, c, g, or t
  misc_feature (427)..(427): n is a, c, g, or t
  misc_feature (445)..(445): n is a, c, g, or t
  misc_feature (456)..(456): n is a, c, g, or t
  misc_feature (465)..(465): n is a, c, g, or t
  misc_feature (476)..(476): n is a, c, g, or t
  misc_feature (481)..(482): n is a, c, g, or t
  misc_feature (484)..(484): n is a, c, g, or t
  misc_feature (486)..(486): n is a, c, g, or t
  misc_feature (490)..(491): n is a, c, g, or t
  misc_feature (504)..(504): n is a, c, g, or t
  misc_feature (518)..(518): n is a, c, g, or t
  misc_feature (521)..(522): n is a, c, g, or t
  misc_feature (535)..(535): n is a, c, g, or t
  misc_feature (551)..(551): n is a, c, g, or t
  misc_feature (553)..(553): n is a, c, g, or t
  misc_feature (557)..(557): n is a, c, g, or t
  misc_feature (577)..(577): n is a, c, g, or t
  misc_feature (607)..(608): n is a, c, g, or t
  misc_feature (678)..(678): n is a, c, g, or t
  misc_feature (682)..(682): n is a, c, g, or t
  misc_feature (697)..(697): n is a, c, g, or t
  misc_feature (728)..(728): n is a, c, g, or t
  misc_feature (730)..(730): n is a, c, g, or t
  misc_feature (746)..(746): n is a, c, g, or t
  misc_feature (749)..(749): n is a, c, g, or t
  misc_feature (767)..(767): n is a, c, g, or t
  misc_feature (775)..(775): n is a, c, g, or t
  misc_feature (789)..(789): n is a, c, g, or t
  misc_feature (846)..(846): n is a, c, g, or t
ttgaaatacaaatantctttggtttacttatcaaagtaaaaaataacaaaaatcttatcagttaaataaaaaagtgacattctttatcnagccttcttaaacactgaaacgcacgcatttttatgctcatgntctttagcagtatcttctcnccttttgcccctcattcccctaaattgtttcaatgagntcatctgtagaatgaagattgtnaccttncttaatgctacttactttttattancccaatatcaagacnaatctagagttttttgtctctnacatgggaaanggatgtgnaaaatggaaaattcaccagcactttttaaganaacataaaagaagcccnaagcaagcngttcanggccatgacacnccattanatttctgaganatttaagggtcnttggtacgtaaaaggagaacncaattccagaagcatatncggatactggncattattcntaatagcgaanatagnncntntccnnagtactgatttcngataagccattttnttnnctgagggttgacnacctcagacttgaatncngaangtcgatgcctcaatcttaanacagcagtcggctggagacatggaaagtgnnttgtggcgcaaggagcgctggtggcaggagtaggttcttggcattttaagaaaagtacatatacatagcnaganatgatagtaaatcanaatacatagctttgtacatgttagaaatatncnatgtgccaccaacacnacnactgccctattaaaaagncctcaggnctggagacatctgnatttttcctttgtataactacatttgcattacccaccacatatctctcccatggtcngtta

SEQ ID NO: 502774 - DNA, 126 bp, Homo sapiens
tggcgaggtctctacctggcagcctctctacctttaataagtccaaatccggctcagggatgggccacctcatcctccgggctcggcatctgggtcccactcctcagggctggtcaaatggagacc

SEQ ID NO: 502775 - DNA, 535 bp, Homo sapiens
  misc_feature (419)..(419): n is a, c, g, or t
  misc_feature (472)..(473): n is a, c, g, or t
  misc_feature (483)..(483): n is a, c, g, or t
  misc_feature (494)..(494): n is a, c, g, or t
  misc_feature (496)..(496): n is a, c, g, or t
  misc_feature (525)..(525): n is a, c, g, or t
  misc_feature (531)..(531): n is a, c, g, or t
agaagctgacagacggtgatgatgatgatgagactaaagaagcagaggatgaagactcagaaggcgaagaagggagtgaataaaacctgcacacacacaatggactttatctgccatgaacatttgtatgtgttgatccgacatgaacatgtacactttattttaaagagtgttcctttagtgagacttactgtcttctgcacactgttgaggttatattttcactgtctctacattaatacaagattctgtactgcacagagagaacggtctgagggaaacgtgatctgtgctattctaactgttcattataagttattgtaactcatttttggcaacgagtaaacaaacaacagtgatcccagagataccacttattctttattgcattttcatggggaaaaaacgtaaaacatganccatttttataccagtgtttattaggaagctgaatgctgctccaaattaagtnntcatgcaaancaataattagncnctataaaaataaagtgatctctgtgtatnagttcntata

SEQ ID NO: 502776 - DNA, 348 bp, Homo sapiens
gaacagagtctcggtacctgttgggtatcatcgatacaggaaggtcccagcgttggggagagccccaaagttgagaacagtagtgaacaattgttgtactgaagcaacttgttacgatacagctgatcatcaaacgacctgtgtgtaatatgtatttcccgacaaacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 502777 - DNA, 345 bp, Homo sapiens
acccggacccggcacacaagtggtggtgggcttacagcatactccggtcacagtatttgtcaaaggtatctcccaggcctccatgtacaggtgtgattgttcccctggcggcagagcgctggaactcccgctccagcgtggatacagtgccagcagctcccctttgtaggggggtcagtagcgtggcaaggttgcgtggcacagaggcggaagcgcctcagggtggcagaatgttcttgatatttgtccaatgttgggcaccccaggaagggaaaggcagctcaagaaccgaggaaatatcaggctgatggctggggcaggcccggagctggtagtgtttgcggg

SEQ ID NO: 502778 - DNA, 228 bp, Homo sapiens
ccaacatctcatagctccttccaacatctctccttccaacatctcatccctccttccaacatctcatccctccttccaacatctcatctcgccttccaacatctcatggctcctctcgggtttcagcacgagttggagccatgagatgttggaaggagcgatgagatgttggaaggggcatgagaagttggaaggaggcatgagatgttggaaggagagatgagatgt

SEQ ID NO: 502779 - DNA, 123 bp, Homo sapiens
gagacagattcaaactatatgcacttggtaactacagctgtaaaatgaaatctcgtctagtagcaatggatttattcttctcatgttaaacccaccaaagataaaggtggactaatataggta

SEQ ID NO: 502780 - DNA, 763 bp, Homo sapiens
acctcttaaacaagcatgcttacccaaatctgtcgcatgcttataatggtagcattagctatgcgcacttgacattatcaaatatccctttcctagtgtaccagtcttcacagagataagaggagctgggaatacgagtcagatgtaatgtgaccctataaaatctgtgaagcgaagcttcaggaaataaatcttttgatctttccctatcttgattatatcctaaagtcaaagcaatgcatacttcacctagagaagacagtattggcaatcatgacacctgtaataaaaacttgaatccaaagtcaaaacttaagcaagatacaaatgtgctgcctgcagttagtcctgcatgggaataaggactagttatttttttagtgctgcatttttttaaagttggattgctgctatttaaaacacaaacagggacccagttcaaaaaaaccccaagggcttaacagaacttggaaagttcccactaagtggtgtgtgaggaaatcctcatctggtctctaagcaatctgcacgatggatccatagatacagtacagtatttactggtcactcgcaaagaactcagtgaggtcaacagtcagggaacgttttccctaatgaagcctacagtctgtatggtcaacttaagaaaactctctatcatggcgtcgctaattccagggaggtccaggcccactatgattttgtcccaaatacatttgacccattgttaataccacctgcaattcatgctctacacaagtgc

SEQ ID NO: 502781 - DNA, 1211 bp, Homo sapiens
cggcttcttgtttgtccttgtgctcggcccccccccccctcccgcgcgtctgtttataccgtactacccccccgtggggtttgacgcactctccgtcgaactagtgggcggggctgccccgcgggtaggttgttctgtttcgcccggccgccccctcttgctgtgtgcgtactgtgccgcggtgttgttgcgtgcgccatctcccccgtctgttttcacatcacggggggtgggggtggtccctctcgttcgccgtctcttggttcagtcccggccccttgttttgttgtggcgcggccagcttcgcagcggtggggcgattgttgtgcgccccccccacagcatctttttgtctctcttgtgggtagtgtccgccccccccttccctcggacccacgcttctgtggtatttgatgggccaccccgtctgctgtgtcggaataaagatggtgggcgcccccccctctaaatacacggccgtgcgcgcccgccctctttctttctcgccacccccccgctgtgcctctccctctctttttgtgggtctctcctccccctcttctttggtgcgctccctcctggggccgccctctatatatgtgttttttgtgttctcgcccccccaccctctcgcgcgcgagggggcccccgctcccagtacccgccctctctgtcgcgcccctcctcgcagcgcgaggagaggcgctccgccacctattattctctgcgctggggttctctcctccctctgattaccaccgcccccagggcgctctctctcctccccgcctctctttttatatactaccgcgacaaaacacacccactcctctttatatatatatataacacaccacccctcccccccccctctctcttctttctcgtcgtgagacaccactcacatcatattacacgccacctctcttctccctagattatattcccccccgctctcttttttgctgccccccacacacctctctcttttgtgcacccctctcgtctttttttgtgtgagtagtgcgcgcgcccctgcctctcccccgcgcgctctttccctcgtgcgcgccccccctcctccccaccctctctctttataaatattctctctcccccccccccccccctctcttttattatatagagagaaatatatctctccccccccccccctcccttctccccctctctctcccccccccccccca

SEQ ID NO: 502782 - DNA, 323 bp, Homo sapiens
  misc_feature (32)..(32): n is a, c, g, or t
cccatctctccacactggactccattgatggngaagacgatgtcgggcaggctgctgatgtttgttcagctgaccaccatgtcgccatctgagctcgcgctggctccgatgtcgctctggatgttggcaatggggctggttgggccggacagcagagaggtgccggtgtcaacaatggcctggcagccctcagcacaggcgatggtctctccgttcatggtgatgctgtccacggtgatctgccagtaaccctcgacggtaacaggcacccagttcagacttccagtgtagtaagaagagtcaatgccaccaaagatcaccac

SEQ ID NO: 502783 - DNA, 972 bp, Homo sapiens
gggcttgcccttggcctttgctggctgtgtggcggctccgcggttcggaggtcgtcgctgagcgtcttctgcttagccgcggtcatgagccggcacagccggtgagaggcaggttctgagcctgtaccgagatcttgctgcgcgccgggcgtgggaagccgggcgccgaggcggcgagtgcgggcaagagttccggcagcatgggggcctgcccgggtccgacgtgctgcgcttcgagtacctgtaccggccgcggggcgggggccccggttgggttggtaccgctccggggccacggcccacccggtggtggggcgcctttgttacgcccccggggggccccggaccgggaagctgggcggcgttgtggtttccccaaggcctgacagaggggagcaacggtacaaagggaaccccccaagaaaggcacgggggcctcggggaagaccccgccccagaaggggacgggggacgggcgcgaaagaagccgaaattcgctcacgaggagctgtgggtgggaaccagggagggctccggcttgcttggcattgggggggcattgggaggaaaccccggcctagagggggggagggcgtacagacgacatacgtgtggagggaattgggggatggcaagaagaactcctcctggcgacgcaggggggcagaaagagcccgtgaatggacggaaggaaggccgctctcccgtgctgggaggaggtgcggtgtcctccccatggggttgggggcggctgggaccgtgggggttggacagttgtagcaagagctttggccagtagggacagagacgccgtggagggagacctgaacctttttgcggggagtccatttggtcggaggtcccttggttatctgaagagggtttggacgtgggaggcgtgaggaggcgagctctgagacctggacaggaggggtccttccacccagtggggtgcctcggtgaaaacagtgg

SEQ ID NO: 502784 - DNA, 130 bp, Homo sapiens
atgtacacccaggcagcaggaagggctcaggccagaggtagaagagagcctgggtctgatgatcatgaaattaagcccaaggacctaccgggtactggccacaggtcctgtagaggaacgtggtgccgag

SEQ ID NO: 502785 - DNA, 231 bp, Homo sapiens
ccttcacagaaagcagatcggcgggcgatgcgccgggctcacgcgcaagatgaggtggacgtggactggcatatgtccgcctgcgaccatgttctgatagatgcgctgggcatcccgcctgaaccacagcctggcgatgggcacacctttttcagtgagatcggcctcgatcatgcgtccttttgggcggttgacatactcgtgttgcgggtaattgctttacacctcccg

SEQ ID NO: 502786 - DNA, 174 bp, Homo sapiens
ctccggtttatctagaggatcccgacctgcagtgtcgctggcccctctggctttcatcaatgttgaggaagcccaccacattgagtagaggtcaaaggtgagcaggggctcaggaagctccccgagaagaactaccaggtgctatcgtttcctgactgctttcctggtgcagat

SEQ ID NO: 502787 - DNA, 430 bp, Homo sapiens
atttctcagctttacatatgtctaaaattgattagacatatgtagacatatgcaatcagttaatcacaatattaacatctccttaataaacttgagtgtattctggcaacccattcattatttatttttcctctcgtaactttctccaacttcaaactaccattatgttggaacttctgattttaaggtaatttactcttaacttaggcttgggggtttttttggcctgatttccattgtaattttaagaatatatcatgtggcttgatttgattttttaaaattatctcctcttgaaatctgagcattaatattggtaacttgtgaataataataagacacagatcacataatctttgaaaccagattgttgattactgattaggctggatcattaagggctgattaagctgacacttaacagtattta

SEQ ID NO: 502788 - DNA, 891 bp, Homo sapiens
ggaagtgacatcgtctttaataccctgcggtggcattccctgacgcaccgacgttgatgcccaggaagacagggtcgacctggaagtccaactacttccttaagatcatccaactattggatgattatccgaagatgtttcattgtggcgagcacgagcaatagtggtgctccatgcagatgcaggcagatccgcatgtcccttcggcgggaaggctgtggtgctgatgggcaagaagcaccatgatgtcgcaaggccatccgagggcacctggtgaaacaagcccagcttctggagaatactgctgcctcatatccgggggcaactgtgggctttcgtgttgcatccaaggaggacctcactgaagatacagggtacatgtttgctggccaataaggtgccagctgctgtccgtgctggtgccattgcccctagatgtgaagtcagtgtgacagctccagaacactggtctcgggcccgagaagacctcgcttattccacggctttaggtatcaccacctaaaatctccacgggcaccaattgaaatcctgaggtgatgtgcagctgatcaagactggagacaacatgtgggagccagcgaagcaccgctgttgaacatgctcacacattctccccccttctcctttggtcctggtcatccgggcagagtgtacgacctagtggcaggcattctaccaaccctgaagttgctttgctatcacccgcaggaaactctgccatgctcgcttccctgaagggtgtccggcgctgttggccagtgtctgtctggcgattgctacgcacctggttgcatcggtcccccttctaccagttcacggtccagcgatccgggcctgttggtgacggttcacctccctcttgcggcccgc

SEQ ID NO: 502789 - DNA, 442 bp, Homo sapiens
ggagaacccatttgggggcgggtgccacttttctcgcgcgtgtggagggagttggccttgaacaagttggttcttttgacgtgcttggcacggggtttcagcccaagggaggtgttggttcgttggttccgggggtcacagaatttgccccccaaaaagtactttatttgggctttcgggcaggggcccagccggggcccccccccttttgttttgccaggctttttgggggtggcacccggggattggaaaaagggggccccttttttttgcttggtgggccccggggccctgccgttggcttttacccagaagaccttggcccgtttggggggttaacccccccatgtcattgtgtttgtttttttggggggggtggggggcccttgtttttgagcggccggcttgtccccccccttgatttaattccttgtttccccca

SEQ ID NO: 502790 - DNA, 727 bp, Homo sapiens
ggctcggctcttgtcccggtgcgaggtgttaactgcgaggccccgtgcctcgtgtccccgtgactagtgccgtgaccccgggtgccatgaagcagtgagggctcgtgtgcggtgcctgtggctgctggacaaaggctgaaacctgcctgccctggctggaggagaacaatgaacccccacctgcctgcctggcccccaggatgtggagatgaaagaggaggcagctgacgtgtgtggcgggtcgacgtggggagggcatgacggcaagacggcgtgcgtgcagcggctgagcactcccagcgagagctggacacagtcaccttggaggacatcaagggatgcacgtgaaacagctagagaaagcggtttcaggcaaggagccgagattcgtgctgcgggccctgcgggattgctgccttccacatcacgccgcctcaaccactattgttctgtataaggctgtgcaggggcttcttcacttcaaaataattgcccactcgatgactttttgctccccttccttggaagaagcccatgtacacagagggttgatttaccagttccgtccccgcacgggaaaaagctgcggtacgacacccctccttgcttgatgttggaagctattaccaatcctcgtggtcatcttcattgattaacagcagcgctacaagtatgccagaagattcttatgatctgattgcgcagatcagtactcgaacgcgggcct

SEQ ID NO: 502791 - DNA, 219 bp, Homo sapiens
  misc_feature (14)..(14): n is a, c, g, or t
  misc_feature (18)..(18): n is a, c, g, or t
  misc_feature (33)..(33): n is a, c, g, or t
  misc_feature (35)..(36): n is a, c, g, or t
  misc_feature (41)..(42): n is a, c, g, or t
  misc_feature (44)..(44): n is a, c, g, or t
  misc_feature (73)..(73): n is a, c, g, or t
  misc_feature (92)..(93): n is a, c, g, or t
  misc_feature (95)..(95): n is a, c, g, or t
  misc_feature (104)..(104): n is a, c, g, or t
  misc_feature (110)..(110): n is a, c, g, or t
  misc_feature (116)..(117): n is a, c, g, or t
  misc_feature (130)..(130): n is a, c, g, or t
  misc_feature (144)..(144): n is a, c, g, or t
  misc_feature (167)..(167): n is a, c, g, or t
  misc_feature (177)..(177): n is a, c, g, or t
  misc_feature (179)..(180): n is a, c, g, or t
  misc_feature (199)..(200): n is a, c, g, or t
  misc_feature (204)..(204): n is a, c, g, or t
  misc_feature (218)..(218): n is a, c, g, or t
gtttgttgaaagcntttncgacatttgtataanannctttnntnataaatatatccaggtgctcaccaaaganacatgtattaacaacttanntnagatttttntaactnatagtnntcactcatttatnatcagtaggagagnctgtctagatgttggggcagctntatgatttangnntgtaacatgttataactgnntttngtaccctagttttnt

SEQ ID NO: 502792 - DNA, 239 bp, Homo sapiens
acgccaagggtgcctatgctgtcataaatgatgttgacctgcacgccggcacgctgcttttccatcagcagatcggcgaatttcaggcccacttcgtcctcgtcgaaaatgtaggtctcgaaattgacatggtcttttgcattggcgatggcggccatcatggccttgatggtggccgggccatcgaagagcagcgtggtcttgttgccggcaatgagtggactgccggtggcggcttc

SEQ ID NO: 502793 - DNA, 106 bp, Homo sapiens
gtgtcagcaatacagttggtcacgttcccgtaccagaaggtgtatgaaggacttctaagaactcaaagaatagtagccggtatggaactcttaccattttctccaa

SEQ ID NO: 502794 - DNA, 1493 bp, Homo sapiens
  misc_feature (1093)..(1093): n is a, c, g, or t
  misc_feature (1493)..(1493): n is a, c, g, or t
atgccgacatgaaagaaggccatgggaaagaacgtggtgtccggccccatgctgtcgattgaatggaacgcaggaggctaagaaagtggtgaatcccctgctctgagaacaaggcctaagaattgttggtcatatgagactaggacagttccagcccataatagagagctcgacccggctttgtcgaaatgtgccccgcatatatctaggttgcaacggcgagagagccatccttctataagatggttgaaagtggcgcttctctgcgagttgacatcgcatgttccactcgcatggactccttggaacgcagacatagggcaggtatcttcaagcttgacttagaggcttggcgcctccagagtagcagtgaccatgagtgactagaatggcaatggatgacaagaacgcaagaagacgttggttgtgagccccgtggtgccctgacggaaggccatatggcattgcgtgagtaagatcaccgtgtggaacgttctcgcgaaaccgataggaagactcgatccgtgtcgctgtccgatgggcagggagttaatcgactcagatctatcctatctcatttggggtggtgacggacatcataagataagagcgtcagacctagggtaggctgaattggctgcgacgatccgctaggattccctaatcgagagcttggttggtctttcttttgcgctttgcacccgtgctgttcggtaaaaagtgtgggggatccgttatactggctacttagtcaagagggcacacaggccaagcgacttaggcgacgttctagtctcgcacagcgacagcagctgatacactacttgttcgacctttcacgacgaggtgaaaccctcgggaaggacaaggggctgcttgtggcgtaagcctgggtgggaagcgtatccaggacccagattaccaaatggccagattgcgcatggagaatcccggccggtcaacctggggggtgtgccacacggtcccctgagggttccctaaagcttccagggtggctttcggaacatctggaccaaggtcttgaaaaaggggaactgcgctataatggaacttgtgacacttggatcctggngtttaaattgttccgcctggtggtagcgcttctcagatcgaccaagaagatcccgagatagtatcaacaattgtcctgtcacaaaaaaagacacaggagggcggcactaaaaaaataacccccacagcggggccaggaattaagcgcacacagtctttgtgcaaaagtgcgcagcaagaggggacgcaaaacaacacgcggacgcgaaaatcacgacaggaacacgactcgacgcgaggacggcccatctgttgggtgctacgcgacacacgcaacgaccagacgaatccaagatgaccagccggaagcagccaaaacacaagacatcgagaagcaagcaacgacagcaggatacactacgagcggagaagacgagaaaagagagagaaagggggggacn

SEQ ID NO: 502795 - DNA, 746 bp, Homo sapiens
tcgacgcaacttaggctatgtacgaggctgggtttttggctagggctgcggaaacgcggccggtccgattccgcggccaggcagagggactctgcaagcaatggctgcagcgcgcctggtgcaagagcggcgccgtgctgctgcgggagccgcgctacacgctgctggtggccgcctgcctctgcctggctggagtgtggtgcatcacctttcatagggtcattcacatgggttgtgcatacacatgagattgacttggaatgtgcctacattgagcctgacggtaagaatgtgctgtcagtcaattgagtaccataatgacttattacccatacttgctatgggctgtactacctggaccactttgtgtacccagctttggatttcgtagtatcattcatattactcgcgcgcgctttgtaccttacttgccatacctatgtccctgatcggctatctttgcacactccctgcattgtgccccctatcgacatccactcacttctcgccatatggtaccattctataccccttagtgtctttaacctcttatgccctttgcttcttgctctctttcattttcgattccttattctatctctatggaacccattgccacaaggcgcttaccccctcccaccttctctggttccttatctctctcccttttcgattcgtttgccttttgcctggcccttcctattaccccagcttgttccctacgttcccaaattcctttttggttg

SEQ ID NO: 502796 - DNA, 524 bp, Homo sapiens
ggagcaaatctccagaaaaaaggacaactgtgagttatttatcagccaacacacacagcaactggaagatgagtctacaactggaaaggggaatagaaaactctatgctgcagcagaacaaggtaaagaatgaaggaacactctcaaaacacacccccatccaaaggcaactaccatcacccttaggtgattatccttccagacatgtctgttacctctcaaccaatgcacatatgaatatttctgctaatgtgattttcacatattaattattataaagacactatcatttctgatggtgccataggatttcactatgatttggttaacaaatttatttaatgaatgggcgttctaattactattgctgcataacaagtcaccctaaacttagtggcataaaacaacaaccattttataaatgctcaccaacaccgagggtcacaaattcaggcagggcccatgggatggctcttctgcttagtgatgtcttggccatcggctggtactgggaggtgtaaatg

SEQ ID NO: 502797 - DNA, 368 bp, Homo sapiens
  misc_feature (74)..(74): n is a, c, g, or t
atagcgacaccgtacttgccgctcagttggtcagccagtacagggtttttgcgcttcagtgcctcaatgctcancgcctcccatggctgaacagcccattcgcggccttcgagaataccttcagtactggatgcccagttgcctcgacccaatgagggaaagacgcagttctctaccaccgtcgatttcgggtgatagttgttgttcgcaaactggggttctagcttgtcgccttggacattccacaaagtgaatagactttgattacgcaggtattgctgaaacgcacctagcacaaactcccgtactgcccagtcgtagttccctacttcaccgatggcttttagtagctgtgcgtggacaagcaa

SEQ ID NO: 502798 - DNA, 872 bp, Homo sapiens
atgaacgcctgcagtagcagatcacgtcagtgaaaatctcataaaacacgttcaaggatggtctgcagatcatgcagagaagcgaggtgcatcatgattacgcagaagcaagcgcaattacaatcggtgattgattatactactatgttccggaaatttgtacctgtaattaaacagatgtttaagcatctattcacgtcctgaggttatgtgaaacttcgaagcgcactgtttgcggagagcaaattggatcactattcttagagacaaggaaatttaaggaacttggaaaaatggctttaggaaacatgcatgtaaattccctttcaattgggtgtcggaagggacttgtggatattaactttgtcagcaattgggtttctagagacgtaaacaggggcacacctggtaaagattacttggttatggttcccataagtacttgtcaaaccattttttagatgacttgggcattttggcatatgtcaggcaacctttatggggtatccggttagatggctggggagtcaacacgtgggggatatatcggcggcaaaaggggagaacgagtggatcttcgctgtaagaaggttcacaattgctacgggagggaacaacggataatcagaatgtaatgtgtactttttggtggatataaatctcgcctcttggcatagattggttacgaatttatctgtgggatgagcaattggtgattcgcttttcctagagtttcggtcaaaaactgatcggttcttatggtcactccaggatggacacgctcgaatgggggaaaaggcccaattggtgtgttaaaccagatgcctgtaagaaaatcccaagacattttaatcgaattggcttgaagtgtg

SEQ ID NO: 502799 - DNA, 267 bp, Homo sapiens
gcggccgctggccaggctgtcactcaggttccggttcaaggtcaggacattcagcagaacctcctgccaaaataggtgcctggcatatatatcatgttctcaagacattcatggagccattctgaggtgttctggagaaaagcccgcccttgctttcaaaaaccaccgtaaacagggctgtgtgtgtattcaaatgctcagtctggccgctgagggcccggccagctccattggcccccagagcgaggtaagttccacagagcccct

SEQ ID NO: 502800 - DNA, 434 bp, Homo sapiens
  misc_feature (399)..(399): n is a, c, g, or t
agcaacccagcgctcaatggtgctagtgaacacagttgtgtcagaaacaacctcaaacagacaccatggtgcacctgactcctgaggagaagtctgccgttactgccctgtgggcaagggtgaacgtggatgaagttggtggtgaggccctgggcaggctgctggctggtctacccttggacccagaggttctttgagtcctttggggatctgtccactcctgatgctgttatgggcaaccctaaggtgaaggctcattggcaagaaagttctcggtgcctttaagtgatggcctggctcacctggacaacctcaagggcacctttgccacactgaggtgagctgcactgtgacaagctgcacgtggatcctgagaacttcaggctcctgggcaacgtnctggtctgtgtgcttgggccaatcactttggcaaa

SEQ ID NO: 502801 - DNA, 572 bp, Homo sapiens
tggtcggtacccacaggcaggttgtactgtgtatttgtggaggactgagaaattccacagtcatcatgcacacttaccttccctcctgaaatctccactcaccaggattaagcatgctgcattcacaggcacctgcctctcgagggtgcccaggctccacatgcgcatgcacagaaccctggcgagcccatgagtgcacgccctctggctgcagagcagaggatgaggcacagagagggagacccagagcagaggatgaggcacagagaaggagacccagagcagaggatgaggcacagagagggagacccaggacggggggtggggtgtggctagcatggcctcacccctagtctccacaaaccacagtctgctgtgccacggccagagtgcactcatacgatcacctggcgtctgctcccgccacagcacctcatcagggtccccatgtcatctccccacaaggaggggagcacatcagcacgtggctgggggaagagtggggtcacctgatccagtgtgtctgactgtgcctgtgagggacgctgaggctgaggtggcacggggtaggg

SEQ ID NO: 502802 - DNA, 805 bp, Homo sapiens
  misc_feature (184)..(184): n is a, c, g, or t
  misc_feature (246)..(246): n is a, c, g, or t
  misc_feature (254)..(254): n is a, c, g, or t
  misc_feature (275)..(275): n is a, c, g, or t
  misc_feature (327)..(328): n is a, c, g, or t
caccatctaaagtgaatgttcatgttttaggagtccttctaggtcagaaagaaggaacaagaagtattaaagaaaaatgagctcctccaccttggaggaaggtgtgtatggtcgtgcattaaaactgatgtctacatctaatacatggtgtgacttggaattaattattatcgccaagcacaanatctagcagaaacaggcagaacatgaatgatcttaaggagttgctggagaaatctttacatngtctgaanaaagcagtgagactcgacagnaataatcacttatactggaatgctcttggtgtggttgcatgttacagtggtnntggaaattatgcccttgctcagcactgtttcatcaaatcaatccagtcagaacaaattaatgctgttgcatggaccaacttgggagtgttatacctcaccaaatgaaaacattgagccgaagctcatgaggctttcaaaatggctcaatcccttgatccatcttatttccactgtgctggattggcacaagctcttatttgctgaggcagtcggcaaggttatgacgccctggagtctcttccaggcaacacgtacatggaacttacatatgcattactggagtgggcgttaaggttatgcgtagtagggtcttgcccacatttgcacgattaacaagcagcgagaatcagaaggtggtcccgttcaagtcttcccaatgaaatgcttttcccgccagccccaggttctttggggactcttcggcgccaccattccgatttttccgccgtttccagggggggtctcccacaccttca

SEQ ID NO: 502803 - DNA, 216 bp, Homo sapiens
tccctccttcatcccccctcggacgggcaggtgacgtggagaaggggcaggtgggacaacttaaggagtccaggcaagacgcttaacctcctacacactatggacaggttgacgacacactactgtgtgcaaacgtgcctactcggactgacctttataacaagattctttacgacaccccagacctgtggaggggtcccgaggctcgaccttcgt

SEQ ID NO: 502804 - DNA, 290 bp, Homo sapiens
acaacgtatgcatgtacgttgaagatatcaagtgaggcatagcacatcaggtacataagccaggggggagccatactcaattctcgcctgtagaccagatctttggttacctgctcactcgtcatccaagcccttacccacatcattatcaatgatggtgtcactgcaaatgtttctttgctggttcacttctctcctatcataaaacaaagaactgacgccagccaactaaccaaccaaccaaaccaaccaaccaatcaaccaaccaactcactacccgcctcttctct

SEQ ID NO: 502805 - DNA, 1070 bp, Homo sapiens
tgttggcggtgtctaggtggcacgaggctcaggaaacggcgagatagctcaataccctcgtgtatcttacacaccaatcttgactgggtgggcactaggcttgatgatgactgtgccggcggtcgtggaatgatgacaatggaagtccagtcagtctgagctctagccacagttgtatcccagtgtgcatcagtgaccgttaaaccgcattttctggcacaagtctcataccacacataggccaaccaaaaccatacagcacgctatgcgctcgcgacagccggcacagggcccacgcagcgcacagcatgccggacacactgcaaaggctcaagcaaaaccacgtgatgtcaagcacccacatcaagccaccgtccggcacgacagctccggcacagcaggcaggcacagacaggcaagaaagcccgcaaaccggccaaagagcccaaccgcaagaactagcatctcaccgcaagtccatccagaccctggagggccggaccatatgcaccactacaaagcaactgaacacgaacaaaagccaacagcgcaaggagaaccagcacgacaccgcctgcgcaacgcaccatgggcacacttccaatagccaacaacccctgcccacctgggcgacagcaccgggggaccaaccaatacctacaacctgagggaacacgatctaccccagagacaacggtcaagaccacgacagcccctcaaggcacaaactacctaacggtcagggactcctcaagcaacaaccttggagcgcaggacaggcgccacgccgtaccacacgagcctcatcgggacagacctggctgacacaacgccccatggaggcaaatgcgaagggcttacaagcagaggaacccaagggcccggcaccaaggcttcccagaacgaaggtgacaccacccgtacacaagcacattcccaagagagaatgaagacaacagacaacgacggcaagagaggcacacaaaccccatacacgtacaacaacccagagccaccaaggcaccaaacggcgcgacaacacagacactcatacataagagtgacgatct

SEQ ID NO: 502806 - DNA, 899 bp, Homo sapiens
gcttccttgtgcgggatgaccatggtggttgggacccggtaacacgtatcctgaataactggagggtctctcgaaggctctcgatcgcatgcctcagttcatagcgtgggactgaggctctcgcgtgcttctccagtagctaccacacaacttcccattaaggtgcaacaccatatgcgtgatcccgtgaaattatttcacgacagaatttgtccctggctcggaatagtgttccctcaggcaattggtgaagggtgctcgaatgaatgcgaatttcttgggagatgttaggacgtacgtggaatttggccgagttgttggccctaacttaattggattggatggccaattgggaggggaaaggcattgagcgcggaagttagaaggtaaactttcgcgaaggaaaagggccaagggaagggcgcccaagaggtagagggtctgccaaaggagagggtctggagggccataatgggttgggaatttttcccggaataaattgtggaattccttaaacgaggggtataggggggagggagagctgccgcggtagagaaattgggaaggcgtttgtgtgtcaggcgaaaatggggttatgggggggccgaccagccccttgtggggtacacaatgggcacgagctttacactgggcaagcattacaccaagggcgtgaagagagatccaacgacgccgtggggtgcccatcacaaaaagacgttgtgcgttgtgaaagacgttgtacactgtggggggcgcctcttcaaacgaggggggcggcaggtttgaaacacgcaccaagagagaagaaatcaccgcggggggcccccatggtgtggaacaacaaagaggggggctcggtgaagattaaacgggcccactcacgcggggaagacgca

SEQ ID NO: 502807 - DNA, 825 bp, Homo sapiens
tacccctccttactttatgcccccaaaaaccaatttaaaccccccccccttttaacgtggggggcagtgacaaaacacaaaaacccacaaacccccgcctgtgtgaagcccaccacgttcctgtgccccccgccattttacctccgccctgtgattgggattttggttttccatctcttgctcccgtgtaggcatgtgggctgagacgtctagagtgtgtggacccctcctgtggggggcactgggccattgacccccctttgtgacaaatgtctctaagaggtggagattgtgagaagaagcgcgccccacttgtctcacgcgccgtgggcattctgtgggagccagtgtctgcgtttggtctcccccacaagaatctcctgtgaggagtgctgagacgggtgtggggttggcgagcagggggttctctcctctcagggtggtgctctagggatggtgttgtcctcctggagtttgcgcccacacatagagacgttgggtgcgcctcccagtggcgctgtgcgcacttagaagtcgctttcgcgcgcagagactgttgtggagactagtggtgtgctatcatcgccgtgtgttgttttgtactacccggatatagtggttctccacactccgtgcgtcctgtgagtcccactgtggtctgcgccccgcctctttcctcgcacacacttttgtcatagaaaaccccttcctcccatctttccccctccgggtgacacacttctttgtgccccgtccccttttagaggcaactccgttgctcatttggtccaccaaggggagtgggccccaacagccctcttgacg

SEQ ID NO: 502808 - DNA, 494 bp, Homo sapiens
  misc_feature (7)..(7): n is a, c, g, or t
  misc_feature (76)..(76): n is a, c, g, or t
  misc_feature (104)..(104): n is a, c, g, or t
  misc_feature (109)..(109): n is a, c, g, or t
  misc_feature (130)..(130): n is a, c, g, or t
  misc_feature (134)..(134): n is a, c, g, or t
  misc_feature (148)..(148): n is a, c, g, or t
  misc_feature (170)..(170): n is a, c, g, or t
  misc_feature (185)..(185): n is a, c, g, or t
  misc_feature (212)..(212): n is a, c, g, or t
  misc_feature (263)..(263): n is a, c, g, or t
  misc_feature (334)..(334): n is a, c, g, or t
gcagggnaacgccggcccgggttcgaattacggctggcgagaaagccgacagagggggaacgatcccttcccaccnttcaattcaattggcccaccattggtantgganctacgagtacacgattacggnggantatcttaaactccntacatattcccccattattccntagaaccaggcgacntgcgactccttgacgttgacaatcgantagtactcccgattgaagcccccttcgtataataattactcacaagacgtnttgcactcatgagctgtccccacattaggcttaaaaacagatgcaattcccggacgtctaaaccaaaccanttcaccgctacacgaccgggggtatactacggtcaatgctctgaaatctgtggagcaaaccacagtttcatgcccatcgtcctagaattaattcccctaaaaatctttgaaatagggcccgtatttaccctatagcaccccctctaccccctctagagcc

SEQ ID NO: 502809 - DNA, 969 bp, Homo sapiens
  misc_feature (965)..(965): n is a, c, g, or t
ggataggcgtgggtttatgcatcgcaagagtcctggcaccctgactgcggacttggagaagaaatcgccgaggaggaacgggagtaagggggttagcagcttgtgcgctgctgggtgccggtcaccccctgttctccgcgacttcacttcccatgaggcctcgctcgcgactggaagtgctgcgagcctattagaaggcgaggcgggacccgcctgtctgctctgggcgcggattgccggtcggctgtatggcattcatgggcagtgtcttctgcactctcctaggggaatcctcgggatgctggcaggctccggctgcctggtagtcgagaggcgggttccggagatcccggcctcacttcgtcccactgtggttaggggtgagtcctgctaatgttaagtgctttgctcgaggtgcccattttcgcatggaaattggacgtccgggccagttctctgagccgtatcattacggggctaacgggagtgcgtgatcagcgatggtgtctggacggttcctagctttgttctgtctgctgctggggtccctgggctctttgtgctttctcttcactatctactgggtgccgtaccgtgggcgtggtggctttgcctggaattggttgcatctgcttgttctatggttgccagggcttttggcttgtgggctgggtcagtcccatggactgtgcgttcatggttggaaccgatctgctgccgatctgggtcggggcccgaatgtgcggtaagggctttgatgacatgctgcatgacttcgcacgggggggcgcctgcccagtctcacatctgagaggccgttcccttctgctgctgcgttcctggttctcgcctcgcgtccgcgggccaccccgggacgggcccgcaactccttgccccctttccgctgctaaaataccctcaccgccgttgtttcttctctctcgtctgtcctttcttctcccggnagtc

SEQ ID NO: 502810 - DNA, 1352 bp, Homo sapiens
ggggagtacctccttgctctcgcccctactctttctggtgttagatcgagctaccctctaaaagcagtttagagtggtaaaaaaaaaaacaaaaccaccaccaaaaggctcgaagccacaaaggggatgaaatttctttctgggacatcctccggggttctcccggtaaattagatcggtatggcgtcctctaagaagtcctatcgggagcaagctttatatgtcctaaaggaggcagcaaatatcaaagcaagacggggagaacaatcgtgagcatggatataacaagggaagtatgcggggctatggagaataggagcgagattgtgcagtatgcaacctatatgacaatagggaatacaacctttataataagcagaagacagggagaacatcagtggagatatattacaatataaggcgctgtgagacacgtggaacgggaaaacgacagatagtgagacacaaaatagcaaacgtggatcaatgggcagtatgagccaagcgagtatcacccaaaacccacattgtcagggacagggaacacaccgaccccatgggcacaacgacacaagccaccacagggacaacaacacggaacatactaagcacacaccaccagagcaactcacatgcgaacacacacgaccgacaaccagagcggtccgaaccaacgactgacaacgcgacaaaccacctcactccggggcacacacaccaagaagctcacaaagccaagctcgtagaccagcgagaaagccagccagacactctcggcgccaaagaaaggacggcagaccaagaacgcacacacacgacgagaccacatcccagcgcaccaacaccgaccccaagcgaggcgccacacacaacacgcacacagacgaaagacgccaaccaataccaaacgcgacacaaggcggcacgcaagcgccaaccactaacgtacgcgacaacgcgcaccccaacacccagaaatccaaaacagcgagacccacccacattagcaacaggacgcgggcacaccccaacgacaacaacagacgcgcggcagcccaacaataacacacggcctgcctgtgcagtccggtcagaaccagcaactcgagcaagacagcacaacaacgccaacgcaacaatgaacgacagcgcagaaggagtgcagcacacaccaacacacagataaagggaaacgcagccccactgacaagggacgcagctacactgagacaagcaacaccacagccgaggacaaccgcgcgacgataagatcacaaccaacgtcaccaccgcaccccacaatcacatgcacgaagtcggcctcagacaaaactacacctgaagaacacgaa

SEQ ID NO: 502811 - DNA, 191 bp, Homo sapiens
tgatattccgggatctgatagaaagcactacccacgacccctacccctaccactagcactatcactactcactgagtagaacaactacccacgaccccaacccctaccactagcacgatcactacacaccgatagaacaactcactgatagaaacactacccactacccctacccctaccactagcactat

SEQ ID NO: 502812 - DNA, 551 bp, Homo sapiens
acagctgtacccccaaaaatatttaataagcttacacagaaaatattattgcctgaagtttatgatctttaagttatcaggtcaagaagagtttattgttgttgttgttgttgttgttgttgttttaaagcacacagtgaagaccgtctatgaagcgaggccactgttcctcctggtgggacgatcgatcctgtctcagagacctgtccttcagctcctttaaaaaacagaaccagcacagcgtccacaccgacagcagttactaggggcatagtcctccggtcgcagagggtggagttgaggcagagctcagtggtgtccacagaaagcattagtcttaggtactgtgttaaaacaatcaagaattcattcatgtttaagaggttaataaccataatattaaaggattaattataaacacctggcaaaaaaccacatcatcccttttcaaaaataaaatgttcatattcctctgagcaaacatcacaagagcagtggccatctgcctcaggcctgccttgtctgtaaacagctgtaaaggaaagctagca

SEQ ID NO: 502813 - DNA, 333 bp, Homo sapiens
agacaaatgtgcatgcgccgtcaccaccgcacggatgtgacccacgactgtaccatgagcgccaagtgcagctacctgtgtcactatatggaccacatgtaccgatgccagagcaagcctgtgttcactggcaatggcatcatctgccatgaggacacagacctggatggcttgcccaatgagaacctggtgtgcgtggacaatgagacttacacactgtgcggattattgtgccaacctttccaacttaaggccggaagacactgacaaggatggaattggggatgcctgtgatgatgaccactactgctatgtgtcacagagtgtggtggg

SEQ ID NO: 502814 - DNA, 238 bp, Homo sapiens
gacataacagcatggaaaatgaggcatgcgcaagaaatttacatactagaacacagagcatcaggtgtatgagaaagggtgtgtgagaagtctgaaaactacagaggaaagcagggtcttaagcggctggggactttagactgtaggcagggaagttaaatgggtagttatgagtgttagatctcttttctagtaatgtggaagatactttggggtagtctggagagtgagactagtc

SEQ ID NO: 502815 - DNA, 884 bp, Homo sapiens
aatgtcggtgctggtgcggtgctttagttgaaggttactggcccgtcgtgcgaccagtcacagggaatgctccgggacgccagcgcacgcggagcggggaccccggagagccagcaggcgagaagaccggccgagggagagccgatcgcgcctcgagagatccgaggaagtggtcgcgggccgggaggctacccgtagccgagccagaggccaggggtactaggggtcagcagcccaggtcgtagcctagcagctagccgtcagctacgaggagcagcagctagtgcccgggatacccggaaggcggcaggggagacaggaggagctagcagcttgggactgtaggcagctaggagggagagggccgggctacccctaggcgggagcacgcgcagggacgactaggctgaccggcgggcccatggcgagtactatgacggagttcgctacgggcgcagggggagcagccgaggggcgcgcccctcccgggaagggggccaccggagcgcaggccagcagacacaagattctagcgactactaccagcccagcgagaggcagaaagcgggaataaccatggaaccctgtgaccaaagtgagagccccaaaatcaagtggtggattggactacgagggtagaatgactgcctgcgaacaatattgtcccatcagagtattggaaccgagagaacgcatcagcggcgaagcctgcatcatgccgatttcccatcaggacctgagggagcagggtgatccacggattgggacacaggacgcatgagtggcagctgggcccttctctggcctggctatgggcttaattaatcctagcactggccggagtggggttttcccttccaataactgtcccgggaagccgtaag

SEQ ID NO: 502816 - DNA, 269 bp, Homo sapiens
gtttaaaaagtatactcgtgtattctttaacagctaaacagaaaatccaaatgaggcaaagtcttcagtcccgaccttaacattgtatagagagggataaaggtcgatggcataatcgcatgaagaaatcctcctgtcttctgaaaatgaccagttgagttgactgtgctcgcattgcataatgacgtcttaagacgctttgaacaatacagctatttctcactgcgacttagtattattctccattcccactcatcgcaatgccaaca

SEQ ID NO: 502817 - DNA, 359 bp, Homo sapiens
gtcacagccaagagacaacaggagcagtgtctaggaatacatgttcgtgcatggcatggtggggagcctacagagacaaagaccccaaaatgatttctcccagcagcatcccccaggccaacttgcagtcccagtttagggacctttgaggtccccaggtgggcacgtccagtccgattcaccactgagtccctggttcctagagcctgcctgcacaccagaaggtgttcaatgaggtggttcagctaaagcataagtgagcaaatcccatacagataagcacgtgaggaatggaaagataaccaacataagaatcctcagtaaaatatttagttgacctaaaacagcatgcagacaaa

SEQ ID NO: 502818 - DNA, 661 bp, Homo sapiens
cttatggcgctgtgcttaagagtaaaacttcagcgatgtttaccatttaaacataagttggaaatctacatttctgaaggaacccattcaacagaagaagacatcaataagcagataatatgacaaagagcgagtggcagctgcaaatggaaaacccccaatttacgggaacatttgtggaccaagttgtgtcctttgaaccctgattgatagctgttttaagagccactggcctgtaaatctgtttggactatatttgtcataaactcttgtgtactacatgtcacgacgactcatgtttaactacataggtgattggtacctcagagacattcttttaacaggattcctttccaagcgagatttaactctataacggtagtacctaattgtgtacaccttgtatacaccatttctcaggcattggtaacacctttaacatgatccagaccagcacataaatattccacatagtcacatccatgtcgtcacagcatgaacgtcggcctaattttccctggatggcctcatttctgattaaccaacctcatttcaccggttgttcaacaataatctcactggtggccccaaatttgtccctccaacttcacaccattccattcactcctggtagaacataactttaaggccgccattcatt

SEQ ID NO: 502819 - DNA, 599 bp, Homo sapiens
  misc_feature (24)..(24): n is a, c, g, or t
  misc_feature (62)..(62): n is a, c, g, or t
  misc_feature (111)..(111): n is a, c, g, or t
  misc_feature (132)..(132): n is a, c, g, or t
  misc_feature (138)..(138): n is a, c, g, or t
  misc_feature (140)..(140): n is a, c, g, or t
  misc_feature (152)..(152): n is a, c, g, or t
  misc_feature (175)..(175): n is a, c, g, or t
  misc_feature (213)..(213): n is a, c, g, or t
  misc_feature (257)..(257): n is a, c, g, or t
  misc_feature (270)..(270): n is a, c, g, or t
  misc_feature (280)..(281): n is a, c, g, or t
  misc_feature (319)..(319): n is a, c, g, or t
  misc_feature (360)..(360): n is a, c, g, or t
  misc_feature (373)..(373): n is a, c, g, or t
  misc_feature (422)..(422): n is a, c, g, or t
  misc_feature (432)..(432): n is a, c, g, or t
  misc_feature (447)..(447): n is a, c, g, or t
  misc_feature (457)..(457): n is a, c, g, or t
  misc_feature (509)..(509): n is a, c, g, or t
  misc_feature (574)..(574): n is a, c, g, or t
gtgtctcttgtgtgtgtccttgtncgtcctcctccctgttgctgttgctctttttcgttgtntttcctggttttgtgcttgacaatgtggtcgttgtgggctttgccagcnccagcgtctagggtgggggcntgggtntngctgttgttgtnagtggtgtcctcctggtgctctntgttgcccaggttgcccttgggggggccctccgacgcntgcttcaccaccttcttgttgttttcttttttggctggtttttntagtcggctggtntggtcctccnntgtctcgttggcagtggggacacggaaggccttgccanttagcttcccgttcagctctgggttgaccttgccctctgcnttggcagcgccanttgtggcagggttgttgtcctggtgttctccgcgtccttttcgccacantttcccggangggccatccacagtnttctgggtgncagtaatggcatggactgtggtcatgagtacttccacgataccaaagttgtnatggatgaccttggccaggggtgctaagcagtaggtggtgcaggaggcattgctgatgatcttgnggctgtagtcatacttctcatggtt

SEQ ID NO: 502820 - DNA, 354 bp, Homo sapiens
  misc_feature (52)..(52): n is a, c, g, or t
  misc_feature (59)..(59): n is a, c, g, or t
cggggggccgctggggaagagacgttggttttaaaaaaagaactgcgtgcgnaaaaccnaacttctggtggtagcaatggggacacgggtcaaaggggacttgaggttatcagctttcagaatgaagacacataatccctattagagtggaagacttaaaatcgagtttgagacccaccttctgaaactgcaggctcttgggagcctgatttccggtgaagagtgttgctgctttgcatttttcacacttgaacacagtgaagaagatgaacattaattaggattatagtgccatggaggcttactgtgctgtgagaactcacaagaaataaaatgccatttctttttttggaa

SEQ ID NO: 502821 - DNA, 116 bp, Homo sapiens
tgtaggcaataaaaatagattaaggatactagtataacgagatcaggtacgtacctattactagtaagtgtaatggctcatcatattgtttaagagggtatagtcttgatatagta

SEQ ID NO: 502822 - DNA, 436 bp, Homo sapiens
cggcacgaggccaggaggagggtggatctccccagagcaaagcgtcggagtcctcctcctccttctccggcttctgcgtgccgatcgggacgatcacgggctttatcagagaggcgagagagcggaccatcttgagctgtaagcgtagaggcagcttgctgataaggaccagatgacagctgcgactgaaggaggccagacgttcagtcgggtgaacaatgagatcaggggtaggacccggatccagagagcgtaaccgtatacgacgtagctctttgaagaacatggggtgcgctgaaatcataaggggctataggataatggatgctaccaatctccatggtggctccactggtgtatctgtatcctgacattctcaaggaggaggcattccgaagagtttgtcgggcacgctcggaccatcctgaagctgccg

SEQ ID NO: 502823 - DNA, 895 bp, Homo sapiens
ccggctggaccctggtccggacacttctttggactgacacgcgctactccgacgcacggactgcggatcgtggttgccttgtgtcctcctgacaccgtcgcacgccggcgggacgcacgtgccgctcttgtgccaacccgacacacgcgtcaactgcacactgacaacgacaccgctggacgtaccggtgccttctagcacggacacaccgttctccaccccacaccccacgcttgacggccaactctggccctgcgacgagctctaaccacacgatacggcactcgcggaccgccgcaaggaccctccacaaacacgaccacagccctacgacaacgatcggacgtgcggacggcacgcataaccccccacgacagaccacacccccaagaaacggtcgaggatgccaggacggggcaaacacagacaccccacaatatacactgaactcacggtacttcccacaccacaaacgttccagggcgttagcccgagaacgtgccacaacaacgaccccgcactacaaaacacgtcgacaaggcaaccataacagaacaacacgttcagtagtagtttctcaggaggaccgtggcctggccaagacacaccaccaacacacaacgaaccacacaggacgagagcgaaacgggataacaaatgagtttacagcgacacttacccccaggacgaccggacctttaagcaacgcgaacaccgttcccgcaacctactgaacgtgacccaccttgacagcccttttgcggtcccaacatacttttccagagatctgagtttggcagatgtaaacggagagcaatgacaaagaaacgctacccccacggaaaccacgaaaccatcgagccaccgataagaccagactaggatccagagggag

SEQ ID NO: 502824 - DNA, 260 bp, Homo sapiens
ccagtcctcatccgagtgtgagagtgagctgccgtgtggtgagagtgagctgtggtgtgagagtgagctgccgtgcggtgaatgtgagctgccgtgcggcgtgagctgccgtgcggtgagagtgagctgccgtgcggtgagagtgagctgtggtgtgagagtgagctgccgtgcggtgagatgtgggctgccgtgccgctggatgaggggcgtggggtaccgggctcgggttcgtggtcgtggtcgtaggctgttccggg

SEQ ID NO: 502825 - DNA, 378 bp, Homo sapiens
ctcatgtatgtaggagacagagaaaggacagagagaattcacacctagtataataatatattttgactgggtctcccaaccccagaaagtcctggaacagacagtgtatattctcctcagagaaacacttgcccacagcctgctctgacacagagttggaagaagaacggttctaaaggtggattgcttcattcatttagttttctcctcaacacactgggacaaaaaggcaaaatttcagcaggcctatcaccttgtcccctggctccctatcgaatcagtatatgctttataaaccatccgttgatcgctcagggtcgtgtctgtccacacatgtccgcaccttcacctaataatttccgtctatgcccctcccag

SEQ ID NO: 502826 - DNA, 671 bp, Homo sapiens
tatgtacaaacgaaacatcaggccaggacaccatttatttaaccaagtaatggcgtagagtgaaccattattccaaggtgcttattgtcttttttcagaatgctcttaagctgttgataatatcgtgcgtgggtctctgagagaagtgtaacatttgttacaaagtactgctgctttgagcacatgtggtttctcttcatatgtctagtgcagggaaatcaccagctttggcatcttaatgacaaacagtggatgggtaattttatttctgatacgcatctttagagtcaaatatatcttttccctgtactcctcatgtacaaccaaagaacatacattatgaaaatgtgtattataatatctggaaacacaacattttcctctgcaggtgactttgtacgaacatgaaaaaaaaaaaccctgtatttttggtggtcctttggtgatcaaaggatatccattatagtagtctctggttatatcaacgggaaccggctgatacagtacaagtgtgaccatctcattcaaatggtcggtggtcatgattgcccatgggatatcggttcaaagaagctggatccttaatacttgcatttctggaatctggtctacataatttgtgtacaagtagacattggtgaactcacatggaatcctgcacgttgtgaaca

SEQ ID NO: 502827 - DNA, 103 bp, Homo sapiens
cgtgcgtagtccagctcgccgcttgtacctggccggcggcctttgctgctttgtagttcctgttggacctgttcgcgcgtcatgcccgtctgctggtcgatgg

SEQ ID NO: 502828 - DNA, 260 bp, Homo sapiens
  misc_feature (16)..(16): n is a, c, g, or t
  misc_feature (27)..(27): n is a, c, g, or t
  misc_feature (58)..(61): n is a, c, g, or t
  misc_feature (84)..(85): n is a, c, g, or t
  misc_feature (116)..(117): n is a, c, g, or t
  misc_feature (136)..(136): n is a, c, g, or t
  misc_feature (141)..(141): n is a, c, g, or t
  misc_feature (179)..(179): n is a, c, g, or t
  misc_feature (248)..(248): n is a, c, g, or t
gttaccatttattggnatttagttttnatttaagaattgaacataattatttttattnnnngctatatagcatgtcagattaanncatttacaacaaaaggggtgtgaacctaagnnctatttaaatgtcttatgngaaantttcataaagccattctcttgtccattcaggtccaganacaaattttaaactgagtgagagtctatagattccatactgcagatgggtcatgaaatgtgaccaaatntgtttcaaaaat

SEQ ID NO: 502829 - DNA, 229 bp, Homo sapiens
cagctggcccgggcttagagatatgagaggagcaagccaggagcagttcgaggatgggtactccacgcttctctctcgcatatgggcaagtgaagacaggttacacaggcacaggctctcccgtgcacgttctaggatctgccttggtgtgcattgggccagtaaggggtaggcagcttgcgcgcagttctcctttatctcactttattttcctggggagaggtgccta

SEQ ID NO: 502830 - DNA, 363 bp, Homo sapiens
gaccattgctcttctaaactgtgcttcatttgttgctgctgtggcttttactattttctctccctcctttgtttactctggtttattgtactcttcttttagttacttgttgatgtagactgttgatccaatatcctttgtggagtgaggagagaatgcaagtgtgtatgaagtgttagtgtccagtacatatatgcttggttcatgtttttgtaactatgtatgttttgtgtttgttgatgactcagtctgggacattaattattccattggatttagaatgactttgggaattttgaaactgttttttcacgtggactctgctgctgagtccttctattcacctgcaaaaaatgtcgacgc

SEQ ID NO: 502831 - DNA, 636 bp, Homo sapiens
gtgcttttaacggcaggtctccatctgaaggttcccccagcaaagtatggaggggtactccccgagaggagtctgaggtgtccggagcctgctgctcgctcgatgctgggaggagccccgtgtcccgccgctgcttgccaagggttggctgcgcgtgcggcgggagtagaggcgccttgcgcacccatggaagtgactgtttccccgacgcagtaaaaacaggccatccgatggccttttagattagccgcctcaggtttgtaacgaggatttattggttacgaaggaaggtggatttcagctgtgttctttgcgatggcaggccttaagcagaagagtcccactgcacaggctcagatacttcatctccatggctggctgatgttgtgacaccaatctggacagttgaagctatgaagaacagctcaaggtgaacatttgcagctcagaagaaacattttacaaaggactacgagtcttacatccaaatgctcaaatggagtcagtgtgacaacggctgtacccaaatctgagaggctctcttgtcttcatccatcctattataccctactcctggtcatcaatggttaccgaaaataagttccaccattctcttgtgaaccgaggtacaggatg

SEQ ID NO: 502832 - DNA, 442 bp, Homo sapiens
agttgggggttttagttgtagcaatttctttcatacccctgttcttggatccaagctgagggatgagctggaatggaagtgctagctttaggattgaaaaatctcaaaagaatgtagattggatctggaagctaaggaacgtgcatagaccttgaaagagagggtcaaggctgcaaagctgaccgccttgcctggaattgctcctttcaacagagctggggagggaaggaggaagtgacccaggcttccggccttctccccagtccctgaggatggcctagcccctgtggatctccctatccgttagagacgcatatggagcatgtacaggtgacattgtgtggcttctgcaatttgctggaagcagcagggaaggtcaggccgtacatgaagccaaaaggaccaaacaccagggggccgctatgactgttacaagaagttt

SEQ ID NO: 502833 - DNA, 327 bp, Homo sapiens
ggataaaacccccctacaaggaaaccctaatctctcttactgggcaggttccagaaattactgggcgcggatatcgcctaaaaagagccaggccatatttccatattttaaagaaccgcatcatgatgctgaaaatagcatttatttgggaattggggttgaaaactgaattgttgccagagaattaaaccaggtgaaaggtccttttgaattcagattgtcttctgaacatccaggctgatcatctgagagcagtcaaatctacttccccaaaaagagaccagggtagctttatttgcttttatttttaatgttagcctgtgtttc

SEQ ID NO: 502834 - DNA, 307 bp, Homo sapiens
gatggggtaggggacaagaagcggatccaggaagttggtgaaccatctaaacaagagaaggctgtggtcaagtatcttagattcaactgtacaacaaagtccaccaatatgatgggtcaccgggtatgattattatattgcttcaaaagcagtggactgtttactcggattcacagagagtaaatgccaacataggagaggaagctttattcacaaccagtgagtatgtacttgtctactcgcacattatttctaatgaaataaccctttcactatagctcctaaatgtcaccgatactgaaatctg

SEQ ID NO: 502835 - DNA, 389 bp, Homo sapiens
ggaaccactactcaacaataaagaggtataaactattatttggaagcaatctaagtgtccatcaactgatgaatggataaagaaaatgtggtacatatacacagtagagtactattcagctgtaaaatagaatgagatcctgtcatttgcaacaacatacataatgaataagatctaatattcactagcacaacagctgatgatagtcaataataatttaattgtatattaaaaaataaaagtataatggtattgtttgtaacacaaatgataaatgcttgaagtgatagataccccatttatcccaatgtgattattacacattgcctatatcaaaatatcttatgaactccataaatatatacacctactatgtacccacaaaaatt

SEQ ID NO: 502836 - DNA, 314 bp, Homo sapiens
  misc_feature (108)..(108): n is a, c, g, or t
  misc_feature (136)..(136): n is a, c, g, or t
  misc_feature (141)..(141): n is a, c, g, or t
  misc_feature (212)..(212): n is a, c, g, or t
  misc_feature (227)..(227): n is a, c, g, or t
  misc_feature (237)..(237): n is a, c, g, or t
  misc_feature (249)..(249): n is a, c, g, or t
  misc_feature (254)..(254): n is a, c, g, or t
  misc_feature (258)..(258): n is a, c, g, or t
  misc_feature (277)..(277): n is a, c, g, or t
  misc_feature (279)..(279): n is a, c, g, or t
  misc_feature (281)..(281): n is a, c, g, or t
  misc_feature (286)..(287): n is a, c, g, or t
  misc_feature (307)..(307): n is a, c, g, or t
attatttaatgggctatttaattaaggggtaggaaggtgctgtgggctggtcccccactccaggaaagaggccagtaaagaattttgccccctttttataaaaacttncagcgatggcccccccaaggcctaaacncggcnctggcctcccaggagggcaggggcattgggaatgggtgggtgccctccaaaaaggggctgctacctcccancaggcatgggaaaanccctggtgtnggggttcccccnaaaangggncctcatttaaaaaaaaggntncnaaccnncccttaaactatttttcctnaaacgga

SEQ ID NO: 502837 - DNA, 492 bp, Homo sapiens
gcccccgcgccggacccaacacatgaaaacacaaggaaaagcacaaaatgaatgttgtaagagcaaagagagcttcatcttgcatgccgcgcttttttgacaggaagaagccgcctcccccgctgcgtcgagaaggaatctgagaggaggcgctctggcttggcaagtaagatcgctgcagttcgtcaacggtgctggatccaggagaagaagctggcgctcctgttggcacggatgctattcagaatgtactgatggtatctggcccagaaagcaaaggggatcctggcccaggcatcgccaaaatctccgtcctcatcccaggtcaggagctcgacttgtatgtcatcccagctccaccgtccaatcagcgcttcatcccagatattcatctgggccctcatctgggccctggcatgttcctcggccatatccacatgcattgtcttgaaagcatcatccacagcctccaagaaatgagccttccattcc

SEQ ID NO: 502838 - DNA, 340 bp, Homo sapiens
cctgagacagagtctcgctctgtcgcccagcctggagtgcagtggcatgatctcggctcactgcaacctctgcctcccaggttgaaatgattctcctgcctcagcctcccaagcagctgggattacaggcaagcgccatcacacctggctaatttttgtatttttagtagagacggggtttcaccatgttggtcaggctggtctcaaactcctgacctcgtgatccgcccgcttcggccttccaaagtgctgggattacaggcgtgtgccaccgcgcccggccttaaattgctcttttatatcttttgaatttcaagcatgggcatactctattcaaaaa

SEQ ID NO: 502839 - DNA, 938 bp, Homo sapiens
  misc_feature (28)..(28): n is a, c, g, or t
  misc_feature (65)..(65): n is a, c, g, or t
  misc_feature (100)..(100): n is a, c, g, or t
  misc_feature (129)..(129): n is a, c, g, or t
  misc_feature (157)..(157): n is a, c, g, or t
  misc_feature (172)..(172): n is a, c, g, or t
  misc_feature (178)..(178): n is a, c, g, or t
  misc_feature (198)..(198): n is a, c, g, or t
  misc_feature (208)..(208): n is a, c, g, or t
  misc_feature (215)..(215): n is a, c, g, or t
  misc_feature (218)..(218): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(244): n is a, c, g, or t
  misc_feature (252)..(252): n is a, c, g, or t
  misc_feature (258)..(258): n is a, c, g, or t
  misc_feature (260)..(260): n is a, c, g, or t
  misc_feature (272)..(272): n is a, c, g, or t
  misc_feature (280)..(280): n is a, c, g, or t
  misc_feature (282)..(282): n is a, c, g, or t
  misc_feature (309)..(310): n is a, c, g, or t
  misc_feature (322)..(322): n is a, c, g, or t
  misc_feature (351)..(352): n is a, c, g, or t
  misc_feature (358)..(358): n is a, c, g, or t
  misc_feature (398)..(398): n is a, c, g, or t
  misc_feature (406)..(406): n is a, c, g, or t
  misc_feature (413)..(413): n is a, c, g, or t
  misc_feature (417)..(417): n is a, c, g, or t
  misc_feature (435)..(436): n is a, c, g, or t
  misc_feature (933)..(933): n is a, c, g, or t
ccccgcagacaccgtgctgccacccccnggtccctccagcccccctctggccccccacatttccnaggcaggggagtcccacttccaggagttctctggnccactcaccctccctactgtctcccaccncctgacacgggacgctgccccatccctncctttctcccctgtngcctcnggaggaagtaattccttccnctaagttgcnggctggngcngcccagagtggcancngctgcngacncaggctcncggatntnggaccccttacncctgctcncngcccttcagtctgtccttgcagcatgnngagggatggccnggaggggctgctctcaggatagggataanncaatancccagtgtgcagggccagtcaccagtgtgaagcaactaanacgagtcncggggcncccnggggaactgggggcagcnnggccacctgccaggctgtcctgggccataggcacgttcagaagacgaaggaaaaaaaagggcccgcagagctgagtacctgctccgcctgggccaggctgtcgctggcctggcggtccaggtcccagcactcctgcagtgtgtcctggaactgccggcaggctcctccaggatggagctgctccggctgggccaggactcccagtagcctggctccacccagggctgggcctcggtggctctggggcctggactggagctgggacgcaaggagctgtccaggtctcggcacagctggtagaactcactaccacgcccaatcacacgctcaccgtcgatgactttcaggccaggcagcagctcccggactgcagcccagtaggaggggttggcacagagcgggttgctgagccgggccaaagggtctcggagccgcagtaactccaggcacggtagcccagccagacactgcagctggcccggggtggcagtaggttnctgcg

SEQ ID NO: 502840 - DNA, 395 bp, Homo sapiens
ggccaaggcaggtggatcacctgaggtcagaagttcaagaccagcctggccaacatggtgaaaccccctctctactaaaaatacaaaaattagctgggcgtggtggtgcatgcctgaaatcccagctacttgggaggctgaggcaggagaattgcttgaacccgggaggcggaggttgcagtaagccgagaccatgcttattgccctccagtctgggcaacaaaaatgaaactccgtctcaaaaaaaaaaaagtaggtcaattcgtaacagtttattttgggacacaccctgaagcttttgttttgaattaaggaaatgagtttcagggattggacaaacctttgtttaaccagctgttcctggggctatttgaggggggttttcctttttccgg

SEQ ID NO: 502841 - DNA, 343 bp, Homo sapiens
tgagacagagttttgctcttgtcgtccagactacagtgcaatggcgtgatcgtggctcactgcaacctccacctctcaggttcaagcaattctcctgcctcagcctcctgagtagctgggattacaggcgcctgcaccacgcccagctaatttttgtatttttagtagagacagggtttcgccacgttggccaggctagtctcaaactcctaaccttaggtgatctgcccacctcagcctcccaaagtactgggattacaggcgtgacgaccgcgcctggcccaaaatgttaattttataccttgcaaaaaggttaatttatcctcaatggaaacatatgatt

SEQ ID NO: 502842 - DNA, 1017 bp, Homo sapiens
  misc_feature (299)..(299): n is a, c, g, or t
ggtactgtgttactccgccgaccgttgatctctactagcataaggtgcgactctgagagccgtcactgatggcgacgggccgaagaatggcgtgtgaaaaacgagcactaatctcatgcagagcgagagaagaccgtgtgccgaagagttatcagcggatagagtggcagaatcatagtagagtagtatcacctaacgatgctagaatagcagatgatggctgtctcctaagcaacggcctgggcgagaaagcgaggaggagtgccctgcacgtgggtattgcgctctcaggttaaacnttgcatcaaggagcaaagacatttatactatcagcaatctcggttcatccatcgagtgctgcattacaggatcgatggtcttgtagtcgtatgatccacatgccaggcctcggtcgtggtgcgatattgtacgtgtgaacgatagaggagctgggtagctttagggctatcgtgtggtgctggaatagatactgtggactgccactgcaagtagtccttgcgaagaaaccaaaccgtgagggagaaccgatactctctattgttacaatggtagtgagtctgtccacccacaccttcattacatcgacccacaattttttcctactgggtagtccccagaaagggatgtctactattttaggtgcaacgtccagtggggagtgtcatggaagctctgatctgtgctttcgaaccatcctgggtgcctgcaggtctgtctccgtggtctgctccaactttgtactccgtgttctctgtcccctgcctgcaggcaaggcctttagctgtctattgggcgaaccagatctcgtcctggagggcttgtcatggtatcccacttggtgtaatcctttccaggatctcggtggcctagctagttctgcagtgccagatggcacctcttttatggccggtctcccgggtacgtgaagtgtgtgtggggaaaaacccccgggtcgcttgcgaagggtttctgttgtttggcccttatgccctgcaa

SEQ ID NO: 502843 - DNA, 411 bp, Homo sapiens
tactagactattcgatgtctgagagcatttattcagaacagatgggaggggcaggatccaggatggccggtgggcacaggcctacgtgtaccatatgaagccgtggctggcatggagagcctcctactgtgagtgcgcagcccgtacagctccccgatcaaggggggcacccagcgggtagtagtggaacacagactcccccaccttccagtcgggcacgtccttcatgatgatggcctcctcctccaggttctcccgaagacatctgcaatgtcctccggtcggtttctgcctgtcacagtggcaccagcgcgatgcgagcctcgaagtcctcgattagtaggcgcctgcgctcacggaaccacttcattatgctccagtgcccgtagatcagggatccaatcccttgga

SEQ ID NO: 502844 - DNA, 856 bp, Homo sapiens
agcggagaacgccgagggctggagggaaagcagcgggaggggcggagggaggggattcgggagcgtccagttcagctcgcatcggcgcacccacgcctcgctgccccgcgttccgtgagcctctaacctgggcgatgcgcacacggatgaacctaacattattgccgagaggacctgtactgttgccaatggctgttggtataggcattgttccagtagatacccgcagggatcgcaatacgtgggacatgaaacgcacgcattcgcgggcagtgtcccttgtgatccattttgagccagagtgggggcatacacagcgcgagttggttgacagactaggacgttgagactgtaacgtgactggggagtaacggaaacgcagtcacgtggccgacggcgcaggtgatttacccgtttcggcgatccggacagtgggctgcgaccaagatcacgcgcaagggacagttcaactagcgttgagggacagatagagggccaagacaagtgggtttcgcatatcaggttgtggcaggagcaggacgagccataagaagctaaagacggtggataatcgacatagatcccacttgacaatatatccaccgcaaatgtggaagtcattgggactgatccgggctaacacaaacgtgtggggggtaacggcaaccatttggtcaagaaaacgtaatcgtggtacctaccctatgaaccttttcactactaaactgtcaggccttgcggtcgtgttggctccgctggcaagtggacggcacgccaagttgtcatggttttgtatcgggatgggttcacactccattgataccacacaaagggggcaagttcgaaagcagataca

SEQ ID NO: 502845 - DNA, 434 bp, Homo sapiens
tcctgtttgagagagaacagcgcccgaactgctttcaggatgtatcgcttcaactgctggcaccgaagcaggtccaggtccactatgtcctgcaaaggcctgtttagtcgattatctttattttgtgctttatctaacttcgcttccagacgaggttcacccaactgagcccagtccagacagcatggagctctagtgcaagggccaggttgttcacacttaaacggccacggacaggagagctggacgaggacacacgaagctgtcagcagtgtggccacatatgactaaccaaatggaaacgttctgaaacgtcatcaataactatggagcttaatcctagaaatgccacacatacccgtaagcctttttatagctgagaataatcattttttaaaatgacattaaaggcaggatagagatttacacatata

SEQ ID NO: 502846 - DNA, 900 bp, Homo sapiens
gctggaatggaggtcttatgagctgctattgaacacggcagagccgtgtggtgacctgcacacaggatccctccagtcagtactgagtgaataactcaaggctgcctctctgcgaagtagatcactacaggacgtcgggactgggcatttccttgccaacatggaccgcactgcctctccgcagtgcacatcgccatctgaggatgccgattactgagaatagcagtcttctattatctatgatctaccctggaatgaagtggccgttcatgctctgcaggaaggaatgcaaggggatgctactttgggcaaagatcttccatcccagctcttctagtaggccatgacttgttatgtagtcagggccatcagcggagaagccttgccgttcattgctcagtgagtgcttgcttccgctgagcgtgcgctcgcagtgcggactggttgagaatcatatctgctgaaatcatggccactctccaagcattctgtttctcggtgacactgaccctgtctggaggacatctcacgtggtcctggccagttgtggtctatcggtcagatcttctatgtgcaagagtggatgaggcacgtcttatataactgttaacctttaacagctggccatcctttttcacttacgctgcatgacgcctgtgacaatgtacctgggaggatcgtgtcactgcgtcaagcccgtaccaacagggctgatggacccgggacaacgagcctgctccttgctagccatagatatggcgcatggtgtccctgggccgtgctaccatcccctgatcatgggtgctttggtacatgacgacttgcaaaatcccaaggagtgttgtgcgaactggccaggcagaatttcgtgcgtgcatgggaccatatggaaagctcttc

SEQ ID NO: 502847 - DNA, 431 bp, Homo sapiens
  misc_feature (115)..(118): n is a, c, g, or t
  misc_feature (129)..(129): n is a, c, g, or t
ggaagcccgctcagattgtctctcagagcctgttcccaaatgggaagccaccagcaaaaaaatcccagtgggctgtgctcttcatgtcctggttgggaaattcaggaagcacacnnnnacacacacatnccacattagaaatactatggtttggccgggcgtggtcgtcacgcctgtaatcccagcactttggaaggccgaggtgggtggatcacctgaggtcaggagttcgagaccagcctggccaacatggtgaaaccccatctccactaaaaatgcaaaattagccaggtgtggtggtgcatgcctgtaatcccagctactcgggaggctgaagcagtagaatcacttgaacccaggaggcggaggttgcagtgagccgagatcatgccattgcactccagcctgggcaacaagagcaaaactatctc

SEQ ID NO: 502848 - DNA, 258 bp, Homo sapiens
tctcaccacccaaggtctgttctgatgcagaatcaccaaggtagggctcagagctggcatatcccatacccaagtctgacgtgccccccagcgtccagagctgggccatgctgttggttgctcactcctcacatccccaccgttgaagaggagaaataaccacccaggaagggggttaggttgttcccaggggccactggggacctgggttaaagaagagtccaggggaagctggccggggttgggttgagaggcggg

SEQ ID NO: 502849 - DNA, 281 bp, Homo sapiens
gaacaatcagacaaaggtttaacataatacatcctaaagataaccatgccgtattaacacttatataatagctctgcccattgaaaggggctttaacttgaatttctctattacatcctcctaactatcatgtgaggcagacaagagacgggaccatgctcttgggagaaaaaagaaaactgctgttcagattaggccacagctacggcatagcacaataacaagcaaccagagcccagatcgaaacacaattaactcaatagaatacgggtggtacaaat

SEQ ID NO: 502850 - DNA, 220 bp, Homo sapiens
  misc_feature (115)..(118): n is a, c, g, or t
  misc_feature (129)..(129): n is a, c, g, or t
ggaagcccgctcagattgtctctcagagcctgttcccaaatgggaagccaccagcaaaaaaatcccagtgggctgtgctcttcatgtcctggttgggaaattcaggaagcacacnnnnacacacacatnccacagacatgaaaaaggttctgtcttctgaaggctgttgccgatcttaacatgaattgtaaaaatgatttgttggtgagtcattgtctag

SEQ ID NO: 502851 - DNA, 347 bp, Homo sapiens
gcgatgaaacatattaactaaaagtgaaagatacatattctgttatacgtgcctccctgtttaaggagttctgtatcaacaaagacaactgattgtgggaagtatcatgatgataggttctacaggaagataatcgagaatatgagctccgagtatcactagcatcttaccgggctctttaaaacatagcattacccagtataggtcaaatcatacatatgtgaaacttatatgattattttcctaccaatgagtgattcatcataattttcattatgccttcaaaattaaccctgagagaggccagaaacccattctgctgatgaagaaactgaggtaaagatttc

SEQ ID NO: 502852 - DNA, 350 bp, Homo sapiens
ccccaggggccttaagtctttaaagcccgccctttttcctttttggtgctttgggcccccagggggtggcgcccccggcctttttttggcccaaccctaccccaaccttggtttcagccccctttgtaggcggtgggcccccttgggatttttaccccgaccccccttccttggcattttgctgggggggagtttagggctgggggaaccttttggttttgtattggctttggaccggggggggggttaagttggtttggggggggcttttttggcccttttagccccccccttttgcattttgtggggggtcttcccccctccccatgaaggccccctcctttttttta

SEQ ID NO: 502853 - DNA, 165 bp, Homo sapiens
  misc_feature (2)..(2): n is a, c, g, or t
anaacacacaagcttactttttttcaataggcaagaagatgtgtgacaacagccttaaaaaaaaaaagcctaagaattccagtttttcagcctggaatatgaacaaagtttttttaataccaaaggaaaaattgccaccaaatgatcaataacttagggtttaca

SEQ ID NO: 502854 - DNA, 117 bp, Homo sapiens
gtgcatgcttctctaaaagttaagaagatgttttccttgctagaacaaatttctgtgaattaggcaatgaagtcaatttgggagccacgttatttaaggaatgcctggaaggtctat

SEQ ID NO: 502855 - DNA, 1025 bp, Homo sapiens
ggctggcaggcgaaggatgccaagatggcggcagtgcggttcgcatccgggggtagtgttggcctcgcgagatgctggtcctcccgtgagtgctgtgccgggatctgttgtgaaggggcccgggcgggccgagctgtcgtgagggactcctgagtggagtggtcgtgggtcggtcacaggttttcgtcttaccaggaggtccggaggcagaggtcgtctgctgtcagagtctagggccatgctggggggcaggggggttgcgggggttggccgggtggtctggattccgggttggtgagttgccaggtggaaccttggaatggtggggcccccccccgaggttaatcggggggtcctcaacgcgggggacctcacttctttctcgtttggaccccaacaccaaagacattcgcggagaggggggttccccaaggtttattatacgcgcagggtggtggcgccttcctttgccaacaggagtggacacttgcggtggcactatacccgccacactgttggtgggcgcggttgtgcaacaccagcggggagggatgaaaggcaaaaggagacgctggatttgagagaggttgaaggttcacaagacgggcccccaatttagaagattggggagagattgtcacattgggggccaggggaaacgtttgtccagatttatttcccaaaaaaaactattacccccaaagagggtggaggcttggctcggaggttcgcacaaagtggaggatttgcccctgacctaaggattactcggggaacagctaggcattggctgggaagagcaacgttttctccctggtcgggactaagtgagacccaccgacgcgggtgttcactggggggagaggttctaatttagcactatttctggcgagcattgattggcctccaattaaaagttttttagttttggtgtgcccgtatcatgtcaaacacagggaggtgctctcgggggttgagagaagagacaaaagtggcaatagtataggtatcgtcggcccaaaaaa

SEQ ID NO: 502856 - DNA, 246 bp, Homo sapiens
cacgctcagccgggcgacagagagagacccgtcttaaaaaaagaaaaaagaaaaaaagggatccatggtggctggagtatagagaatcggggagcaggcagagatgagaaagtagggctgggctgcatggtctcatgcgccataggtaagcaattgcgggtttatgagcatcacagggaagcagttgtgagggcaactgatgcaaggtaagtgacagggtatttacagtagaacaaagtttttggt

SEQ ID NO: 502857 - DNA, 969 bp, Homo sapiens
  misc_feature (72)..(72): n is a, c, g, or t
ccgggatatttggctggcgcggagccactgcgcgctgtctattcctggcaggggtctggcgcggataacganccaggtcgcgggcggggggcttgagcgcgtgcggtgccgaggagccgagcatggagtaccaggatgccgtgcgcatgctcaataccctgcagaccaatgccggtacctggagcaggtgaagcgccagctggggtgaccctcagacacagttggaagccatggaactgtacctggcacggagtgggctgcagtgtggaggactgggaccggtgaacatcatccacgtcactgggacgaaggggaagggctccacctgtgccttcacggaatgtatcctccgaagctatggctgaagaggggattctttagctctccccacctggtgcaggtacgggaggcgggatccgcatcaatgtggcagccatcagtcctgagctcttcaccaagtacttctggcgcctctagcacctggtgtaggagaccaaggattggcatgctgtgtctccatgcccccctacgttccgttcctgaacagctcatgggcctttccacgtcttcctccaagagactggtggacctggcagtggtggagggtgggcattggcggggcttatgagtgcacccaacatcatcaggaagccctgtggtgtgcggagactcctctccttgggagtcgaccacaccagcctccgtgggggatacgggtggagaaagatcgcattggcacgaagggggcgtcttaggcaaggtgtcccttgcttcaattgtgctccaccttgaagttcctgccagtgctgagggccgagccagagatttaatgtctcatactgtgtcggtgatgggccttcagaagggcgccggcggtaccttgcctgaggtgaggaccagggcagagcggtttgttagtgccatgttgttcgggtgaacctggttgtgcaaggacagcaggtcttgaac

SEQ ID NO: 502858 - DNA, 171 bp, Homo sapiens
  misc_feature (38)..(38): n is a, c, g, or t
ttcggatgggtcgttctgctgcacaaccacaacaacantacaggcataggagccccccttaatgagcagcccctcttccggccaaaccgccgggcaactggaaacacgcggcattgagccggtcccggaaggcgagtgcaacggtcatccgctgcaactgttctgggtgtg

SEQ ID NO: 502859 - DNA, 1182 bp, Homo sapiens
tccgatccagcgaagcgctgcgtcctcgagtccctgcgcccgtgcggtccgtctgcgacccgaggacctccggtgccgcgtgcgattctgcgtgccgaaccggaggactactggccaacagccagtcacaggggctgcgcaacgtacgcggggctccgatccactgacgttcctcaggcgtttgacccgcaagccagggtatgcgcgatggctcgtgctactacatgccaatgcaagggcgtttggctcgatggaccaggaggcactctactggcactgagtaagtcacacttctactggtcagtcatccacgggcagcaggctagggaggatctgcacagcagcttgacaaagtctctccctcgaacgggcacatcggacctctcagtaagtcgaagagtttaaagacgtacttgaatttcgaacggtggcaaaagattcagaacccgggttggactgtggtcgaggcgctagacttgaggtgcacacgcgtgccttagttggctgattgcccagagagcatacacttacagaggactagcgcactgcgtccgtgggcgattgttgtgccagctggatttcgcagaaaggtgggccgttcaactttgaggactcttccgggtcgtgtcgcccgggtaccctcactggaggccaagagttgtcctcccaagtctggggtcggccatggccagtcaccaagaggaattgctcgttaccgaaagccggggaactctgggacagggctagacaattcatgtcgggccgtatcgacctcgttgggccagcgttcgccatgacaggacttgcttttggtcgtggtgcctggggctccccaagtggaacatgcaagggcgcaaggggagggcatttgaggcgtaactagcacgccgcaggggaaccttggtggtcacacaaccaagggattgtgcccccaagtggaccggaaatagcggaaatgccacgagggagaacgcgttgaccactcgggcgcggaaccccggagtggaatggcccccaggttcacacctttacaatcccatttgcggaacccaaccgcgacgaccactcaggcatgctcaacgggctgaggagagccgacaggacatactctagagccacaccaaccgtgtagacccggagatgaagggcaaaccacaccacagtgggcaaaatcatcaagag

SEQ ID NO: 502860 - DNA, 674 bp, Homo sapiens
ggcgacaatgtaccatcgatctatctccatgcgtgagcatcgtaccgcgtggtttaacatttcgtttgatattattcggtcgctacctaccatctccacagcagacctgaaatcacgccaggacatatgtccagcgagtctgctgaaacagaggtttcgtgctgcaaggatacgtgtaggagcaacgtgcagatgtgagcacgtgtgctcgcttccatggcttgaccgcgttcgtggagggcgtgtgtcccttctgtcggctcatgaggaggctcggggtgaccagtgtgacagagtgtggcaagctcatcaatgctgtcgagcttaagaagcctcaggtgtaaagtctgccgatcatgccctgtggtgcagtcgagccagcacctgtttctggacctggctaagctggagaagcgactggaggagtggttggggaggacattgccatggcagtgacgtggacacccaatgcccaggtgtatcacccgtgcttggcttcgggatggctcaagccacgctgcgtaacccagtagactcaaatggggaaccccatgtacccgttagaaggttcggaagacacatgtatgctatgtctggttggatgccgagtatgggctatctgtccatacagaggcaactacacagatcagtgggagagatggtggaaagaacca

SEQ ID NO: 502861 - DNA, 239 bp, Homo sapiens
atcgagccggtacccctacgtgagaagtgtcaatagcaattgggtgtctcttccttggggagatcctagccagattaccagaagtgtcgttagtcatctaaatcagagacatcaattggattatggagaattggtgaagtcttcagactcagatgaaggaaaccgcaataccagaactgcgtgttgaaactgtctataaacgtaggggggatcctcgtagacgtcgaccgggctaggca

SEQ ID NO: 502862 - DNA, 184 bp, Homo sapiens
  misc_feature (77)..(77): n is a, c, g, or t
  misc_feature (89)..(89): n is a, c, g, or t
  misc_feature (109)..(109): n is a, c, g, or t
atgacccgacggaagacagaggagggccttactagtcaagttagacatctgaccttgaggacagttcaacatgtcantcgggctagatnagcaaattctttatctagtnaaaatggctaggcatggataatatgtggttacttattctccttcctcctccccctcctctgtgctgtgctgtcca

SEQ ID NO: 502863 - DNA, 243 bp, Homo sapiens
aattgatcccacacaccccaaaacataaagctgaattaaaccgttcatccgcggaaaggggtggagagggggggttttatatgaggtaaagaggcccggaaggggccaccatcaaaccaatgaatcgaatcctgcaggggcaccatggacacatggggagacgttaagtgtaaactgtaggattctcaaatatttacatggaaaatacacttgcaggtgggaaggactgaaggcggacggggt

SEQ ID NO: 502864 - DNA, 777 bp, Homo sapiens
  misc_feature (272)..(272): n is a, c, g, or t
  misc_feature (476)..(477): n is a, c, g, or t
agcggactaaccccgccaggtcgcgggcactcccaccagctcgcagccctccttcggaccctcgatccgagagcgccccagccagagcttgtgcccatgcccctgtcccgcaggggaaggggatcccgcctggccggctctcgagcggcgactagtaacctcccgcgggcgacagccctctccccaaagagtgccggccgcggggccctgtctataagccacgcgcaactcctcacccggcggcgccattcctccgagcaggtcccgccggngtccgagccgcgggctgacttccgctcgggaaagtggctccaagagcccgccacaggggacgccagggactcgcggcaggctctgcgggccaggatgagttctaagcacaggatctgtagtcaggaagaagtagtgatcccctgtgcctatgacagtgattcagaaagtgtggatttggagctgagcaacttagagattattannaaaggctcaagtagcattgaactgacagacttggacatccctgacatccctggactccattgtgagcccctgtcacatagccccagacacctgaccaacaggacccgctcagtgaggccattgttgagaaactgatccagtccatccagaaggttttcaatggtgagctaaagggtgaacttgaaaagctgaaattcctaggagatctgtcttctctcagccaagctttaccttatgatgaaaccggaaaatcattcattcacaggcacatagcagacattgtgcatcctttaaatgtcc

SEQ ID NO: 502865 - DNA, 293 bp, Homo sapiens
aacgcgtgatgcggttgatcagaattgcaaatcgtatgttgaagccctaaccctaccatacctcggcaggtgaccttgttggaaatagggccgctgcagatgtaatcagttgatgaggttgaatgatgtccttatgaaaaggggagatttggaggtgactcacacacagggagaatgccatgtgaagatgatggcagagatcagggtgacccctctacaagccgaggaacgctaaagaggccagcaaactccagaagctggggcagagccctgaagcagcttctccctcacag

SEQ ID NO: 502866 - DNA, 479 bp, Homo sapiens
  misc_feature (272)..(272): n is a, c, g, or t
agcggactaaccccgccaggtcgcgggcactcccaccagctcgcagccctccttcggaccctcgatccgagagcgccccagccagagcttgtgcccatgcccctgtcccgcaggggaaggggatcccgcctggccggctctcgagcggcgactagtaacctcccgcgggcgacagccctctccccaaagagtgccggccgcggggccctgtctataagccacgcgcaactcctcacccggcggcgccattcctccgagcaggtcccgccggngtccgagccgcgggctgacttccgctcgggaaagtggctccaagagcccgccacaggggacgccagggactcgcggcaggctctgcgggccaggatgagttctaagcacaggtcagtgtccgcggccacgttgaggttcgaagctaccagcatccgcggccgcgatcccagtcctcccggtgacagggccctgcagttcccctcgtg

SEQ ID NO: 502867 - DNA, 1006 bp, Homo sapiens
actggattcgtaccttgtgtggcgtcgctcgttctgctgtgcgcgtggtgccttgactgtgcgaggacagccactttctggctgggaaggctcgctcgattattgtgtcgtcgcgcgcgtgtggggtcgcgtgtgcgctcgtgtggggggcgcgagttcggtctggcgttcgggtcccactatgcgctcggggttgtggtgcgcgccgcgcgccgcgccgagtttgttgtgtgccgcggccaggggttgccgggtttctttgttaagacgtggagtccgccgtccatctcgtgacgcgtggtagggttgtccgctccgccaagggggtagtgcgtccgtcggtgagcgcccgcgggggtttgaagccctgtggcgatggtgagcagcgttgtagagggcgcccgttcgtggggtggactgcccctgatgtgcccttatattagccgcactcttgtgccacggcaccctcctgttaacagccggccctggcaaatttttattgtacagagttttttccggtgaccacctgtgggcatattatgtcatatgacttcatggggccccctcgagaaggtagctagactggtgtcgcgctgcgagatttatatatatgcgatacacagctcgtggttctcacgcccaatcagcagattatacctataggagaggcgcggattgaagtaagtcagaagaccaccatgtctgcgtctgcgacgagagatactgttggcactccctgttctccctgctatcaagggcatatgctgcgctcggctgagtattcaccacagagcggtgcagcagtctcaacgctcttcaggctgcaactgccaattcttcggagccacttgagtcccttatctgcgccccccttgaaagtggaaaaacctctgctcctcacatatccttgcaagggggcataaagggctgagtatagggggggaccacttggccccggaaggccggtctccccaaaaacaggcggaaaattctgcccacataaaca

SEQ ID NO: 502868 - DNA, 1036 bp, Homo sapiens
gtgcattacatcaaacagaagtacccccaccttcaggtgataggggggaagcgtggtgacagcatcccagggcaagaacctgattgatgctgtgtgtggacggctctgcgcgtgatgcatgggtctgcggctccatctgcatcacccaggaagtgatggcctgtggtcggtccccagggcactgatgtgtacaaggtgggtgagtatgcccgggcgcgtttatggctgtgcccagtcatgagtcgcgagtggcaggacaatccatatcggccgtgggcacacaggtggtcaaggacccctggtccctgtgtggagacctcggcacgagtgattgaatggtgctgccgctgctgtgtggcgccaggtacgcggatgggcctcctgtgcgagatactctctatcgtacaggactgggggtgcgcgttcagaggacagtacacgggtgcagtgggccgtcactgtgcatgccatggaggaaggagcaggggcgtgagccagaagcgatacttcagcgaggcgcggataaacgtgagggatcgcgcccgggtgttctcgggctccgagtcctagggtagcatacccggatccggttcacgacatgttcagtgtacctacctcatagctaggtcgatccaacacgtgtggcaggaatatcggggccggagctgtctgtccttcgcgttcctgactgtgcgtccaggagaggtcaagtttgagccgcggacagtgtctgcgccagattgagggtggttgttcaatggctggaatgcttaacgagaagcggctgtcctgatgaacagcggtggaggcgaagtggtggaccgggatgaaccccaatgtcactttggggcaaagctcggctcctaagtgagggggtcacagaatttgggcaacgggctcccacgaccttcagagaagagggggagcacaaagagaagaggggcccctgaaacctcgagagagagaagagccgggcgtggttgagagaccccaaaacaaataaacagacggaaattaagagggcaacggcccacga

SEQ ID NO: 502869 - DNA, 191 bp, Homo sapiens
aaagcggtataaatgagcactggcttgcacatcggaacacaaaaaagacaaaaatatgattcagaagtgaacttagtattacttcactatactaaacacattgaagacactcacttcatgtggacttggagctccagaccttttacatccatcacagataggctggacgggttgcaattgctatgcacagc

SEQ ID NO: 502870 - DNA, 261 bp, Homo sapiens
  misc_feature (83)..(84): n is a, c, g, or t
  misc_feature (106)..(106): n is a, c, g, or t
  misc_feature (209)..(209): n is a, c, g, or t
  misc_feature (233)..(233): n is a, c, g, or t
gagcagatccgcggaagggcagaatgggactccaagcctgcctcctagggctctttgccctcatcctctctggcaaaagcagnnttttctccggagctttaccagnggaggacgctgcccccaggctgtttgtccctgggccgtgcggaccctgaggaagagctgagtctcacctttgccctgcgacagcagaatgtggaaagactctnggagctggtgcaggttgtgtcggntcccagctctcctccttccggtaactcc

SEQ ID NO: 502871 - DNA, 379 bp, Homo sapiens
gttgtgtcatgccaccctccacggtgcagtggcttgtgtgtgatgtgcagtccgaagcacaccgtcctttctcactggatggacagttcattgcactgactctgggatctcagccctgctcctgggagctggaggagcactttgagatcctaagggaccacaccctttctccttccctgcccacagaggcagagggcacaggaaagaagccgggccaagctcggagttattgtgccacaagtgttgtggccttcctgaactgggagtcctggctggccccggggagaggggcaatctcggactacactcaggcagctttccttctttccctgtatttcagattcatacctctacttgcatcaccatatgtgaagtaggg

SEQ ID NO: 502872 - DNA, 747 bp, Homo sapiens
agcggctttcggcggcggcggcggcggcggcggcggcagcagcgcggcccctttaaacgcctgcgggcccgcgtaggcacgacagtgcggcatgcaggtggccggagcgggcgcgaccgcaccgtcagggacactgatgcgcggcgggaccagcgagaccgaactagagcatatacacagtacgcaaggttggtagagtaacagagtagcaacaggtgcaataatacaagaacaagaagtaagaagaattcaagaagcaaaacaaagtgggaccaccgtctcgaaacaagtacatcgacagcgacgaaagccacgtacaaggggacaccagaagactagcagaggacaaacaaaggggcccccacataagacagaacggagggcacacagagggagctgagccaccccagtaacatcatgcagcgaagacaacagagacacaacgaacaggcttacaaagcacacaacgagaagaagcaaacacaaaaaccaagacaaacaaagtactccctgtcgggaaacatattacctggaccgagacaacacaaaccggtaagcagaacgcgaacgccatttaccattcgcccgctcactaccatcaacacagcccgaatgagatgtcttccccgcaaacacgagggcacagagacggccacgactgacaccatgctggaaacagctgatgacatgcgccgcgaagcgagtatcgagagggaaacacaacaccaacaaacaccggaaatgggc

SEQ ID NO: 502873 - DNA, 197 bp, Homo sapiens
cgaaattgccaggggggacttgggttaactcaagaacagttttttttggattccttatttgatttatttaacctaattaaattttaaaattgcaaatattcccataaggggggaaaagtaaaattccttttttgaaaatgggtcctggggttttagatttttaaattccataaaaaacattcttaattttcaactca

SEQ ID NO: 502874 - DNA, 141 bp, Homo sapiens
agagtggtgtatccatcacatcgtttagaacatcatcactccagaagaaacatactacccatcagcagccactgcccatttcccatgatctgccccgcatgaaaaccaccttcgtgatcatggtatctcccccgccgaatg

SEQ ID NO: 502875 - DNA, 326 bp, Homo sapiens
  misc_feature (13)..(13): n is a, c, g, or t
  misc_feature (18)..(18): n is a, c, g, or t
  misc_feature (67)..(67): n is a, c, g, or t
  misc_feature (109)..(109): n is a, c, g, or t
  misc_feature (211)..(211): n is a, c, g, or t
  misc_feature (250)..(250): n is a, c, g, or t
  misc_feature (265)..(265): n is a, c, g, or t
  misc_feature (270)..(270): n is a, c, g, or t
  misc_feature (295)..(296): n is a, c, g, or t
  misc_feature (299)..(299): n is a, c, g, or t
  misc_feature (308)..(308): n is a, c, g, or t
  misc_feature (314)..(314): n is a, c, g, or t
  misc_feature (316)..(316): n is a, c, g, or t
  misc_feature (318)..(318): n is a, c, g, or t
cagtgtccgagtntaccnctatttccagtggggcagggcccagcgccaggccgcaaaaaaacaaaanacctcaggaatcatgtagaactggggggctttttttcctgancaaaaaggcccaaggcatgctgtggaaagacttcccctgcccccattttcaggtcaacaggactaaagcgttgatggttttcaaaccctgttggaaaaaagngcccatggtttttctggttttgccagtttgacagtttanggaggctttttaatngtaanaacaatgtgagggtgagggaccccnncanacattaaanaatttncngngtttgtga

SEQ ID NO: 502876 - DNA, 105 bp, Homo sapiens
atacaaagctaatgtacaactaacagtgagtatatgaaaagtgctcactacgtttttacggcgaaataatcctgacaaagaatgtttaagtgaactgtacgtcta

SEQ ID NO: 502877 - DNA, 160 bp, Homo sapiens
  misc_feature (22)..(22): n is a, c, g, or t
  misc_feature (50)..(50): n is a, c, g, or t
  misc_feature (94)..(94): n is a, c, g, or t
  misc_feature (133)..(133): n is a, c, g, or t
cgacagtcagccgcatcttccnttttgcgttcgccagccgagccacactngcatgagacaccatggggaaggatgaaggtcggagatcaacggntttggacgtattgggcgcctggccaccagggctgctttnaactctggtaaagtggatattgttgcc

SEQ ID NO: 502878 - DNA, 750 bp, Homo sapiens
  misc_feature (404)..(404): n is a, c, g, or t
  misc_feature (493)..(493): n is a, c, g, or t
agcgggggggctctggtcaatcgaccgttgacgcaggtcggtgggtgcgtgcggagtgccgacgcggtctcacccccaaccgtcggtccagtcggacggttccgaggtcgttgccggggagccgggcgcggctcgtgtgtggacctcggagcaaacgcggggttaatttaagcgaggatctcgagtggacaagtgctattatgtgtgaaccaggaaattggaacgccacgaagtacgatgtcagccaaggcgtgctcatggtggtaggataccgcatgtctgccattgtctgtgcgtcagtcgacatgcggtcgagggcgccatctgatctgcgctcactccattgtgcgcctactctacggatacgctacgtgtgagagcgcctccgacctttcttcgtcccntatagtggccgaggcgattgtgggggatgcataggcatccttggtgtccgaactgcccttgactcgggcatcgaaatgttggcgctcgntctagtgccaccttgcgacggtcccagtgggcttacaatggcgtttgattgggacatctagtgctgaactacttcacttctagattcatagttggggccgatagttgctccgtaaccactgaacgtgtctatcaatgttgccaagaacgcacatgccctatcttatcttctgaagctggggtggattctgggtaacactgaccaggggtcgcgttgttgccatgtgcagtgtggcattcgaagtaggcatgggtgtg

SEQ ID NO: 502879 - DNA, 757 bp, Homo sapiens
ggagagaactagtctcgagttattttatttattttttttgcagagctacctgaggtttaattttgggaccaaaaaaaaaaacgcaatgaaattgtttggtacctggaggcttgggcaagggggttccccaggttataaattccccagtgttgggctagagggctagggctagacgccatcagtggggtactctttggtcccagtgctaccctagcataaggggcctactattacccagagctctggggcgacagcagcaacggacgggtgtaaggactggaaaggggctagcccagcacgtttgtacccactgtggccacgagacatgtcaagaagagactcaagaaccaccgaggtattccacatcgaggggtgtcatcgactcgtcacttatacacaacaccgagtggcccgtgggaggaacctaggttgcggcatgaaaggcagtactaggagccacggctgacaaaagcacaagatccttgggcagccccagtatctgatagcttaacagcaggggcatttgtagaacgagcgccccaaaataagagccagaccgtctcacagcaccaacgcagtgaaaaataagcacagacatgaggaggcaaactaacaaaaatgaacaatcacaacaagaggtagcgaggaacaccagcagaagatcagaagcgcgagataaatacaaaaggaccaaccaggaagaaaatacccaggaagaggagagagaagctacgaatgtccaagagcccactcatga

SEQ ID NO: 502880 - DNA, 328 bp, Homo sapiens
  misc_feature (82)..(82): n is a, c, g, or t
  misc_feature (149)..(149): n is a, c, g, or t
  misc_feature (232)..(232): n is a, c, g, or t
  misc_feature (259)..(259): n is a, c, g, or t
cccgggtagtcttacgaccctggtgccctgggctgccgcctgctcctcgctctgggcgtggaaagggctcttgcgctacccnagatattcacccaatgtccagggagcgttcaaaatttttaaaaagtggcctttttttttaaaacggnacgggacttatttttcatatccctttgttcttaacaaaaggaccctctttggtttgactcccgactctctcttggaggccccngcccaattctcaagacaacccctctcntaaccccacgaacccccaaagggctctccacaccacctgtgtttcatccccgctttaacccacaatgac

SEQ ID NO: 502881 - DNA, 405 bp, Homo sapiens
aagggcagtactgttatatgtggttcttccacatcaccctttactcaaaaacaacaacgaaaaagcaaaactcatatatacttctactttatagatacgcctgacagaaacatagtgaagcaatctgggaggcaacctgtggtagattatatgctaaatgttcatgtaacctctatatgattattataaaactgtttttatatatgagatttagacataaaaactattaatacaggctagactaaggaatttctacaaatactctttagagcacccaacattaaagttacacgagttgaattttgctctatttcaactcccttacctctctagtattcagttaatattaagtttaaataactttgcagagccctgcaaattaataatctacatgaagtatatctg

SEQ ID NO: 502882 - DNA, 907 bp, Homo sapiens
aggagccatttattgaaactcgccaggatggtgtctctcgaagattcatccccccagccaggatgatgtctacagaaagtgctaatagcttcactctgatcggggaggcatctgatggtggcaccatggagaacctcagccggagactcaaggtcactggagacctgtttgacatcatgtcgggccagaccgatgtggatcacccgctgtgtgaggaatgcacagacactcttttagaccagctggacactcagctcaatgtcactgagaatgaatgtcagaactacaaacgctgtttggagatcctagagcagatgaatgaggatgacagtgagcagctgcagagggagctgaaggagctggccttggaggaggagaggctgatccaggagctggaagatgtggaaaagaaccgcaaggtggtggcagagaacctggagaaggtccaggctgaggcggagagattggaccaggaggaagctcagtaccagcgggagtatagtgagtttaaaaggcagcagctggagttggatgacgaactcaagagtgtggagaaccaggtgcgctacgcccagatccagctggacaagctcaagaaaaccaatgtcttcaatgccacttccacatctggcacagcggacagttggcacaatcaataatttccgactgggtccgttgccgagggttcctgtggacgtgggatgtaatccatgctgcctggggccagaaggtgctgctgtccatgctttgggcaataatggtcggagtttccaagtccgaatgtccctatggaaaatctattggggtctggccaacaactaggagtgcgacagacggggggcgggccggcacatgccgggatctggagggcagcaaagaggacaaaacagttcccaaggaaccaccg

SEQ ID NO: 502883 - DNA, 484 bp, Homo sapiens
  misc_feature (359)..(359): n is a, c, g, or t
gcgtttcacaaacagctttgaacaagtgaaactatgagttaccaaacagctattatcctacttatatgcatctacagtgtctggaacaggatgtaacaaataacataactgtagacgcatcaccgagacatccatttacttaaccacagaagtggatcttgctacatagttctcctcaatgtcttcagttctttcagatgctccggggcttacgaatgtctcattctttcaaagatcattctgaaccatttgtgttgcgagagatatctgttgctttttgcctatcagggttgttctatgacatgctgttgcttcatatcatttgtccccttgtgcaaacagtcgatgccaagagcagngttcatctccttcacctgtctggctcggacttcggtcatagtctggatgggattcatgccactgttttcagagaggggcatggggatgagctccagtgcgtcggcgaacgcactcatggcatact

SEQ ID NO: 502884 - DNA, 956 bp, Homo sapiens
ggggctagcggcaacagcggggcctgatgtgtagtatggtagactgctctctccagatgctgaggtgcctgtatcatatggcacaggccagtgctgaaccgtaggtaggagtaggctgtgccttactgaagcagtatctattcacaatgcaagttgcagtcgtcccgaattccagtcactatttcacagaaggactgcgagagtctgacagacattattggtcaacagagaatcacgaattaagaatagcaggaggagcagtgcagggatttattacactgggacgtacatgcctcaggcatatacgattattgccagcagctgctaacccctactcagcatgacgcgagatgtgaccacgtcggctggcgacttcgcgctgaataaacaacagacgggcagactacgcacggcacacaagttactagccaggccttccatgcacggaacaatatttcgacgattaactaccactacggattggcatgtcaccactgacttggaagacatagcctgcacggtagaaacttaaccaactggactggcagcaacagcatgcggcacggccagagattctcacctataactttctaatgttgtcaggtcatagatggcacctcagaattgacctactttacatgggctatactgccggaatttcacgacccgctaacgaacagctcacagatcggatgggacccttgctaaaccagcagaatacggcaggaattatcctacacattgaagcaatactttcacggtttacttggcgagaactggtcgaccacaagcttgtggatccattgtatcgtgagtcgcttgtgggagctcatttgtcagcaaaatggctatacgcgcttgtgcgggcatcacatcgagcacgcagggatttgtgtgcactactgcggactagcatcttgttatgggaacctctgagtagattcgtgtggcgccct

SEQ ID NO: 502885 - DNA, 273 bp, Homo sapiens
aaaaaaaaaaaccgaaaaaaattttccttttaacccgggggccacctttttggcctcccccccccgggggggggccccaattttttgggtggggttttttttttaaagggggggcccaccccggggggtggggttttttgtttttttttttccggtttgggtttgggccccttttttttttttggcccggggttggggcggggcccaattttggggggggttttttttttttaggggggtccccttttggcccctttacccatttccccccca

SEQ ID NO: 502886 - DNA, 436 bp, Homo sapiens
tatcaaagaatatcatttacatgggaaggaactgtcactaccagaccagccctacgagaaatgctaaaaggagttctaaatattgaaaccaaagctgatatgcaccaaaacagaacctcttgagagcataaaacagagcctataaaacaataacacaatagaaaaaaaccaagcatctaggtaacaattaacatgataaatggaacagcacctcacatctcagtattaatgttgaacataaatggcctaaatgctccacttaaaagatacagatgggcagaatggcagaatacgaaccaaatatctgctgtctttaagagactcacctaacgtataaggattcatataaactcaaagtaaaggggtggaaaaagatattccacacaaatggaaacaaaagcaaacaagaatagctattcttatatctgataagaca

SEQ ID NO: 502887 - DNA, 229 bp, Homo sapiens
gtctactactcgcacggtactcgactactcgactactcggactactcgactactcgactactcggactactcgactactcggactactcgactactcgactactcgactactcgactaacgtggaaggtaaagaaagagtatgaagtacaacacaggaggagcatgtggttgactaagctaggaggggcagatgtcagatcgatacagttgaaactacgtcatcatata

SEQ ID NO: 502888 - DNA, 342 bp, Homo sapiens
ccctgaccccccctgaaatttttggccagtcctcttttccgcagctgcagagaggagggagactattaaagggccgtccttattacctgttttgtagatggggtttgcaaccgcccctaaactggaaatggggtaggaccccccttgatgcccgtgggccctttttaaaggcccaaggcccagaactcctggccagggctgcaaggctttgcagcccatgcagaaaatggggcaggtcctttgggaacccccccccccccaccccctccttcctctttttttttccccccttgtcttgctaaaaatagacttgggaattaaaatgttgattgaagtttggga

SEQ ID NO: 502889 - DNA, 349 bp, Homo sapiens
gggggggggtttggttggtttgtttccgcggccccaatccccccgcatttcctttggggagggcctcctcccccccctcttttttccttccttccggttttcctcactattaggggttctttccccctcttgggggccgcgcggttgggggccaaggtgaatgggcttgtccctcaccccgccgttagtttcccgggccgattgggcccgcctaattggttttcttttagtttgctacccggggggggccgcccctttttttcccggccggggggggggggggttttggtttgtggcctattggtcctttggaggaataacccaggcaccaaactttttttttggttta

SEQ ID NO: 502890 - DNA, 411 bp, Homo sapiens
  misc_feature (43)..(43): n is a, c, g, or t
tggctattacccaactatttccttgggttgacttttaaacttngtaatacttccatgcataatactgtgataatgtccagctgtagcttaactctagtcagcatttcactgcaacagagaaaacacatctctggtcttaatcagagatgcacaattcttaaacatttatttagattttaattttgacatattttaatttttttaaaaaaaatcacaaaacaaacattaagtaaggatctgtgatattctgacacagtctatgacagggtggataaaacacattttaattattctagttagttaagctactccaggacttactgcaacaagtgctttgcaggtgacttgatactctaccctgcatcatgtgcagcttcagagtaacttgaagttaactggcaacacacacgc

SEQ ID NO: 502891 - DNA, 916 bp, Homo sapiens
tggttttgagaacagaatgcacaaacacctgtttggcttcagtgcctgggacatggtggtgctcttcccaggccagcggccaggccactcagggtggaagacagtaggtcccttaacccctgggctgtggtggtgcttgattggtggtacgggccttttcttacatataggtttagaagatagagtcatcagaagaataaaaccagtgtctaggtaaaagaaatttttaaatatataatatgaatatcttcttatttataccagtacagtttcaaaatgtaattttttttttttgggggaggaagaggtcttagaagggcaaaattgcctagggtaacagagtcaaaatacaaccaggttaagccaggggtgcgggggccaattgcggggggtcccagcacttgggaggccgaggcgctgcaactcgctggacgcctcaggagttcgagaccacgccggggccaaggtgaccgagaccccatctctacggcgacttaccaaaatacgccggatgtcgctggtgcatgcatgaagtacaaagacaacaccaagaaggctagagcgcggccgaaggattggcttagcaacccctgaaaaaggcgcacgtcgcaggaaacctgtgacttcggcgccgtatgactcccgggagtggtcgacagagaaacagaccctgtctcaaaacaacaagatgtcgctgggccaggcggacaacggcctggggcatcaacccatggagggttgagcggggagacatggcaaggccggaaatggcaaccagtggaccacgggacaccgcctacaaaatcacacatcgtggctgggggaccagataccggctcgagggaagcgaatctgaccaagggcgtggcaccatcgggtccaccgcagcaacgaagcgcctaaaaaaacgcgggcc

SEQ ID NO: 502892 - DNA, 592 bp, Homo sapiens
  misc_feature (17)..(17): n is a, c, g, or t
  misc_feature (69)..(69): n is a, c, g, or t
  misc_feature (108)..(110): n is a, c, g, or t
  misc_feature (112)..(112): n is a, c, g, or t
  misc_feature (128)..(128): n is a, c, g, or t
  misc_feature (134)..(134): n is a, c, g, or t
  misc_feature (140)..(140): n is a, c, g, or t
  misc_feature (147)..(147): n is a, c, g, or t
  misc_feature (154)..(154): n is a, c, g, or t
  misc_feature (229)..(229): n is a, c, g, or t
  misc_feature (241)..(241): n is a, c, g, or t
  misc_feature (299)..(299): n is a, c, g, or t
  misc_feature (376)..(376): n is a, c, g, or t
  misc_feature (440)..(440): n is a, c, g, or t
  misc_feature (447)..(447): n is a, c, g, or t
  misc_feature (569)..(569): n is a, c, g, or t
taattgaaaggaaaaantgttggtaagggatcgtttgataaaatcttaatgagcagcattaaggttttntttattaaaaaaaaaggaattaagggaaaaagaatgaannnanaagacataggagaagnaaaggnaaaagngattaanaaaaaanaaattaataatggaattaaggttgatggaagcctcctcataactctggcctccagaaaggaaggtgatccaagtnaaagcggggggnactgtgcggggcaggctgtgacggtcgccatggcaatctcctcatgagaaaacttctnagtgcaagaatggcctggggtgaaatgttgggcttcagcaaggtgccttccaggtagatgtggtggtaactaagagnattgtagacagcagccagcaccttctcggtcacatactggcagcgcttcaagtcatggtccccntcagggnggatctcaggctccacgatgggcacaatgccattctgctggcagatactggcataacgggcgagaacattggcattttccatgatggcgagggctgagggggtgtgttccccaatcttccanacacaacgccacttgggaagtca

SEQ ID NO: 502893 - DNA, 772 bp, Homo sapiens
gctgtactctacagcatcaagatggtggtgtgtcgtggcgaatgagcattctcagacgtctccactagccttcaggtactcctcgcgtgtcccgaggtatatactatagacgcgacaaatatctcactaggggtctatctgctgtagctagaacgaggaacccatattaactatgggaatcacaggggagtgtggtaggagtatgctagagttatagcgtcgcgccgacattaccagaggtactagtacactgacgtcatgagaggctacattcagagttctcagaagttatgaatgatatctgggctagtgatcaagatcagaagtgccgtctcgttatctcatcaaatgccaggctgttttaattgcagggtgcatgatatctaactatgtgtagccgcttgctaagacccttcgaaggaagtaacacgagcgtgatcacagagaagcacagaggaagtagattgaggaaacttgaagaggtccacaaagcctattgtggctgccatcaatggatcctgcctgggaggaggacttgaggtatgccatttcattgccgattatagaatagcaacagaagactagaaaagctagtattaggtcccctgaagtgttagctgggggccttagcaggagcgaggaggcactctaaggttggcccaaaatggtgggtgtgcctgctgcgtttggacatgatgctgactggtacgaagcattcgtgcagacagggcaaagaagaatgggactggttgaccaagtggtggaacccctt

SEQ ID NO: 502894 - DNA, 337 bp, Homo sapiens
tattggcaggtggaaatcaggaagatcacaaatcagagggtacggataaatggaaacgatcactaattggactcgccaaaagacagactgtcgccttcaggaaaataaaaaaactttttttttttttttttaaaaattcacagcaacccaagcaaagtccctcactgattaggtttcaaaacccttcaggcaaaatcccatcattctcgcactaagtgacagggacgcgggtggtgaaggagtattgggagtggtggcaaaaaatggcttcggcattcccagctggagtaggtctaatctcctaagcggatgctcagaacccagggtcgggatgcag

SEQ ID NO: 502895 - DNA, 269 bp, Homo sapiens
  misc_feature (15)..(15): n is a, c, g, or t
acgctctctctgtgnggggaccgctctacgctctctcggtgggggggctgcccatgtcttgatgcctcatgaatcaacggtggagcacacacacgtagatatcaatgagatggagtctcctctttgccacccggaaaccgcacatcaggtggatttcaaacaacactgcactacacagcggcaccagcgtgacacggtcaattacgtgagattacaacctcccaaccttcttcccactgggccccacgagagagagcgtcgggtaccga

SEQ ID NO: 502896 - DNA, 385 bp, Homo sapiens
actttttaaaaaagctgtcaaatatggtgttaccctactaataattattataaatacatttaaaaacatctattacctcaagtcattttgcctttaaaaatatcaaatataactcttatagaaatttacataaaagaatgcttcttaattttggattatgatgttccctcctcaattttgtatttttaaaaattacatgttaaaaaaaaaattcacaacattatataagtctttaaaattataattctgccccctcacctcttaccccattactattctccatatttaatctattaacaatttcttatgtaattttcaataaatttgtattcttatataatcaaatatttaatctttattttttaaataaattttttcatattat

SEQ ID NO: 502897 - DNA, 2140 bp, Homo sapiens
  misc_feature (15)..(15): n is a, c, g, or t
  misc_feature (30)..(30): n is a, c, g, or t
  misc_feature (41)..(41): n is a, c, g, or t
  misc_feature (615)..(615): n is a, c, g, or t
  misc_feature (720)..(720): n is a, c, g, or t
cattcttgggaaaanggaggcaacacattngtcatataccngggatgtggtaaaagtctatgggaagacctcacatctgagagcttatctgcgttggcattccggagaacgcccttttgtttgtaactggatgtactgtggtaaaagatttactcgaagtgatgaattacagaggcacagaagaacacatacaggtgagaagaaatttgtttgtccagaatgttcaaaacgctttatgagaagtgaccaccttgccaaacatattaaaacacaccagaataaaaaaggtattcactctagcagtacagtgctggcatctgtggaagctgcgcgagatgatactttgattactgcaggaggaacaacgcttatccttgcaaatattcaacaaggttctgtttcagggataggaactgttaatacttccgccaccagcaatcaagatatccttaccaacactgaaatacctttacagcttgtcacagtttctggaaatgagacaatggagtaaatattacacaaatacttattcattgtggttatttttatacagtagtgagaagaatattgttcctaagttcttagatatctttttattgatgtgcaaaaattttnggattgacagtaacttggttatacatgacactgaaatgccttacttgtatgatattccatagtatattaaaaatggtaaaattgcatgggtttgtaggtactttnggaatctagaagaaatgaaattttaccaagttatataaagagaaaattgaatttaacaatgcgaatggtagtctaaccaaatgcatcaatcctgtgtggtttagtgtaaaaatgagaacatgttggtatttatctattgtaagataaaaaagctggtgggtgaaagaaatcatgttatgataaaaaattttgtaattttcttgatgactggaatttttattatgcataactgacaaatcaagtttccaagcaaatgttacatagtgtaggctttacttagcttatcaatttgtcattttgaagctaattattttaattaggttaactatgtacaatattttaagcattactcttgtaagattttgaaaactacattttaacatggaactctagggatagtcaccttttaaatcctgttgaaaagccatgtttaagatttaatttgccaaaataatgtcttgttaatattctttcaataacgaagttgggcaatataaccaatgtttaaaaaagtttaaaatgtataagttgaggcatttgggtggtaagagaatgttatagtgaattatcccttttcttgactattggaggaccaaaaaaataaggtgtattgcgtcttagcagtgatttttatccaatcttgtttccaaaaaccatgtctcccagggccttaaaagccatcatgtaaattaccagtaaagtgtaacatatgcaaacataacaaaatcacttccatagtgacgatactccaaccatatggatattagtcatagaagaactagaggttttatgatatttttttaagtcttttttttttttgtctaggtagtcagtctgcacttaaatatcaatcattttccttttttgcttcttcccttaaaatttatatgtatccagtacatttaattgagaagcgtatgttttttattatgctgtattttctttttattttttaattattgtttatattttcaattcaaaaatgtacaaaataaagttacattgctggtcttgtaagagctatacagttttcctaaatgtatacctgtaactgcagcagttcacctatttcaaaaatttggaattctgttcatttgttattcttaagaccacctcaaatttaaaggctaccttattgtacgtttaaagtgtattataacagtgtggtagttaataaaacactatttttttttcttttgagtttgttgtattcctatgcataaaaaatattgcagtggtatggggtaagaattggtggtttatttttcttcaacttggctttttatttttagattcttgattttagacactgaattgtaaacaggcatttatttgaagaagagatatatagagacactggtcatttactaattttttacctagagtaaataagaatgagcttattaaataaaatttttga

SEQ ID NO: 502898 - DNA, 83 bp, Homo sapiens
ccctttcccctcccgggtctctcccctacgacccgggtgggaccccagtaggtccgatcgccctctagacgttgacctttaat

SEQ ID NO: 502899 - DNA, 121 bp, Homo sapiens
gatcggtggctccatcctggtctcactgtccacttcagcagatgtgattagcaagcaggagtacgacgagtcgggccccttcattgttcacgcaaattcttcttaacggacttagcagatt

SEQ ID NO: 502900 - DNA, 2247 bp, Homo sapiens
  misc_feature (15)..(15): n is a, c, g, or t
  misc_feature (30)..(30): n is a, c, g, or t
  misc_feature (41)..(41): n is a, c, g, or t
  misc_feature (615)..(615): n is a, c, g, or t
  misc_feature (720)..(720): n is a, c, g, or t
  misc_feature (2247)..(2247): n is a, c, g, or t
cattcttgggaaaanggaggcaacacattngtcatataccngggatgtggtaaaagtctatgggaagacctcacatctgagagcttatctgcgttggcattccggagaacgcccttttgtttgtaactggatgtactgtggtaaaagatttactcgaagtgatgaattacagaggcacagaagaacacatacaggtgagaagaaatttgtttgtccagaatgttcaaaacgctttatgagaagtgaccaccttgccaaacatattaaaacacaccagaataaaaaaggtattcactctagcagtacagtgctggcatctgtggaagctgcgcgagatgatactttgattactgcaggaggaacaacgcttatccttgcaaatattcaacaaggttctgtttcagggataggaactgttaatacttccgccaccagcaatcaagatatccttaccaacactgaaatacctttacagcttgtcacagtttctggaaatgagacaatggagtaaatattacacaaatacttattcattgtggttatttttatacagtagtgagaagaatattgttcctaagttcttagatatctttttattgatgtgcaaaaattttnggattgacagtaacttggttatacatgacactgaaatgccttacttgtatgatattccatagtatattaaaaatggtaaaattgcatgggtttgtaggtactttnggaatctagaagaaatgaaattttaccaagttatataaagagaaaattgaatttaacaatgcgaatggtagtctaaccaaatgcatcaatcctgtgtggtttagtgtaaaaatgagaacatgttggtatttatctattgtaagataaaaaagctggtgggtgaaagaaatcatgttatgataaaaaattttgtaattttcttgatgactggaatttttattatgcataactgacaaatcaagtttccaagcaaatgttacatagtgtaggctttacttagcttatcaatttgtcattttgaagctaattattttaattaggttaactatgtacaatattttaagcattactcttgtaagattttgaaaactacattttaacatggaactctagggatagtcaccttttaaatcctgttgaaaagccatgtttaagatttaatttgccaaaataatgtcttgttaatattctttcaataacgaagttgggcaatataaccaatgtttaaaaaagtttaaaatgtataagttgaggcatttgggtggtaagagaatgttatagtgaattatcccttttcttgactattggaggaccaaaaaaataaggtgtattgcgtcttagcagtgatttttatccaatcttgtttccaaaaaccatgtctcccagggccttaaaagccatcatgtaaattaccagtaaagtgtaacatatgcaaacataacaaaatcacttccatagtgacgatactccaaccatatggatattagtcatagaagaactagaggttttatgatatttttttaagtcttttttttttttgtctaggtagtcagtctgcacttaaatatcaatcattttccttttttgcttcttcccttaaaatttatatgtatccagtacatttaattgagaagcgtatgttttttattatgctgtattttctttttattttttaattattgtttatattttcaattcaaaaatgtacaaaataaagttacattgctggtcttgtaagagctatacagttttcctaaatgtatacctgtaactgcagcagttcacctatttcaaaaatttggaattctgttcatttgttattcttaagaccacctcaaatttaaaggctaccttattgtacgtttaaagtgtattataacagtgtggtagttaataaaacactattttttttaaaaaaaaaaaaaaaaaaaaaaaaaaaaaaaaaaaaaaaaaaaaggtggggggggcccggggcccaggaaaaggttttaagacacacgggggggagcggcggggcccacaatggaaatgagagacagagggcaaaacaggggtcccacaaggaaaaccgggacaaaaaagaggggcgggagatctccacaaaaataaaaaagcggcgggggggaaaacaccagcggggtttgggacaaaaatccaaaaggaggcatggggacaacaaagagggggcaacaacaacaggggagtccacaaggagggccagaataaaaaaacccgcggggggtgaan

SEQ ID NO: 502901 - DNA, 131 bp, Homo sapiens
gccccagcagaacctcatggtgtcccacccccttcggcagcgcagtgtgtccctggacagccagatgggctacctcccggcaccaggtgccagccggagctgtaaatagagcgctgcgcttttgtgctgga

SEQ ID NO: 502902 - DNA, 694 bp, Homo sapiens
  misc_feature (340)..(340): n is a, c, g, or t
cggggtatttgggaatttcctcttaaggaaggggtaaaactttgttaccggaaaagtgaaaggttggaaataaccccataccacaagggtcaagtgcgtccataacaacaaggtctctagtacatcggatatttaataggtacctttacataacccttcttggcccggggacagttgaaggaaaatctctcaagcaatttgaggcattagaacgtgggccagtcgtcgcggactgttcccccataaggctaggtgacccagcgcttttgtccatatgtcagtggcaaggcccaatatcatgttgtagcatagtgtccaatgcggggcgatagtgtaaacncagcagcatgcgccctgaggcaggttccagtatgagagcattcagagagcctccacatgtacgtggtaggattgagaccgagcgtgaactttcagtcaacaacagggccgtggctatctataggtctaggaaggggtctcacgtcgtcgtcagatcaatcccaaagtagttactgtctgaacatcgcaaatggtattattcgtaggcacaccatattcctgggggactcaggaccctagttttctcgaggtaaaaatcggagataagggccaaatcctcatcggtctgaagggtcactggaacatagtcacaggcttccctctttacggcaaacataagacgcggtgagcccct

SEQ ID NO: 502903 - DNA, 1698 bp, Homo sapiens
  misc_feature (1320)..(1320): n is a, c, g, or t
  misc_feature (1553)..(1553): n is a, c, g, or t
ggtttccgccccgagtgtgtgccacaaggtcccccgtgttcttttgatctcgtcgttgatgtgacccttgtgtgagaggttcccacaagttgttgtgggagccccgaaggagtgctgtttgcttcatcgagtgcggccccccgtcatgtttctttcgtgttggagttgactctcggacaccagattgccacatggtgggggctgtccctccgcccagaaggcgttcaccagttggtgatgtgtggccccgccccgcgattgtgttcgtcaccctcgggggcctgtgccagaacccttgggtgtggcaccccccggaatgtttgttcgtaacgctgcgctttctttcctactaactggtgaatgggatctgcttcgggccgtgccgtgttgcaacgttgggtagtggagaatgggggtcttcccccgccggctgtaagtgtctgggtagtaggtgtttatatataatggggccccgggtatgccaccaaggcgccccccacaggagtgttgtggccccacggccttccttttcggggcgttttgtgacgccccccgttgtggggacaggggttattagaatattggtcgcctctccccccagacaagttgctgttccacaagggggaagccgccgttgcttggccgccactaacaggatggtttccacagttggcgtccacaaggagcagactattctctcccggggggggccaccccacagtgttatattggagccggaggaggccttcgtggtcttctcgccgaagagagatgactcctcgagtagagatgggagtgctcctaattggtagcgcaccacggttattcctccgcggtgttctctcaccgcgcacagcaattttgtgacagcgagagaggggcccccccccacacacgctggggggttcacacccacacacccacgcttttctcgtcctcgtagaggtttttgttgagagtcttcgtccttggagtagagttcgagaccgctcttttcacccacgagagtctgtagagaacacgcttaccaccgggtgcccacgctgctcactctgcgagagattttctgcacacctcgtgagactctcccacttcgagagaaaattttctcgtaagagggccccacacgctttgggagagaaccacgcgcctcgaagggaagtgtttgtgagagggcccgcgctatacgcccctcatcacacgattgggagaccacgcgctctctcaccgcgcgaattccctcggctgcaccctctgagattccacgagagtctggtcaccacgacccccgggcacagagagggaccacagccccacagngcccacgcgaagtatttgagaggcccctctgctttgaaccactctccacaggtcatcacacagctctggagaggctctgaagattccgccacacctataccccccgcctctgtctctgaaagatggccgaggacctttatattcttgtgtgaatgtccttggaccacgcacgcacaactccacatgtccaaccacatcccacaagagccaccccacccgcccgcgaatatagntggaatggcccaaatgtgtgttctgaagacccactgaccacccaagattttgagcgccttaagccccccagaacccgggtaccccttggggacccggagagccctcattaaaagttccgagttccaaacaaaaataaaaaaaaaa

SEQ ID NO: 502904 - DNA, 388 bp, Homo sapiens
aaggttgggaatagaactttccacttctattctagtttctatttaaaatacactaaaatttattcatgggaatggttacttttatttctgtaccaaagacgatacaacacagcccacttagaagtatttctgtgtgcatgtgtatgtaaatacacacaaacatgctctgcagttggctaataaaacacagtaatcaaagcctatagtggatattcagtgtaaaggtaagacttgctgaattttgaggcccattggcgaagggcagggtcagtgtgagacaagcatgtggtcacaactagtgtgcgttttcttttgttgggagtcaactactgttaggtaaaattcctggcagcgtgtagcaaggtttttggatcccacctgtcagaaa

SEQ ID NO: 502905 - DNA, 1033 bp, Homo sapiens
  misc_feature (321)..(321): n is a, c, g, or t
  misc_feature (337)..(337): n is a, c, g, or t
  misc_feature (343)..(343): n is a, c, g, or t
  misc_feature (365)..(365): n is a, c, g, or t
  misc_feature (385)..(386): n is a, c, g, or t
  misc_feature (424)..(425): n is a, c, g, or t
  misc_feature (427)..(427): n is a, c, g, or t
cttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaccgcatgcacaagtcccggatgtacagccagtgtgtccgaatgaggcacctctctcaagagtttggatggctccaaatcaccccccaggaattcctgtgcatgaaagcactgctactcttcagcattattccagtggatgggctgaaaatcaaaaattctttgatgaacttcgnatgaactacacaaggnactcgntcgtatcattgcatgcaaaagnaaaaatcccacatcctgctnnagacggttctaccagctcaccaagctcctggactccgnncngcctattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaacaagcaaacaaaaaaaaaa

SEQ ID NO: 502906 - DNA, 537 bp, Homo sapiens
aggcaggccaatcacctgaggtcacaagttcaagaccagcctggcaaacatggtgaaacgccgtctctactgaaaatacaaaaattagccaggcttggtggcacatgcctgtagtcccagctactggggaggctgaggcaggagaatcgcttgaaccagagaggtggaggtgtgaacgagattgtgccattgttcactacagcctggtcaacagagcaagactctgtctcaaaacaaacaaaaatggtcaatgaccaaacattctaacaagaaatgccaaaaaaaaacgcttcgtgagctatcaagccttcaaactattataacggaagcaaaatagtttcctaaaatgcaatatggtaggtgacaacttcctcattgaactattacctgaataagtactggaacaccaaggacaagcgcgcaccggacgatcgaccgcgcggcactacccagaggcgggcacactgggcacggagcgagcaccagcggcacgacggcaaaagccaccggccgcacgcggaaacaacgcgaccccac

SEQ ID NO: 502907 - DNA, 909 bp, Homo sapiens
agcattcaagtggtgatttgggtactattaaaggcattcagttttaaaagggaaacagaacataaaagttcagaaaatttgtggcctgactatgcaatagaaaagaaaaacccattctgggggggagaaattcaagccagctgcagaagtttgcacaagtagcaaggagcctaatgttaattccctagaccatggggaaaatgtctccaggccacatcagagacctttacagcagcccctcccatcacgggcttggaggcccaggagaaaaaagtggtttcatgggctgggaccaggtcactgtgctgtgtgcagcttagggacttggtgccctgtgtcccagctgctccaaccatggctcaaagggccaacatccagcttgggctgtggcttcagaaggtggaagccccaagctttgacagcttccacatggtgttgagcctgtgggtacacagaagtcagaattgaggttgggaacctccacctagatttcagaagatgtatggaaatgcctggatggccaaggtgaaagtttgctgcagggacggggcctcatggagaaactctggtagggcagtgtgggaagcacaatgtggggtctgagcctccacacagagtcctagtgggcatgctagtggagcgtgagaaagaggtcaccatcctccagatttccagaatgctagatcacaaaaggtgaacgtgcacctggaaaggttgcagaactcactacagcatgaaagcgggggagagaaactgacctgacagcacagggtgggcggcaaacaggaacaccctaataaaaaccgggaaaatggagaaaagaaactggggaaagcgggaatggtatggcgcactggggagacccgagggggaaaacaggcacgcgagaacaggaaagacagagggcaa

SEQ ID NO: 502908 - DNA, 449 bp, Homo sapiens
  misc_feature (27)..(27): n is a, c, g, or t
ctcgggtgccgtggaaatgatttccangagagtccaaccttgcgttgggcggaacgcccgagatgcccagccccaacgacacaacccacatcgatatcgccggccagcaggtgcccgtcgtcaagggtggcttgtacgaccgctttcgctccaacccgccgttgtcggtggttgcagcagaattacccggggttgatttaagctggttcaaagggttgcaaaagcacaaggtcgacatcggttttgaatcctactcgcccaatttttactaccagaacagtcgggtaacagcagtctatacagccgacatcgataagcttcgggcgttgatgccaccgcaggtactggccgccgtgcagcccttgcaagtctggccgggtcgcgggctgatcgcgtttactgcgtacacctatgagcatgactctctggatcattcacggatcctctat

SEQ ID NO: 502909 - DNA, 1027 bp, Homo sapiens
  misc_feature (12)..(12): n is a, c, g, or t
  misc_feature (38)..(38): n is a, c, g, or t
  misc_feature (56)..(56): n is a, c, g, or t
gatggtggggtnattctctgcctcctcacccacagagnaagagcaggagcaggggnagatcggtgcctgcagcgacgagggcactgctcaggaagggaaggccgcagccacccctgagagccaggaaccccaggccaagggggcagaggctagtgcagcctcagaagaagaggcagggccccaggctacagagccatccactccctcggggccggagagtggccctacaccagccagcgctgagcagaatgagtagctaggtaggggcaggtgggtgatctctaagctgcaaaaactgtgctgtccttgtgaggtcactgcctggacctggtgccctggctgccttcctgtgcccagaaaggaaggggctattgcctcctcccagccacgttccctttcctcctctccctcctggtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtctttttttctcccactgttgtaaataacttttaatggccaaaccccagatttgtactttttttttttttctaactgctaaaaccattctcttccacctggttttactgtaacatttggaaaaggaataaatgtcgtccctttaaaaaaaataaaa

SEQ ID NO: 502910 - DNA, 135 bp, Homo sapiens
acgtccaagagcttggggctgcagggagctgtgatcacattacgtgctctccatccggggcacatgagcaagaccctatccaaaaaaaacaaaacccctatgattgagacaccgtccttacctcgtacggagggt

SEQ ID NO: 502911 - DNA, 859 bp, Homo sapiens
  misc_feature (162)..(162): n is a, c, g, or t
gctactccggcataaatggggttcggtatgcttagatgctgatgcgtgagctcaaccctagtgtcgactataatctcctcactgtgccttgtgcagcacagttcaagacgtgccagtctcggctcgcctgccaagggaacttcaggcgcaagactgttgtgngccttgacgagatcatagtcacaaacagatacgacagctcatttgctttgctctctaggtagctatgtcacagagagagtagggcacgcaaggagttatctgcgataaaagtacttagtagattaagcgaacctcctatggaaatagcataggtcctcgtagaattaagactgtcttaggatcagtgaccaccacatgtggactttaaaaggagatcttatttcggtagaaatttcttgattggaaagcaagtgactggaattaacacttattcaatttgaaatggttccaaaaggtaggaaccagaaatgtattgacgagagttgcgctagtgtattcgattttggaatcttgacacattgagaccataaacattgtgagtcaaatctttttcttctaggggaattcttttttttagtatcggaggggaaacttggttaggcgtgggagttatttttgggcccggacattgggttttaatctatgggtgaatctattttaccacccataaattttacggagttggaaacagttgtttttcaattttcttaattcaaaagcggcaatatttaggggttaaaaacggttaagttgatcattttttaggtaatatactctaattattaaacattgggattaaacccattttttgactggttggggcgttctattcttgaattatggcgccccaaagaag

SEQ ID NO: 502912 - DNA, 409 bp, Homo sapiens
aattcggcacgagggaagggctcaaagtgctagtgggctaccaggattcttgggcatatatctgtgtctctctaccaaattgtcatttattacggggactacagatggagttgaggaggtgtagagagaaaaagaaacatacaaacaaaagatccaaagagagagggagaaagagagagagaacactttgtgtttccaacagaactttgtaagataagctgcattatttccactatatcgtttctgttgagacagctacaaggtttgccaaacttcaaagggaggggatattacttgacaggaaaattgtcaaagtatttatagtcatgtcacaaaaatcacaaccaatataaccttttgaagaagacagtagaagttgttaagttattgtaagattcataaaatttta

SEQ ID NO: 502913 - DNA, 918 bp, Homo sapiens
  misc_feature (51)..(51): n is a, c, g, or t
  misc_feature (66)..(66): n is a, c, g, or t
  misc_feature (78)..(78): n is a, c, g, or t
  misc_feature (128)..(128): n is a, c, g, or t
  misc_feature (136)..(136): n is a, c, g, or t
ccaccccttatatccattaaccccattccaatttttcatattctattgcancctcataataatatncatttccccatnctacatatccatccactccctcttttccttatatttccctacaccatccntctcttancataattattatctatttatttgcatttttttatctctaagctgcaaaaactgtgctgtccttgtgaggtcactgcctggacctggtgccctggctgccttcctgtgcccagaaaggaaggggctattgcctcctcccagccacgttccctttcctcctctccctcctggtggattctcccatcagccatctggttctcctcttaaggccagttgaagatggtcccttacagcttcccaagttaggttagtgatgtgaaatgctcctgtccctggccctacctccttccctgtccccacccctgcataaggcagttgttggttttcttccccaattcttttccaagtaggttttgtttaccctactccccaaatccctgagccagaagtggggtgcttatactcccaaaccttgagtgtccagccttcccctgttgtttttagtctcttgtgctgtgcctagtggcacctgggctggggaggacactgccccgtctaggtttttataaatgtcttactcaagttcaaacctccagcctgtgaatcaactgtgtctcttttttgacttggtaagcaagtattaggctttggggtggggggaggtctgtaatgtgaaacaacttcttgtctttttttctcccactgttgtaaataacttttaatggccaaaccccagatttgtactttttttttttttctaactgctaaaaccattctcttccacctggttttactgtaacatttggaaaaggaataaatgtcgtccctttaaaaaaaataaaa

SEQ ID NO: 502914 - DNA, 86 bp, Homo sapiens
  misc_feature (58)..(58): n is a, c, g, or t
agagaagggatactcccgcccaagggccaccgaggccgagagaagcccgggccagggnttttcttcgcgtatgtggggaatcaagg

SEQ ID NO: 502915 - DNA, 835 bp, Homo sapiens
gggttccggcgggtcccccgcggctgtcaggctcaaagactccctgcggtgccctgaccttgaattccttcgggcgaaggagttgggggcccggccctcccttaaggcggacccgcacaccacgttcctcccgttctggttagaagccgccgttcatcttccacgcagcggggctcttccacagaggccagcatttcctccccgagagggagattagtagttcaagagcaaaggagtttcttgcggtccctgcgggcgcttaccgccattcattgggtataaacatatccgacgtgagattacatagtcccgcacgtgtgcgtgtgtatacacgtatcgtttacgcagcatgctgctgtgcatcagctcgtatacatatacatatcgggtgtctttcgtccacgcgcgcgttccttgccgtggtcgcacgcacacgcgtgcccaccatttccgcgtcccaacgctcgtgcggaagctctcccgtaggctcggtggcgccggtacacccccgcgcgggtcctcgagctctcgtttgtacactgtgcagctccgctcttcgtggcccacacacacgcgtggtggtagaaccctgcgtgtgtcatgtatcccacacacgcccctacctctatgccgcgccccttttgtgcagggcagctctcctactagctcgcacgcctcatctcggcaggcacgcaggggcacagagcggtcccagcgttgcaccccagtaggggctccgtctcctcccagaaccccgggtatacagtcctgcattgacacgttcgactcgggcgtctccaagatgttcccccccctctgtcccatcaatgacaca

SEQ ID NO: 502916 - DNA, 184 bp, Homo sapiens
atgtgaggcaagtgtgcgctactcggagcctcctcacggactgacctgcagcagtgtgacagagagacgacctggatccccacatagaagtataccttacagcgtgagaggcccgcaacttgcgtctcaggcctaggtaaccagcctgcagcttcctgtacgtgccagtgtcagccatcaattt

SEQ ID NO: 502917 - DNA, 622 bp, Homo sapiens
  misc_feature (12)..(12): n is a, c, g, or t
  misc_feature (38)..(38): n is a, c, g, or t
  misc_feature (56)..(56): n is a, c, g, or t
gatggtggggtnattctctgcctcctcacccacagagnaagagcaggagcaggggnagatcggtgcctgcagcgacgagggcactgctcaggaagggaaggccgcagccacccctgagagccaggaaccccaggccaagggggcagaggctagtgcagcctcagaagaagaggcagggccccaggctacagagccatccactccctcggggccggagagtggccctacaccagccagcgctgagcagaatgagtagctaggtaggggcaggtgggtgatctctaagctgcaaaaactgtgctgtccttgtgaggtcactgcctggacctggtgccctggctgccttcctgtgcccagaaaggaaggggctattgcctcctcccagccacgttccctttcctcctctccctcctggtggattctcccatcagccatctggttctcctcttaaggccagttgaagatggtcccttacagcttcccaagttaggttagtgatgtgaaatgctcctgtccctggccctacctccttccctgtccccacccctgcataaggcacgcgttgatgtcttctacactctcatcacgctagtgcttcaacagtatcgctctcacagagcga

SEQ ID NO: 502918 - DNA, 260 bp, Homo sapiens
tttatctcacagagctagtagcatgctgctatgcaaagtctacggcccgagtcaaatccggggcatctccacagatgtgtggtagggcacgggctcgagctcttgtgtacgaaagaacaggaatgagaccagctttatttggtagcgccaaggtctcagtatgctcacacctgtaatcccagctttgagaagcggctctggcaccagaagggtctggtagaagaccgtgggcacaggtgcaggacaggattcttttcctt

SEQ ID NO: 502919 - DNA, 190 bp, Homo sapiens
tgttgtgtcgagcatcttcactggtaggactttagctgctcgttgtatttcttggtcaacctctcagcgacctggagggattcgtcgatgctcccgccgcagcttatcctgggacgggttgttggtggaacagtccacagacaagatctcccggcacttgtcatactggtccttcatccgcatacgcccg

SEQ ID NO: 502920 - DNA, 264 bp, Homo sapiens
gaagagcttatcacctttcatgatcacgccctcataatcattttccctttatctgctttcctagtcctgtatgccctttttctaacacttacaacaaaactaactaatactaccatctcaaacggtcagggaattggaaccgtcttacctatcctgtccgccattatcctaggcctatggcctccaatccctacgagatccttacaatacacaggcgagggaaaccgatctctctctataccataaaatatacttgacaccact

SEQ ID NO: 502921 - DNA, 215 bp, Homo sapiens
cttcacgccagcctgggcagcacagtgagattccgtttcaaacaaatctggaaacaacccaaatgtccattaacgagaatgggtgataggctgtgatatatttttacaatggaggttgcggagggaggagaatcgcttgaaccgggtaggtggaggttgcggtgagctgagatcgccccactccatctagcctgggtgacaacaaggccctgaga

SEQ ID NO: 502922 - DNA, 909 bp, Homo sapiens
agaccccttagtgcactggagctagttaatgcagtaaataacaagagcggaataaatgcgagacattctcagagttccagttgggccgtgcttcttccctgcggcagcaatttgcggtatggagtccccgaaaaaaggtttccccaaaggtactattacacggccaattttacctccgtttgggcccccttctattcgtggggatacttccttgcaagcggcgctctcctggtgcctcccccccgggaatcgtaactcggcagctgcttccaaatttctatgggctgaaggttatcagcccgtccctggccatgccaaagccatttcttcggggagaccaaaatggggcagttgccgcttcaccaaggaaccaatgcaggggcggcgtccaccagccaacaagagaccccagaattcgggttgggcaaagtaaatgcatccccccaccgaatcgtctttctagagcaactccgaagtggcctcgatacttccctccaccgcgtctctattaaatcctccacgccaccctccccccctgtggcgagtaacccaacgggcggtgtagtattctctccaggaaaaccgcgctgtcccctgcggcaatccgcgttgcacacccatcaggagctgttcatcgctcgttcctccccccccgatgtatgcgatccgcagcgtgtgaacaaaacaaattacagggttcttcttgcgagcgtggacaaaccacctttgtgtttgctccaataaacggggtcctttgccagcgttaccgtctgtcaaaaagagacatgtggcggatgaaaaaatcttggcgagccaaggcagaataaaaagaacacaacaccggggccggcagagacccacacccactcgggggaagcccccaaaacgggctaaccccccaacaataca

SEQ ID NO: 502923 - DNA, 167 bp, Homo sapiens
cacagccgcccacttctggaaggtccactcccctgtaggtctggtctccacgacgctccgtgtcctgggctcttggtcctccccatcccgctgccatggtcagtgtgatctccgcagggtagaagctcagggtccagcatcctcagggtggagccttccagaagtgg

SEQ ID NO: 502924 - DNA, 107 bp, Homo sapiens
gtctcactagcttaccaacccacttcagctaagccaaaagccacactttaattacattattgctgggtggctcaaaattcctatgtcaacctgttgcctcattcatt

SEQ ID NO: 502925 - DNA, 816 bp, Homo sapiens
agaaggaagagggtccaaaaactgtcctgtctcgtgtcaggctgttggaatgatctcgctgcttgcccttgcagagaacctacgcctggtgtcaacacataggaaagatggcccgtgtttatgtcacgtaaccgctgttgaacttgcgtgtgccgtgcttacgtcaatttgctgcgccactacaatacctcctgttgtacggttatcggggaatacttctgatggcattcgggtcatataaggtaatctacaacttgatagcggtcgagcaagtgcctgtagaagattgacgaatctctagtagtatacgtaatcgtacgttagttttccataagtgttaatttgtgcaatggaatagttgaggttgagttagttttgtggaatgggataattgagggttcaatagtacagacgtatacaaagcctgtatatgtagtcaatatcgtgtacgctgtccctgtatgacctgttattggaaccgtgtatcctgaaatcgttaagatcgaaggtagggttatttgtatttgtttttgtgtgagttggagtctcactctgtcgcccaggctggagtacagtggcgcattctcggctcactgcaagctccgcctcctgggttcacgccatcctcctgcctcaacctcctgagtagctgggactacaggcgcccggccagcacgcctggctaatttttttgtatttttagtagaggcggggtttcactgtgttagccagggtggtctcgatctcctgacctcgtgatccacccaccccctcaaacgaacacccccggggctacaaaaagcgaaaaaaataaca

SEQ ID NO: 502926 - DNA, 307 bp, Homo sapiens
  misc_feature (72)..(72): n is a, c, g, or t
  misc_feature (95)..(95): n is a, c, g, or t
  misc_feature (204)..(204): n is a, c, g, or t
acatgcatgccaccacttaggaaagtataacttttttcaaaatctttgcttttcagatgaaatacctgtctntactaaaaatacaaaaattaggntgggtgcagtggctcatgccggtaattgcagcactttgggatgccagtgcaggcagatcacgaggtcaggagttcaagcccagcctggccaacatagtgaaaccctgtntttactaaaaatacagaaaattagccggggatggtggcgggtgcctgtagtcccagctacttgggaggctgaggcaagagaattgcttgaacccaggacacgc

SEQ ID NO: 502927 - DNA, 619 bp, Homo sapiens
cccattgtcatatagactgggtccccacatggtcctctcattcctcatacataccatgagtgtccactgattcacaaattagttggatcacccgattgtcccctaagtggaccttagaatgaccagccgccagaatggcttggtgttggtgtgccacatgcgttcagtacgatgccaagtaatcgattttcagcgctatcacatcttcagagttcatgctagttatgggcagacatgtcaatcatttgaatgtaacgtccgtgacagatacagaccatcacctcgtgtggccttacgataactgacaacttggtcataggtttcataccttgcaaaatgcacaccatgacgacaaccgtgaatgttagttatatctgtcatatctctcttcattaaagtccattcagtcaacagtatgagcctgacacacatgttgcatctctcccacacgaccttatttggcactgtactgcattatcaaaagtagctcaagtgacagacgaacatctgtatgctgattccctcgagaactaattgcaaatggtgcatcatcggcatgtactcttggcttcttagaagtatgcgattaaatgtaccgaatggcaaatgagaatcacag

SEQ ID NO: 502928 - DNA, 125 bp, Homo sapiens
aaagccaaaccccgactatgcctctacgacaaccagagtagagaagtaattgagacttacctaagtatcttgggtaaaaataatcctgtggacaaagaaaaagaaatatgtctactagcgacaga

SEQ ID NO: 502929 - DNA, 946 bp, Homo sapiens
  misc_feature (137)..(137): n is a, c, g, or t
  misc_feature (139)..(139): n is a, c, g, or t
  misc_feature (144)..(144): n is a, c, g, or t
  misc_feature (146)..(146): n is a, c, g, or t
  misc_feature (154)..(155): n is a, c, g, or t
  misc_feature (194)..(194): n is a, c, g, or t
  misc_feature (208)..(208): n is a, c, g, or t
  misc_feature (217)..(218): n is a, c, g, or t
  misc_feature (222)..(223): n is a, c, g, or t
  misc_feature (252)..(252): n is a, c, g, or t
  misc_feature (254)..(254): n is a, c, g, or t
  misc_feature (280)..(281): n is a, c, g, or t
  misc_feature (288)..(289): n is a, c, g, or t
  misc_feature (334)..(334): n is a, c, g, or t
  misc_feature (348)..(349): n is a, c, g, or t
  misc_feature (356)..(356): n is a, c, g, or t
  misc_feature (368)..(368): n is a, c, g, or t
  misc_feature (370)..(370): n is a, c, g, or t
  misc_feature (455)..(456): n is a, c, g, or t
  misc_feature (477)..(477): n is a, c, g, or t
  misc_feature (485)..(486): n is a, c, g, or t
  misc_feature (528)..(528): n is a, c, g, or t
  misc_feature (540)..(540): n is a, c, g, or t
  misc_feature (549)..(549): n is a, c, g, or t
  misc_feature (645)..(645): n is a, c, g, or t
  misc_feature (672)..(672): n is a, c, g, or t
  misc_feature (690)..(691): n is a, c, g, or t
  misc_feature (708)..(709): n is a, c, g, or t
  misc_feature (718)..(718): n is a, c, g, or t
  misc_feature (720)..(720): n is a, c, g, or t
  misc_feature (739)..(739): n is a, c, g, or t
  misc_feature (759)..(759): n is a, c, g, or t
  misc_feature (774)..(775): n is a, c, g, or t
  misc_feature (777)..(777): n is a, c, g, or t
  misc_feature (788)..(788): n is a, c, g, or t
  misc_feature (818)..(819): n is a, c, g, or t
  misc_feature (821)..(821): n is a, c, g, or t
gggctgcagcagcggctcaaggggctgccgggactgctgtcgagcagctgggcccgccgcctcctctgcctgcttggcctcctgctgctgcttctgtggttttggggggtcctggctgctgctggctgggctgtgcngngcggncntgcacctnnctgccctgtgtccctgctggtgagcctgggcgcctgccngagcctgtctgccntgcctgganngcgnncaccctgctgcctggctgcgtgcctgcgngnagcgcgtgtgagtgtggtacctgctnnggtcctnngagtgcctggccctgtgtggccaactggcttcctggccctggacngtggctgccaatcnngctgtgngttgactcccgngngagctgggagccctgccgtggcgccggactttgtgcccttcgtgcagctgcgccctgctgagcgctgctggctgaagctggaganngcggtgctgctgctgcggganggggcttnntgcgccgcgtgcgttgcctgcagctggggtccccaggtcctngccccgtggccngccggcccngggcccgcctccgtctctggccttgccgcggggtccggccgcgactgcgtgctgctgcaagaggactttctggcgcacaggggcctgacccacgtntacctgcagcgcatccagctcaacaanccacggagcgcgtggccnngctgcagacttgtgggnnccactgccngnccagccccaaggccttcancagtaccctggagaaggtcngagaccatcagttcnncntctactcaggncggtcccgcctacgccaactgggttggtgnntnttggtgttggtgggcgcaagaaggctggtgaagcgctcaagtgggtccaagacggcactggataagacgggtgcttgtgggttggtgcacagttgtggcccataacccgcaggtgctcaaaagca

SEQ ID NO: 502930 - DNA, 105 bp, Homo sapiens
tgtgggaattacgggcttaagctaccatgccgggccaaaaacaatattttaaaaaagagaaacacttgagggggaaaaataaaaatgacataagtgtagagatag

SEQ ID NO: 502931 - DNA, 756 bp, Homo sapiens
agcgggctgccctgccgtccacccatttctccctacctgactcggccgtcgccaccaacgcgctctcccaaccctcggagtcagttccaaaaccaaaccaaaaaggaggagagcagacaaggcttcagcctgcgactgagaacagggaggcggcacgccttggggaacgagggcccgaggccatacgcgctaatacaggccagtgtcggcgtaaactttctccgttaccggcccggccgcgaccgccatgtttccgccgccgaaatccgcgacggtacggaacgccgccggggtcaaactgcgcggcgcgcctccttcccgaggcccggccccctccccgcccaaacccgcgcgccgccacacactcaggtgagcaaggcgctgcgcgagtgtcaactgccccacctaaggcgcctgccttcctcaagccaaagtcgactcctgggacctggaatcagcagctgagaacagacagcgggaagaccaccaaagatcaggctgacggtgcccatcaagcatctaggccaccgcctcgggctggaccgaacggggacagggtggacaggactgccacgcgtgggctgtaaatactgcgggaggcgtgctgctcattaatatatatggcataatatatggctttgtaaccagctaaggcccaagctccttaggccctccctcagacctttcagttcctcaaatgcagggacatgtcgggttttgctcaacattaaatcaccttagcatagtgcctgacac

SEQ ID NO: 502932 - DNA, 286 bp, Homo sapiens
ggatccccgtcagccatggtgatgccagctctgaagtcgctgtgtactaccagtccggtccatgagtctaatagactatacgcttatgagctgctagtatgcacatgacacgaaccttttttggacttctttcgaaccaggctgagcccttgggtaccaggtctaccctacctttatgacctcttcctggattctaggattttctgtctctgtggggactcaggccagcaggtaggttttgtgtgggttgcccttgtagccctatcctgtatcacctattggctga

SEQ ID NO: 502933 - DNA, 194 bp, Homo sapiens
cgagatgtgatagttatttatgaccggtgctgatttctgggagcacttcttttacgaaaatcaatgagcagtacattatgattggtatacttctgtgcatatataaatgaaatggtattcaacaagtaaaactaaagcaccatccatccatccatcctgtccatcccatccattcatcccatccattcatccca

SEQ ID NO: 502934 - DNA, 356 bp, Homo sapiens
ttaggtcatgcaactccactcctgggcttgagcgatcctactgcctcagccccccaagtagctgggaggacaggcgcaagccacggacactcagtgtaatttgtgtacttatttcgtagacgatagggtttcaccatgctagcccaatttgtgtctcgtaacgtcctgagactcaagatgagtccgcccgcacttgtgcctcccataagtgctgggtattacagcgcatgacgccaccgatgcctggcccagataaattgtacaacacacacaaactctcaagtgtgcctaattccctcgtcaccaaaaccaatcacacatacagcatgaaagagaataacttgctgttcattttt

SEQ ID NO: 502935 - DNA, 506 bp, Homo sapiens
  misc_feature (369)..(369): n is a, c, g, or t
  misc_feature (425)..(425): n is a, c, g, or t
  misc_feature (502)..(502): n is a, c, g, or t
tagtgtttgtggtggtgaatctgtatgggtctaaggcagagtgagagaccgaggcaagtttctcagcaggagtgaaagtttattaaaaagttttaaagcaagaatgaaatgaagtacacttggaagagggccaaacaaggcaacctgagagatccaagtgcctcatccaacccttttgaggttttatgcattggcatgattccagggtttgtgtttcttctcccctgattcttcccttggggtgggctgtctgcatgcacgtggtctgccagcacttaggaggggccgcatgaacagtgtgtttactgaagttgtgtgcatgctcacttgaggctttcctcctttaccagtcgagtgttcctagaaganggggcacggtaccagataaactctgccatcttaccctcttagcatgcatgcttgancccacccacccagctcctgagatcttatggggaagctgctatcactagccttcaggtgttttctatctatcaggagnatgg

SEQ ID NO: 502936 - DNA, 774 bp, Homo sapiens
tacgcctcacactcgattctcgaagcccgccgtggactaataatcaccagtaaggccctagccccgttccttgtgctgatccctatgaggcataattataacaagtgtccatcgtggcgtacgacaaagagaccgaaaatcgctcattgcatactctatacaagcagccacagtagactcctcggtagtgaatcagccccaattgtcctccaatgtccccaagagaaacactcgcgcatgggaaatgcccttgccagcaacggccaggctaagggtgcacttctctatacatcgtcgccacgggtcttagcatgcgcgtcacttagtattctgcctatgcagagacgtcaaatctacgaagcgcagcatcagcagatcggcatcagtaatccgtgctcgtcaaggacttgcaaagctgcctacgtcccactaactagcgtttttgatgacttgcgtagtcaagcgctcgctaacctgcgcgcgttagccccccactgattgaacctactgggagaaggtctgctgtgctagtaaccacgttctgccgtgatcaaaatatcactctcctacttacaggagtcaacatactagtcacagccctatactccctctacatatttaccagcaacacaatggggctcactcagccaccacattaacaacataaaagcctcattcacacgagaaaagaccctcatgttcaaaagagaataacacgaacaggaaaacctgcgcaggaaaaagggggggggggggcaaaaaaaaaacgccggg

SEQ ID NO: 502937 - DNA, 690 bp, Homo sapiens
  misc_feature (4)..(4): n is a, c, g, or t
  misc_feature (121)..(121): n is a, c, g, or t
  misc_feature (126)..(126): n is a, c, g, or t
  misc_feature (146)..(146): n is a, c, g, or t
  misc_feature (164)..(164): n is a, c, g, or t
  misc_feature (173)..(173): n is a, c, g, or t
  misc_feature (191)..(191): n is a, c, g, or t
  misc_feature (197)..(200): n is a, c, g, or t
  misc_feature (209)..(210): n is a, c, g, or t
  misc_feature (231)..(231): n is a, c, g, or t
  misc_feature (233)..(233): n is a, c, g, or t
  misc_feature (243)..(243): n is a, c, g, or t
  misc_feature (258)..(258): n is a, c, g, or t
  misc_feature (278)..(278): n is a, c, g, or t
  misc_feature (294)..(294): n is a, c, g, or t
  misc_feature (442)..(442): n is a, c, g, or t
  misc_feature (455)..(455): n is a, c, g, or t
  misc_feature (591)..(591): n is a, c, g, or t
  misc_feature (600)..(600): n is a, c, g, or t
  misc_feature (648)..(648): n is a, c, g, or t
aganagaggagagcagacgaggatggctgattgtcaaagcagggggcaggacccgggggcaggagaaaccaggctgccttcccttcccggggtccctggggcatctgggtgtgtccgcgangctcnggggagtgtgctggaaagtngtcgtgattggcatcgtngggggtganaagacaggaatggttcanatggtnnnngtggaaggnnttgggagggtaaccgtcagangnagcttaaggntggggctggcttggntttggccggtctcgggagtntggggtcaggggctanagtccaggcttggccgggggcttggggtgggagtcagggcgcaggcagcagcctcactcgggtccggggggccgcagcgagttccactgggcaatgggccgccggcgggttggccagcatggtccggcccaggtgccgcaggcaggcncccgccgggcggncgcccccacgggccaccctcccgatgggcctcggttcttggcccagctttgtcgtagtccagcacgggtcagctccacctggcacctttctgggacttgggtcacaggggcacctcgaaagctggaaagcttcgtntggtaatangggggttcagatgtggttctttcttggatgggtgggtttttctctctntccggcaccgtttttttggccggccctggcaggcaggggggg

SEQ ID NO: 502938 - DNA, 548 bp, Homo sapiens
cgtgcacacacacagacaacgataaaaaaaggagtgtgcgtgtgtgtggaataaccacccagccgcttgtcagaatttcccataatctccaatggacttttaaaaccaacaaaagccgaagacggtggcccagaggctgttcctttgttatcccatgctttctaattcaagtcgaatgactgctttggtcacacttttttagtcacagtaaaaaatcacgggcgccctctggcatgcatgacatgcgataatcagaaaaggtaccactcccgtgttttttgtttctgaatatgtctgttcacggaccacaagggcatgggtcaccaatccgaagtggatgggactaaaccattgcgccttagaggccctcaattcaactacgaaccctttaacagcaacagcattaatatacgcttttggagctggacttaccgcgggtgatggcaccagacttgtcctccaattgttactcgatttggatgggtttaaatatccccattgaaaacgagcatgcaaagcatgtcggtctatttctttcgctgactcat

SEQ ID NO: 502939 - DNA, 277 bp, Homo sapiens
caagcagagtaatttgtatgggacaagaatgagaggagtggctgctcagaggggagtggattctgtcagtggttcagtcagagatctgtatctgttgtgtcattgaggagtggcagtgtctcagtgaatattctgatctggcagtgatcaaaggactttgtctcctcaggtgctcaggatgtttcatgtggctgactgagtcaattccaggtctgatggggccgagtcgaattcgctcttgccggtctcacagtcgtgtgtggcactcgcgtcagct

SEQ ID NO: 502940 - DNA, 1148 bp, Homo sapiens
  misc_feature (499)..(499): n is a, c, g, or t
acttcgtaccatccggagcagacccctacatcttggcgtccaacggttgacattaccccgctggatgtacaggaccgggcgtttccctcgcccacgttgagggaacaggggtaaaaccttcgaaaggcaagccgaccgtgacctaccccataacctcttgggcttatcctaagacactcatctcccgatgctaaagtggaagggggttgctccaaagcacatgcgaatgggtggctatgggacaaatccgctggcgttgtcccctatccagtggttcaacgggtgtacacgccttcgttgtgtttgtttcttcgaatggcaggcggaatagttctcctgtcgcgaagcttgtccctatttttgctttctttatttgcaccaccacatcaatgtgcgctccaacggatccgacatgtccgcccttcgcgctctagatcctccgtagtcaatgcgcggcttcccgtgatgatctagaattgtgcccatcgtgggacgagcncaagcccttcagtaggaatgtcgcgatagcacaaaacgtgatcgtctcaccaggatagatagaacaatctggtaggctatgatggaactgttgtctccgggtttcggtactgaaaggggactgaaggaatgacgtacctattgaatgaatcaagcttctgtctaaggaaatgtctggaggtgtgtaagataggcgacgcgggataggggatatgggagtagcgtgtagggtcagagagttaaatgattcccacatcgtgttcaattgggcggatgtgtccccgagcgccgctctgtacgcttcgccgctcagcctggatagctatgcttcaactcaatcgcgcatgtgacgactcgtccttcccgcgcatcgcccccaagatacacactgggacacctcgtttctggcatgaatgttgggcactttaatgttgtctcgacaagcagctgctgcttctccagccccggcagtgggctgacaagctgtgttcataccgtaaatttatctggaaggggacagtgaaaagaggagtgacaggaaaggaaagggggagacaaaactcgtactctcaacctcacaccgaacacctcgcctattatcactctctctgcccccattccttcaataacagaccgggcgggacaagccc

SEQ ID NO: 502941 - DNA, 442 bp, Homo sapiens
cagctcggtacccttcgcgcttctcgttgccaggctgtagtgcaagggcatactcagctcactgcaacctccgcctcccgggttcaagcaattctcccgcctcagcctcccgagtagctgggaccacaggcgcccaccaccaagctcgactaatttttctatttttggtagagacggggtttcactgtgttggccgggctggtcttgaactcctgacctcaggtgatctgcccccctcgggctcccaaagtgctgggattacaggtgtgagccaccgcgcctggctgccagggatatttttatctgagaacccctgtcctgctggacctcacccctctctttgcttgtgagtttgagcacctgcccccgcgaggcttcgtgctgggcacccagtggaggtgagatgtgtgtctctgagtactggaacgagaagcggcgaagg

SEQ ID NO: 502942 - DNA, 175 bp, Homo sapiens
gagtatggtcaaatcccacatctaggccctgctacatggactcacctagtcgtacccaactctcatatttctcattacagcaagacacaactagtggagattcagagttctcagagataatctacgtgcttcaaacaaattgtggatttgttttgcaacttagtttattaacata

SEQ ID NO: 502943 - DNA, 299 bp, Homo sapiens
  misc_feature (57)..(57): n is a, c, g, or t
agaggaccggattggtgcatgtgagatggtagaagtgtgtgtgaagggatgcgtgcnttgatgttggtgcatatctataggtgtcgtgtcatggtgtgtgttgtcactgtgtctgtgtgtgacatcatcaccgtctgtgtgatgcatcgccgcgtctgtgtgacattaatatgtgtgacgtcgacatggcccgtgacgtcgttgctgcatctcggtgtgacgtcatgccgagttccccatgtctgtgtgcgacgtgctgcatctgcacgacgccatcgctatatctcttcgtgacgtca

SEQ ID NO: 502944 - DNA, 237 bp, Homo sapiens
tgatcaaactcttcagttcaatactgcttgggtttttaagaaaccctaaacttggctcagcaatctcaaatgactatgtgatttctcgcatggccacttgtgatgctgataatctttgtgactatcagtccgtactcacaagcacccacacgaattgcttgattcgatttgttaaagagcgtttggttaagagcttttcgtctcaaccgaggcgcgcattctacgctttcctcagag

SEQ ID NO: 502945 - DNA, 167 bp, Homo sapiens
gcagctgatcaggaaacgatggggattaaagcgatgcaccaggctgaacaacaacgaaccaatgatccccgcaccgccgaacaccagcaggatcagggtcacggtgttgccactcatgccggcaacaccttcaacaaacggctcaacatagctgtaggccgtgaact

SEQ ID NO: 502946 - DNA, 433 bp, Homo sapiens
  misc_feature (240)..(240): n is a, c, g, or t
  misc_feature (303)..(303): n is a, c, g, or t
  misc_feature (325)..(325): n is a, c, g, or t
  misc_feature (332)..(332): n is a, c, g, or t
  misc_feature (334)..(334): n is a, c, g, or t
  misc_feature (340)..(340): n is a, c, g, or t
  misc_feature (353)..(353): n is a, c, g, or t
  misc_feature (358)..(358): n is a, c, g, or t
  misc_feature (360)..(360): n is a, c, g, or t
  misc_feature (373)..(374): n is a, c, g, or t
  misc_feature (381)..(381): n is a, c, g, or t
  misc_feature (405)..(405): n is a, c, g, or t
gggagggcggtgtggccgatgagcggcggtcgagctcacggggtagcccaggcacagcgagccggtcgtgtccaggcggacgcctacgggggcagggcagcaggctacggggtgctctaaaaaggtgggatcctcccttgggtagcttaatttgactgtcctcgcagagaatgtgaacatgtgtgtgtgtggggtcaattctttctcatgtcgggagtgagaatgccgggcccctcaggnctgtcggtgtgctgtcagcctcccacaggtggtacagccgtgcacaccagtgtcgtgtctgcngttgtgggaccgttgttaacangtgacantntgggtntgactttctcttntacangncctttcctgaagnntcgagtncagtcctttgttgctgttgctgtngctgtgctgtgttgctgtgtgggcatct

SEQ ID NO: 502947 - DNA, 176 bp, Homo sapiens
tagtttgggggcggctgggcgcttggcgttcctcccgccgcccgctgcgccccgcaagccgcgcccctggcgggctaagtgagtcccgcccgctcccgcggggacccgcactggaggctgggcggctctcggcgaaagttggccgctcacagactggcaggcgggcgggcggccgc

SEQ ID NO: 502948 - DNA, 380 bp, Homo sapiens
agtctagagtgatccccgagacgttacacccagcccgacccgatggcgacggcgcagcccaggcctcgggtgcgcagaccacgcgctatgtgtacgacgatgccacgggcctgcagctgcgctttgccgtcagcgccgaaggccgcgtcaccgaataccgccgcaatgcctatggcgaagtcatcagcacgctgcagcaccaggtggcgcgctatggcgcagccgctgcctcgaccgaggccgccctgtcggcatggaacgggcagcagaacctgcagcagctgcagcgcaccgactacgtgctggacttccggggccaggcccaggtcaccaccacctattcggccaccgacgccgcaggcaaacgggctggcggcggt

SEQ ID NO: 502949 - DNA, 1615 bp, Homo sapiens
  misc_feature (34)..(34): n is a, c, g, or t
  misc_feature (521)..(521): n is a, c, g, or t
  misc_feature (625)..(625): n is a, c, g, or t
  misc_feature (796)..(796): n is a, c, g, or t
  misc_feature (1112)..(1112): n is a, c, g, or t
tccaccagcacacaccacctagtagcctcgttantcggacgagggctgtttgaaaggactttatcgatctctttattaacatcctagcttcggtttgttgtgtgcttattgtgtgctgggcctgggctgagtggtttacatgtcttctctcctttaacactgcatttccccaaggaggcgggtgcggtcttattatcccatcttaaagacaggccagtggcctgattccagagctcatgctttaaccccacgttgcactttctctcactgctagtgtagacggaagctcctttggtgccagattataaaggtagaaatttgtggaggacatcgaggagacagaagacatgctttatacatgtttctttttattttaaaaagctttgaaatacatttgaatgaaaaactaagcagttgcttatgctgtcagtacctgtctctgctctttaaaaagtaagccactgcctcttacctaaaggtcagcatgggctccatcatacagcggtcaggtccatcatacngcggtcaggtccatcatacagcggtcaggtccatcatacagcggtcaggtccatcatacggcggtcaggtccatcatacggcggtcaggtccatcatacggcgntcaggtctgtaactcttgacaggaaggtgcagtagcagaatggcgagatgcactgagggtaaccagatgatctcatgggacttacccagtgttagcaccaaagtcccatgaactgaggtgttaaaacagaaaggcctgtgtcctcagaacccctccaagtcactggccaantatgactcatgtttggtgatgttggatgccagttaataaagtccagaacttaagcccaagaagagagctcagaagtgtttgtgttactctttatttattgaggaataatttacagatagtaaaatttaccccttatatctgtacagttttgtgaattatgacaaacttactcaggttgtgtaaccaccagtgcagtcaaggcatagattatttccatccttccagagaagtctctgggaccttttgtagtcagtcccctcatggaatgttttgatcaacgtagaaatgcctggaggctgctgggtgggaggctgancactcagccatcagagcgtcctgtgtctctgagccgtgcaccccattgtggcatggcactggttgctggacattcttctgcgggcccactcacacatctgcctgcctgcggcctgtctgtgtttgtcttactcatgctcttggagccgtagcgaatgtgtctaatattccttccacgtggtagattgaaacttcaccaaaatagccctgtgcgcctactttgctcctgaacatctctgatttctccggctgtccctgtgtggagttctggcagatctcaccagtctacatgacctattggaaatgccagtgggtcattgtggcattcagacacataattcaaaactgcaaatggtgggaccgcactaaagaatttttagtaattaaagtacaggaggctgaggtgggaggatcacttcagcccaggaggtcaggtcaaggctgcagtgagccatggttgcaccactacactgtagcctgggtgacaaagtgagaccctgtctc

SEQ ID NO: 502950 - DNA, 302 bp, Homo sapiens
gtgcatttaaaactcaatgtagtacctaattcctaaaaagaatttggccgggcgcggtggctcatgcctgtaatcccaacactttgggaaaccgaggtgggtgcatcacctgagctctgcagttccagaccagcctgggcaacatggtgaaaccccgtctctagtaaaaataacgaaaattagccgggaatccttgggaggctgatgcaggagaaccccttgaaccggggaggcgaaggttgcagtgagtcgaggtcgcgccactgcactccagcctgagcgacagagcaagactccacctc

SEQ ID NO: 502951 - DNA, 1698 bp, Homo sapiens
  misc_feature (34)..(34): n is a, c, g, or t
  misc_feature (521)..(521): n is a, c, g, or t
  misc_feature (708)..(708): n is a, c, g, or t
  misc_feature (879)..(879): n is a, c, g, or t
  misc_feature (1195)..(1195): n is a, c, g, or t
tccaccagcacacaccacctagtagcctcgttantcggacgagggctgtttgaaaggactttatcgatctctttattaacatcctagcttcggtttgttgtgtgcttattgtgtgctgggcctgggctgagtggtttacatgtcttctctcctttaacactgcatttccccaaggaggcgggtgcggtcttattatcccatcttaaagacaggccagtggcctgattccagagctcatgctttaaccccacgttgcactttctctcactgctagtgtagacggaagctcctttggtgccagattataaaggtagaaatttgtggaggacatcgaggagacagaagacatgctttatacatgtttctttttattttaaaaagctttgaaatacatttgaatgaaaaactaagcagttgcttatgctgtcagtacctgtctctgctctttaaaaagtaagccactgcctcttacctaaaggtcagcatgggctccatcatacagcggtcaggtccatcatacngcggtcaggtccatcatacagcggtcaggtccatcatacggcggtcaggtccatcatacagcggtcaggtccatcatacggcgctcaggtccatcatacagcggtcaggtccatcatacggtagcggtcaggtccatcatacggcggtcaggtccatcatacggcggtcaggtccatcatacggcgntcaggtctgtaactcttgacaggaaggtgcagtagcagaatggcgagatgcactgagggtaaccagatgatctcatgggacttacccagtgttagcaccaaagtcccatgaactgaggtgttaaaacagaaaggcctgtgtcctcagaacccctccaagtcactggccaantatgactcatgtttggtgatgttggatgccagttaataaagtccagaacttaagcccaagaagagagctcagaagtgtttgtgttactctttatttattgaggaataatttacagatagtaaaatttaccccttatatctgtacagttttgtgaattatgacaaacttactcaggttgtgtaaccaccagtgcagtcaaggcatagattatttccatccttccagagaagtctctgggaccttttgtagtcagtcccctcatggaatgttttgatcaacgtagaaatgcctggaggctgctgggtgggaggctgancactcagccatcagagcgtcctgtgtctctgagccgtgcaccccattgtggcatggcactggttgctggacattcttctgcgggcccactcacacatctgcctgcctgcggcctgtctgtgtttgtcttactcatgctcttggagccgtagcgaatgtgtctaatattccttccacgtggtagattgaaacttcaccaaaatagccctgtgcgcctactttgctcctgaacatctctgatttctccggctgtccctgtgtggagttctggcagatctcaccagtctacatgacctattggaaatgccagtgggtcattgtggcattcagacacataattcaaaactgcaaatggtgggaccgcactaaagaatttttagtaattaaagtacaggaggctgaggtgggaggatcacttcagcccaggaggtcaggtcaaggctgcagtgagccatggttgcaccactacactgtagcctgggtgacaaagtgagaccctgtctc

SEQ ID NO: 502952 - DNA, 206 bp, Homo sapiens
aggctcagataaacgatatatggaggtcagcacggtgctcacgtagtcgacggaacttgtacagggaggcatagcaccgcagtggtagaatacacgtacgaccaggctccatataaacgatataaggaggtaagcacggtgctcacgtatacgaaggaactagtactagaggaggaatagcaccagcagtggtagaataccacgta

SEQ ID NO: 502953 - DNA, 940 bp, Homo sapiens
cttttttttgtttgtttgtttatgtggtgtggttggggtggacgaccgaaacgaagagtgttaatgtggcaaatctatcgttccgtgtatagtatatttccggtcaaacagggttgcatttcaccgcccttcgttttgacaatatttgtgaagagccccgtgggataaagatcgaagacccacttgaagcccccccggaagaaaggtccccggagaaactagaccccgcttctgaaaggaggagaaaagccggctccccttctccttaggagattggatgaattgaccagcgctgctctgagcccaagccaaggaccccttcgctcacctgccccagagtgacccttgtggttggatagaatttgaagcgccagtactcccatgaggacacacatctctgtggccctgccctaaatttctgggagcactttgataaggacggcttggtcccctggtggtacatcaagagtatctcgccttccctggaggactccactctcagacccttccatgagcctgccaatctcaatccacctggaatagttcccaaccgactggaccagactgaggaagaatgcccttctgcccagtgtctatcccttttgggaccccaccaatagccagcgtcccatttttggagatctgggtcttctcgaggcccgcgagcttgcctttcccgctgagatcccagattgcgccaggtggacatacgagatctataacacactggccggaaacatggatcctggccagcgaggagacacccagaacgctggttcgagagtacattttccctgggagggggccttcccagacaagatgggccaaaaccttccatcagggccagattttcaagtgaacaatcttttgccctcacctagctgcctgcacctgccctttcagggagatgggggtccattaaaggaaactgaacccttga

SEQ ID NO: 502954 - DNA, 444 bp, Homo sapiens
  misc_feature (226)..(226): n is a, c, g, or t
  misc_feature (241)..(241): n is a, c, g, or t
  misc_feature (259)..(259): n is a, c, g, or t
  misc_feature (281)..(281): n is a, c, g, or t
  misc_feature (297)..(297): n is a, c, g, or t
  misc_feature (299)..(299): n is a, c, g, or t
  misc_feature (344)..(344): n is a, c, g, or t
  misc_feature (384)..(384): n is a, c, g, or t
  misc_feature (424)..(424): n is a, c, g, or t
tccccattctcaatttctaaagattaagggaataaatctgtcttttccaaacattagacctagcagcataattttttcatcacaaattattacccatgacatgtattgacaccatctctgtcaaaaaacaagtggagttcaattctcatcttttggaaaggatcaaagaacattctaacaaccagtcctcaattctgtgtcaacactctttcattgggtaactaanaattaaaatgggtgntggctaggatttttttgntcactctatgtcctagtcctanaacagagcaaaagtangnccaatagtaattggggaccaatccaaagacaaatgcagaaatttngcttcagtgcttcccatttggagaaacagtgaccttcttntggatgagacttaggagcgggtttgcggggtcatagtggnacttcagctgttggcatacc

SEQ ID NO: 502955 - DNA, 797 bp, Homo sapiens
tttatgcaaagtgttacccaggcacgatggatgacatggttgtggatagtgatgaggaggtggattatagcaaaatggcaccagggtagacaaggaaggggcccttatggccgttgggacgtttgatacccaggaagaatacagcgatgtatatgaacaacaagagaagctttgccgaaggtttgcattacagtatggtatcaacaatgtctgcagggcggacaaccaggcgcttcaaggcaaacaatgacaaagcagagcttgatcgccagtggacagaagatcagtgcaatcatgagaaggaggaccgcacgatggaagctgatgggcgttgaagtcaaaaagagcaaaatactaatcaatagttacaaacagagatgctccacaaggatatgctccccactgttttctttctacaattcccaacgcgtgcacgcatgtctcctgtgggctgcctatacagcatccactcgtcgtccttacacttgggttcccattaaccaattgggttaacctttggctggacaatatccatctcgtatcatcagcgttacaacaacacttttctgcggaccgcacccccctcacctaaaaatcagcgtctcttaacacacccccctctgcggggcagcaggcccccctctagtctcaattaacgcaccgtcaccataccgcttacctcccgcagagctcctcgcccacctcagcagggtgtgacccaccacatcataaaccgcgccgaaacgagcgatcggaaactccgatcgtccccaggccatcgcttacaagcggccagg

SEQ ID NO: 502956 - DNA, 851 bp, Homo sapiens
  misc_feature (1)..(1): n is a, c, g, or t
  misc_feature (139)..(139): n is a, c, g, or t
  misc_feature (141)..(141): n is a, c, g, or t
  misc_feature (183)..(183): n is a, c, g, or t
  misc_feature (202)..(202): n is a, c, g, or t
  misc_feature (210)..(210): n is a, c, g, or t
  misc_feature (218)..(218): n is a, c, g, or t
  misc_feature (223)..(223): n is a, c, g, or t
  misc_feature (227)..(228): n is a, c, g, or t
  misc_feature (231)..(232): n is a, c, g, or t
  misc_feature (251)..(251): n is a, c, g, or t
  misc_feature (268)..(268): n is a, c, g, or t
  misc_feature (270)..(270): n is a, c, g, or t
  misc_feature (274)..(274): n is a, c, g, or t
  misc_feature (289)..(289): n is a, c, g, or t
  misc_feature (298)..(298): n is a, c, g, or t
  misc_feature (303)..(303): n is a, c, g, or t
  misc_feature (305)..(306): n is a, c, g, or t
  misc_feature (310)..(310): n is a, c, g, or t
  misc_feature (314)..(314): n is a, c, g, or t
  misc_feature (318)..(318): n is a, c, g, or t
  misc_feature (322)..(322): n is a, c, g, or t
  misc_feature (332)..(332): n is a, c, g, or t
  misc_feature (338)..(338): n is a, c, g, or t
  misc_feature (347)..(347): n is a, c, g, or t
  misc_feature (367)..(367): n is a, c, g, or t
  misc_feature (382)..(382): n is a, c, g, or t
  misc_feature (396)..(396): n is a, c, g, or t
  misc_feature (400)..(400): n is a, c, g, or t
  misc_feature (417)..(417): n is a, c, g, or t
  misc_feature (423)..(424): n is a, c, g, or t
  misc_feature (431)..(431): n is a, c, g, or t
  misc_feature (437)..(437): n is a, c, g, or t
  misc_feature (445)..(445): n is a, c, g, or t
  misc_feature (450)..(450): n is a, c, g, or t
  misc_feature (463)..(463): n is a, c, g, or t
  misc_feature (481)..(481): n is a, c, g, or t
  misc_feature (483)..(483): n is a, c, g, or t
  misc_feature (501)..(501): n is a, c, g, or t
  misc_feature (821)..(821): n is a, c, g, or t
nagacaacattgtaaagatgacatggtttaccagattaatctataaattcaatacaaatccaatcaaaatttcaatgctcttgggtttgtttgatttataaattgttggtctaattctagaagtaatatggaggaacantnggctaagaatagccaagacactccaaggaagaacaattttcncgtgatactggagacagangtgaaatncgctacanttatnacannccnnggaggcatcttggttttcntcagaccttttcctaangngggngtgattagggctgtnctgtactgntacangnntagngaanttgntgtnagtgagagtngagacnatcaaaagngccacacacatacacaaaanttttttttttgttanttgcagtgttacanattntttgggaaaggttgttntttttnnttaattntgcagntttaaccnctttnttttttttatttnttaagttgattttttaantnataatttttacaaaaatnagttcaggacagactaaagacaaatgtgaaaggcaaaactataaaatttccacaaggcagtaaagaatatatttatgactttgggtaggaaaggatctcccccaaaccaatttgtattcagctttatatgatactttttaaaaacatttactttcagcaggaaataggcaacaatctataacattttacaatttccaaactcccctcctccaaaagtcaccgtaaaagttaacaagatatgtcgttgctgttttgaacaagaaagattttcagagagggtggacacttcacatgaggcatgtatgagcttttctcaggcncactttgacatggagggaataaagtaaaac

SEQ ID NO: 502957 - DNA, 138 bp, Homo sapiens
ctctgcataccacttacccatgatgggacaccctggaacatggccaccctcctactctccctgagacatcccaacatgggtggactggactgtagtgctcccctaccccccccttaccctctcctatgatatccatgc

SEQ ID NO: 502958 - DNA, 580 bp, Homo sapiens
tggttttccccacacgccagaacacgcccaacgccatgcccgtgagggagttatctccaaagttggggtccagccatttacacacccgcaggtggtatgtccagcccacctgtcccacccaaggcacaggtttgtacaatggtttgatctggttgtcccacaagctgtcaaagggttacccagccaggggcaggcccctaatgcccggaagttcctgggtgcatccccgggatgaccaaactcccggactcctcaggcagggccctttcctcccacttttcctcccccaaagccacaggcctctgctcctgttccggccggcatgttttttctgttgttggagcctgaacccttgctttttgggcccaaaggggtcccctttcctccctgttgggccctatggaaggggtttcctggccaagccccccttttccaaagaaggagcagggatctgggttcccttttttttttctgttttgggggcactctagggcccaggttgggagggggaaggtaagggcttcgggtggtcctataatgtgcccctggttcttgagtaataaatttcctgtggtttgta

SEQ ID NO: 502959 - DNA, 161 bp, Homo sapiens
tgcatcagagtcttctgcaacatgtgagactggtgagacctgcgtgtaccccactcagcccagtgtgagccagaagaacgggtacatcagtcgagaaccccaaggacaacgaggcatgtctaggttcggggatgagcatgaccgagtggattccacgttcg

SEQ ID NO: 502960 - DNA, 249 bp, Homo sapiens
atggagacccaggtctgagacaaaaaaaaaaagaatggcaaaaactaaaataaaatggttataagggttaacacagaaaatggtgttcatactcctaggttaggcatggatttcttaaacaggacacaaaaagcagtaaccataagggaaaagatggataaagtataatttcattaaaattaagaatctcaggcggggtgcaggggctcaggccggtaatcccaacacttggggagggggtaccgagct

SEQ ID NO: 502961 - DNA, 123 bp, Homo sapiens
agtagtcaatgtagtgagggtgagtgatatgcagacaagcgggagagagtaacagacgtacggtggtaggtctcacgtctgcacagatgctgaatgccagagtacagtgattgtctccacaaa

SEQ ID NO: 502962 - DNA, 106 bp, Homo sapiens
  misc_feature (8)..(8): n is a, c, g, or t
tggcaggncttcaggagcagcagctcttcttgcaggaggtgcatttgcatcctcgcacttgcaggagtctgcgcaggtcaggagccaccagaaatacgcctgggtg

SEQ ID NO: 502963 - DNA, 686 bp, Homo sapiens
ttacagggtcccggcggcaggcccaggcgacgccggggtacaggtgagatggagccgggcgaagagtcgtgtagggctgacgggttacagattcggagagagaggtgcgtagtggctggactttgacctggcaaagaatctgtgcctgctgacgtcgtcaaggcttttcctggaagacaaatggatcattcccaccatatggggatgagctatatggactccaacagtaccatgcaaccttctcaccgatcacccaaccacttcagcctcacactccgcatggtggaggagacagcagcatgatgatgatgcctatgaccttctacttggctttacagaatgtggaactactgttttccggttgggtgatcaatacagctggagaaatggctggagctttgtggcagtgtttaactagcaatgttctatgaaggactcaagatagcccgagagagcctgctgcgtaagtcacaagtcagcattcgctagaaattccactgcctgtcccaggaccaaactggaaccatccttatggagacaccaccaacagctgtgggcaacagatgctgagcttgtcctcacctcctgaaaacagtgctgaccatcatccagggtggtcataagctaattcctcatgctcatcttcatgacctacaagggtactctgcatggagtagcaggagggc

SEQ ID NO: 502964 - DNA, 1038 bp, Homo sapiens
tacaacaattttattttacatattatccacatcacacttctttctcatgttatatttaaatatgcaatggccacacattttggcttttataccttttacatctttattatctctaattttatataacatgcataatatctcttctgtgataagttatagccatctccatacacacgtcttgatctctatttgacacgtattctcacagacgtacttgcaccaccattgacattctaagtctgccaggctagctaccgtatgcctacatcaaaacttaccgttagcatcttcaacattcctacttactctccgcgtaactacaaaagtcgcaagtactgtgcagcaattcgaaaaactatgttttctatctacagatgcaaacttattacggcatttcttaccagcgtcacccatggattattccaatgttaaacttacttttccaatagctcactctctactacgctcaagttcattgcgcaacaccagattgaagtttgcataaatatttcctgctaagcgaacctaagttccacaactttcctatcactatcattccaaataataactatcatactaggatttatcccccatttaggtttccccacataataacatttccaacgcttcctcataggaacaaaccccttggttctcaacttcaatcacgcttgcgcgcgaactttacggatcatgacccacaaccattggcgtagcgcgtttgtacttataccacccatttgaaaatggcatagcatctagtacttgctgcctctcacctgggcgaacacattcctcgttccacaccactacacttattcagctgattagccacaaagaaccagcatcttccacccttgaagtatactattgacgcattactatgatggcaaactacccagatttcacaacattctggcaacccttacggttctcaacgcctctgcccaccttggtaactattaacggacaagcacactccccttatacttaaaagactccatgactcacataatccacattttgggcttaaccctt

SEQ ID NO: 502965 - DNA, 208 bp, Homo sapiens
caggaccaagtgaataaaatggggggtgtctaaaaacaaaacttaaagtaagaaggagtacttggccgggcgtggtggcaggcgcctgtaatcccagctactcgggagtctttacccaggagaattgcttgaacctggagatggaggttccagtaagctgagactgccattgcactccagcctggacaacagagcgagactctgtctc

SEQ ID NO: 502966 - DNA, 135 bp, Homo sapiens
tagttgcaaactcacctccctcactcaacactttgaatacttattgtttggcaggtcatccacacacttctgcccccagtgcatccaattttttgcaaatgccccctataataaatcttttcaattatctcatcc

SEQ ID NO: 502967 - DNA, 175 bp, Homo sapiens
catacttaatattttttgaaaacacaataaccacagtacatatactgtattctctatatttttccctactttcataccataactctatactctcctcttttttgttttcactttatcaaaacaaaaattacccgatgatcctctttactgatgaaaaggatggaaaattaaatca

SEQ ID NO: 502968 - DNA, 125 bp, Homo sapiens
tctttattagtaaggcaaaaacagactagcacagtgagtctctgtacttcggcagaggagtgcttcagtttttacttaggaaaaaaacatcacagcagcgcggtagaggggctcccgggcgtcgt

SEQ ID NO: 502969 - DNA, 126 bp, Homo sapiens
cttcgcacagcagtgaacaagaaatgacacaagccaacctcccctcagcagggaacaggcacgggttatcccacaagtgtctgcgcaaatgcacctggggtcagtgtgagcgcaacacctgggcag

SEQ ID NO: 502970 - DNA, 200 bp, Homo sapiens
tcagtggaccgtcgtctgtcgacgtcgcgcaggaggtgtgatcaccgaggtgattgcggtaccaccgaaggtctgatcatgaccccgatcgtggaaggcggcgacgtggtcagccgctgaaggaccgcgtgctgggtcgcgtggttgccgaggacgtgttcctgccgggaacgacgaagatccgatcgttacccgcaaca

SEQ ID NO: 502971 - DNA, 223 bp, Homo sapiens
cgaggcggtggtcagtctctgtccgtagagggcgtagggggagtagtacggtccggtggcggcgggcaccggcacgggggcccaggcgtgggaagcgggctcttggagtaggggtggtagcggctgctgagtcccagcgcgtggtgggggtgcgcagcccagcgtcccaggctgcccggtgcgcccgaggtggggatgtgcatagtgcaagccatggcggccc

SEQ ID NO: 502972 - DNA, 415 bp, Homo sapiens
cgcatgctcaggtagctcaatcgggaaaatatcttacgcagacatattctctgagccttaaaacaggctgctatcgacagtcacgtccgatgcacagccagatgacttgatacttttcatttcagtgtaggcagtcatgttttctaagaaagatttagaaatcagcaaagtgtaacaatagtgtttcatttatggaatggacaaactgacagtgtcccattcagcaacactttggaaaggttgtctgcattaggggcatgtttctggaagcatcccttagcagcaagctgctgcaggcaatctccttgccaggttgtaccagattttttttttcttaaatgtatggtatatattttccttaaaaggtcttcatgggctgactgattcctatccgtagtaatattttaggtcactt

SEQ ID NO: 502973 - DNA, 702 bp, Homo sapiens
gctccagtttcccagcgacacgatgtacccgtttctacagctggctggaggactggactgctactactactcctggctgtggcagtgagcaatgaatccgggcgatgacagagagaaaaaacttgcgacttggtagcgagaagaagggtaaagagtcagagagaagagtttgccctctaggtgaagaggcgtgaaaccacgtgtttaatagaagcttcgagagcactggtgggccaggcttcagacacatacattctatcatctgtcaggggtgtgccgggaatgctggcaaccacacttctggtgcaggcctggtgcaaatcatcaaacagtagatgggaaggagacgagtgtgtagggagcactcaacgaaactcgcatcttcaaccggaagtaacttgggatcatgctggatctatacacacggggttgatgaccatatgacaatccactgtggcataggagctgacgtcgtgcacgtgttgatgatctcctgcaatcgacaggagtcctgaacggacaattttaaccctgatgtctagaggagcgtggcaaagtccaagatcgtgctacctctttgagatggatagtcaggctggctgttcaccagagatctcccacctcagtgtgggttccactcttacttgtcacgttgcatcactggtgctgctgaagccgcggggggtcctataccagcgactg

SEQ ID NO: 502974 - DNA, 450 bp, Homo sapiens
  misc_feature (265)..(265): n is a, c, g, or t
ccagcacgggtgaatcacgaagtcacgagtttgataccagcctggcagcttgaccaacgtggtgagaccctgtctctgctaaaaatacaaaaattagccgggcgtggtagctcacacctgtagtcccagctactcaggaggctgagacaggagaatcacttgaacccgggaggcagaggttgcagtgagccgagattgtgccactgcactccagcctgggctggagtgagactccgtctcaaaaaaaaaaaaaaaaaaaaaaaanggccccggcccgggggccccccctttgaaccccggccttttggaaaggccaggggggcaaaaccaggggggggggtttaaaaacccccccggcccggggggttaacccccctttttttaaaaaaataaaaaattaccccgggcttaggggggcccccttaaaaaccaatttcctggggggggggg

SEQ ID NO: 502975 - DNA, 256 bp, Homo sapiens
acgagatacaggtcacggagctctcagatgcagacacggtgtccgcgagtattctgacgaggaggtggtggaggacgtggatgatgccgcctactccatgtctactggtgctgttgtgacggagacgcagatgtacaaaaaacgagctgattccttgacgtatgctgattatgctgtatacgttggtggtgaacaacactacggggtaccggagctcgaaaatttccgtaaatcatgggtcctaggctgtttccct

SEQ ID NO: 502976 - DNA, 180 bp, Homo sapiens
cccggatctgtgtatcatcacccgatgagcacacagccagaacggctgaacgcaggcacatactttctattctacacctagtagggtcccttccctactcatcggactaatttaaacttcaaaaaacctagggttcataaaaatttctataattaattttaataaccagggaccggggat

SEQ ID NO: 502977 - DNA, 508 bp, Homo sapiens
gaatttggtactgggcagatactggactctcctcggacgtcggtgccctcacatcattggtctcccacccgcccctgggatttctggacgcgagccctggccctccccctaggtgcgccggcgccttgattataggctttccgctcctaatgagttcctaggtgccctatgccccacctttggtcacccacagaggcacacaccactacctccctatcgcccatatctagttattatccgaaaccttcagcgctaatcattctactccaattagccctggccgtacgtcctatactccgcctcacactttcctgccagggccacttattccaatgcaccttacttggaatgccgccaccctcagccatatcaaccataataccttccctttacacccaatcatattcaccgattctaattatctgactatcagtaggattcgcgtcgccttaatccaagcctacgttttcacaattctagtaagcctttacctggacgacaacacata

SEQ ID NO: 502978 - DNA, 310 bp, Homo sapiens
ccatgccaagaggaagcccagccccttcatgtctgaccgaccggatcgaatcgaattgctgtgtttccggaagcacgtccatcttgcaagaagccctgcaatctgctgcccggcacagaatgtcgctccgggtccaacccctctctctccggctctgcttggctttcctttcaccacctgttacctcatttcatctcagaatctcctgttggtttctgcgctggacatccctgcttttcctcaagtgtgcaaaacaccgcactgcatgcgataccagttgctctccagcggtaaactgacagactcgtca

SEQ ID NO: 502979 - DNA, 90 bp, Homo sapiens
tctgaggacacggccgtatattactgtgcgagaggactcccctggaattatgggaattactactacggcatggacgtctggggccaaggg

SEQ ID NO: 502980 - DNA, 433 bp, Homo sapiens
caaaggcttagactacagtagtgagcacgtgcctgcctagattgacaggatattttttaaggaccagaacagtattttgtaactatatgtttatacaagcttgatacttcactactaagttatagtctctagcttccactgagcatttaccaaatagcagatatagttgactgcctttgcaggtgtatcactgtgtgtcagaatcctaatcctttctcctacttcagtgttaaacaagccatttaattctgatgttactttttcggattggttcacactgcagagcacaatgagcagggtttgtgtgcatactaatactaggatggtttattcaggactttacaaagtaagtggaataatttagtgcaatactgaaaatccagtctgtggagcacacagcctttacattacattagttggggacttcagctcc

SEQ ID NO: 502981 - DNA, 271 bp, Homo sapiens
gatttaaatagaactttattggtgaaccgcctggcagagggagaggtttgatcataaaattggcccggtcaaacatttggggtttaacccctgggggccctttccccggagaccctattgtaaataacacaagggggggggcccccctttttggcaaaattccacagggaacccttaattttttgtttcctctttcccggttcaaaattccatttattggatcatttccgggacccccggtttagggccaaaaaaggaggtttttaagcca

SEQ ID NO: 502982 - DNA, 95 bp, Homo sapiens
agaacacgaaaactttctgctctttcctctcagcctgagtttccttctgacaggaggaccagccccagggagcctgcaggaccccagcaccccac

SEQ ID NO: 502983 - DNA, 256 bp, Homo sapiens
  misc_feature (19)..(19): n is a, c, g, or t
  misc_feature (221)..(221): n is a, c, g, or t
gaggatcccgaaaccctanattacgcataacaaaaagataaagcagagccccagtctacatggagagaagaacccagagatgattgtgataccgtctggggtgacttcattctttttaaaaacaaaaagtcgacagcagcaaataattaaaataggagacgagacgataggtacaaatcagttaccctcctgaataaatacagtcatccagaatctcattnggatgaaaaagtgtcttctccgtcggtgtcgaccc

SEQ ID NO: 502984 - DNA, 200 bp, Homo sapiens
ggaggtcagtagagcgcgctgcagtgagccttgggtctcgcagagacccagaccctgacatgcaaggagccaggacacccaggaaacatcagcacacacacacacagggaccctcccttcatgtcactagtatagctgccctaaatggcttcttgcaccctaacccctgatcctggaagaaggcagcagaaactggcccg

SEQ ID NO: 502985 - DNA, 675 bp, Homo sapiens
gacagcattcgggccgagatgtctcgctccgtggacttagctgtgctcgcgccaactctctgtttctggtcgctggaggctatccagcgtactccaaagattcaggtttactcacgtctatccacgcagagaatggaataagtcgaaattccctgaatgctatgtgtctgggtttcatccatgccgacctcgaagttcgacttactgacgaatggagagagaattgcaacagtggagcattcagacttgtcttacagacaaggactggtcttgtctatctcttgtactacactgaattcacccccactgaaaaagatgagtatgcctgaccgtgtgaaccatgtgactttgtcatcacgcccacagatagtaacgtgggatctgaggacatgtaagcagcatcatggaggtttgaagatgccgcaattggggattggatgaattccaaattctgtcttgtttgctggttcaatattgatatgtgtatagagttacactttatgcacaaagatgtagggtatataataatgttaaccatggacatgatcttctttataattctactttgagtggtgtctccatgttgtgatgtatctgagcaggttgtccagaggtagggtctaggagagggtggaaattagaggtggggagcagagaatactacttatgaagata

SEQ ID NO: 502986 - DNA, 133 bp, Homo sapiens
catgtcctgcggcttcctgcttctgccgtcctgcttcctgcttctgccgcttcctgcttctccgcttcctgcttctgccgcttctgcttctgctgcttcctgcttctgccaaatggccgcttcctgcttctgc

SEQ ID NO: 502987 - DNA, 334 bp, Homo sapiens
gtcgacgtggctttagcagcagagacagaggaggaaaatgtagagaggagggagtgaaaggatgctaggtccgcagggaggcgagttttcctccatttccgctcggctgcccggagccccattctgtgagctcgcaatgagtcgtcgagccacggagcgggaggggaggaccgagccggcctggaggataggggacatagggagtcaaaggatgcagtaagggaggagaggagggttgaggaggcagaatcaggagataggttggagaaagtttgagcagagggaagagaagataggatggaagaggagagagtagcgggggagaggtcgacgc

SEQ ID NO: 502988 - DNA, 304 bp, Homo sapiens
aacgggtgatgcggttgcggtgagctgagatcgagccgttgcactccagcctgcgcaacaagagtgaatgaaactccatctcaaaaaaaaaaaaaaaaaatctccattgggaaaacaggagacggccccataggtccatcgggactttttagtatttcctgaaaaatagaggggatcaggtctgaaatgaaccagcaccgggaaatcttgcccccaaacttgtgaaactgctggggagatggaagtgatttgggcggagcccaaaactaaaacccagcctttgaaacatgtgggggagccaggg

SEQ ID NO: 502989 - DNA, 1754 bp, Homo sapiens
tctcggtgcgttgtttgctcagtgtgggcggtgtccgaactctgctgcgtctctgtgtctacgatctgtggtgagtgagcgttctggctcgtttgccgtcctgcgacgtctcgctctcgttcttgtgtgcacgatgtcatcgggagaattcggtcgtgttcccctgtgtcatctctcctctctctcatctcgtcttgcttggcttgctcggcctctgtgtgtgtgtgtggtgtgatgcggcgttcacgctctattggtcgcgtgactgtgctgcggttgatcggtcgtgctggttgatcgtctatgttgttgttgattatcttgtttgtttctcttgtgtgcgttgctgcgtgtcgatctacctggctttcctgttttttgctgttgttggttttgtctggtgctgtgtcttcgccttggcctctgtgttggttggtctttgccgttcgtgttctttcgtgtggtgtcttgcgtgcttgttgttgttgtgtgtgttgttgctgttgtgttgttgtcttgctggtgtgcgtggttggtgtttgttgtggttgttgtttgtggactgctctgccgcctccgcgtgtggtgttgtgattcgcctacagcgtcacaccaagtgttgaagtacgccaggtgccgccgcccttgtagtggggtgagtccgaaagagacagcaacacaatatggacgggattttttttagaggtggcacacacacccttttatggggaaaacttccgctttaagagtgatgccccccacacaagaagttgtgggtgcacccaaaaaaaagagccctcagagcgcttgtggttgtaaaaagagccgcggagcgcgcccccccacgtttgatcttttatgtacgccgcggtttctcctttaaagaggtgttatagccgcaagagggcctctctgggggtgggggcgcgagattattttccggggccactcagcaggagcggccctctttccttgttttcgccactcgtgtgtttggggtctcctgttttgtagggccccccccgggcgtgtgggtggtgtcgccttcctgccggcccacgaatattatggggggccaccaaagtgttgtctactctgggagaccccctctggggcgagaaagtgtgttgggtgtccctttgtgtctctctgggctgtgtggacacgcgtgtttctctcctccggggaccgccatatagacggtgtgtctcatttctcggtgtgagagagacacacactgtgtgagtgtgagtgggcgccacacgctcctcagaggtctgtcgccgcgctcacacagcacccagatgtctctctctgtgtgtgtgcgctgtggagatttgtgccccgcgcttacacccccccgcccccatagatgtcaccacgcgcttgtccacaatgtgcgcccacagagaagagaagatatctctccccacagagagagatctcacaagagattatatatctttttgtgtgtgaaagagtggtgataacatcccactatctcccctataatgcgcccacacaggtatctcttgtggagatatatcccccttggagccaaactgtctgtcacaatataaggagatgtctttctagagatctcctgcgtcttttaaaccacaaggccccgaatgggagggccacaaggtctaaatttgaaagagagaataccagaaccggccagaccccatggtttttcccaggaactgcggttttagaatagctttgttttgatccatttaaaatttttaaga

SEQ ID NO: 502990 - DNA, 125 bp, Homo sapiens
gcttttgacccaaatgcaaacattttattagggggatagagagggtgaggtagagtttatggaactgagtgttagggactttggcatctccatagctgagcacagcaggggaggggttaattgca

SEQ ID NO: 502991 - DNA, 422 bp, Homo sapiens
  misc_feature (382)..(382): n is a, c, g, or t
gaatctgagagtggaagaaaacctttaccttggaagaaaattttaacatatgagcaagctgttgcaagaggattttttcaccacattgaaaaactcaagtatgaacaccacctttaaggaatgcttgaagcaaatgcatgctggggaagatttagaaaaggaagaccttgacagtcggaggcacaaatacatggatgatgatggttcactttctcctattgaagagccattaactgaagatgaagcaacaaatcctcaggctgaatgtgatatcaagttggttgaagacagttgcttcataataagttcagaattctcaaggaagagaaacttgggaacaagagaagattaagaaagaatcctacattttctaaaaaagccnaagatgccacacacagagagaaaggggcacagaagaacct

SEQ ID NO: 502992 - DNA, 984 bp, Homo sapiens
cggaggcgcggggtgtggccgctgccgcggaaggcgggcgtggctgggtgaggctgcttcctgtgggtcctgcgctgtcatggaatgcctgtgcctgtcctgccgtcctgtctgccctgcatgggcatttgcccctgatgccatgcctgatgccgccatgatgcctgcgggccgcagggggtgtcagcggtgcccagaccaccaggaatgctcccactgctgcactacctgccataccacgggtctctagctgactcatgggctgctgcatactgttgcatcttgggatcaagcttctcctcaggacttctgaagagcccgacatgctacacggaatgcacagatggctatgagtgggacccagacagccagcactgcctgggcatgtcaacgagtgtctgaccatccctgaggcctgcacgggggaacatgaagtgcatcaaccactacgggggctacttgtgcctgacccgctccgactgccgtcatacaacgacctacacggcgagggaccccacgacaccagagcctacccgcatcaaaaccccaaggccctgaccaacagggcatatgagcaccgacgatcagggacagactgtgtgaatgtggactgagtgtgcccaaggacctgcaacgaacagaacgacaccaaacaaggacatgccaataaacttgccatggaatacgaaatacaagtgcaaccgtggaccatgaatggtatacagcagagaaatccgagagccccgaaagatagtgaaagcgagcaaaagaccaggaggaggccacgcggaaacgcgaaaacaaggcgcaaagcaccaccagcgcagcgatacaccacactgccatagggcgaccagtcgcgaggaggccaaagaaggacaagccaagggagcaacgcaacagaataagagaggacaaaacaaagaccagagatccataggaatacgacagagacagagagaaggtacaccaaaaagagagaca

SEQ ID NO: 502993 - DNA, 332 bp, Homo sapiens
  misc_feature (78)..(78): n is a, c, g, or t
caagaaccttcgtttttatttttaaacacttttgccccctacaaaacaaaccagcaagtacttgccaagaaccaattnttgggattcaaggagtctcgggacgaactgccttgggcctctggccgccacccaggaagggtggggttggatctgtgtaagttgcccaggcccacaacctgccaccagggggctgaactggatccatgctttactgtgtttaaatgggggtaacaggggtccctacagccctccccagctaaacatttggaacaaaaacaccagcccctttgtagtggatgccagaataaaattggttaatccaatcactccca

SEQ ID NO: 502994 - DNA, 995 bp, Homo sapiens
ccaccagcagcacccgccgcagctcaccatggatgatgatatcgccgcgctcgtcgtcgacaacggctccggcatgtgcaaggccggcttcgcagggcgacgatgccccccgggtccgtcttcctcctccatcgtggtggctgccccatgcaccaggacgtgatggtgggcatgggtcagaaggattcctatgtgggcgacgaggcccagagcaagagaggcatccttcaccctgaagtacccctatctgaagcacggcaatcgtctaccaactggttacagacatggatgaacatctggcaccacaccttctacaatgagctgcgtgtggcctcccgaggagcacccctgtgctgctgacctgagtgcccccctgaaccccaaggcgcaaccgcgagaagatgacccagatcatgtttgagaccttcaacatcccagccatgtacgttgctatccaggctgtgctatccctgttacgcctctgtgccgtaccactggcatcgtgatggactccggtgacggggtcactccacactgtgcccatctacgaggggtatgccctcctcccatgccgatcctgcgtctggtacctggtgtggtcgggacctgtactgatacctcatgaagatcctcaccgagcgcggttacgtttcccaccacggcgagcgggagatcgtgcgtgacatgtggcgagaagctgtgctacgtcgcctggacttctagcatagatgggcgcggctgttcagctcctccctggggaagagctacgagctgctggcggcgccgtctccattggcatgagcggtccgtgctgagggctttccagcttctcctgggattggtctgtggtcccgaactcctcctccctgagtggtgggcccaaccgtcccccgtgtggtggcccttcccctccgtgggggcgccgccccgaaatgccccatctgcggccctcctctgggacccccatggttccaggttctttttctctcgtcccg

SEQ ID NO: 502995 - DNA, 722 bp, Homo sapiens
  misc_feature (7)..(7): n is a, c, g, or t
  misc_feature (34)..(34): n is a, c, g, or t
  misc_feature (36)..(36): n is a, c, g, or t
  misc_feature (186)..(186): n is a, c, g, or t
  misc_feature (188)..(188): n is a, c, g, or t
  misc_feature (205)..(206): n is a, c, g, or t
  misc_feature (297)..(297): n is a, c, g, or t
  misc_feature (341)..(341): n is a, c, g, or t
  misc_feature (358)..(358): n is a, c, g, or t
  misc_feature (418)..(418): n is a, c, g, or t
  misc_feature (474)..(474): n is a, c, g, or t
  misc_feature (480)..(480): n is a, c, g, or t
  misc_feature (500)..(500): n is a, c, g, or t
  misc_feature (516)..(516): n is a, c, g, or t
  misc_feature (527)..(527): n is a, c, g, or t
  misc_feature (531)..(531): n is a, c, g, or t
  misc_feature (611)..(611): n is a, c, g, or t
  misc_feature (620)..(620): n is a, c, g, or t
tcctcanatgatggggaaggggctggcaagtgtnancaaaatataaaaatgggctgctctcaattttgcctcaatggacattttaccactgttcttatacaactaacaaagacgggattttaaaaaaaattgaaagtgactcattatccaaccttattaaaattcctacatggggggggaggggananaaaaacgccaaaccccnnaaaaaaaaaaaacccacaaactaaaccaagattttcaccaatcccaacccttttcacaacaattttatcaatatcacctctcctatatttncacaaatcacaaaattaacttcccacattcttctccctcaaatntccctcttctcaccctnttcttactcacaccctcttttccccccccccaccctataaattatttcttatatttcttntatcttccttctttcctcttttacttctcctctctctttttcctcttctctcttcncttccntctctttttcctttctcccntccttttactttctantttttttttcntccncctcctctctcctctccttccttctcctctcctttcccctttcttctctctcttttccttcttctctcttttctttttcnctttttctnttccctttcttcttcctctctcttctcttctttttctcttctctttccccaccctccttcatctttctctcctttctcttctttttttaaaataaataaaaa

SEQ ID NO: 502996 - DNA, 344 bp, Homo sapiens
tccccctgagccagcccctgttgttggggatcgcccgaaattaaaccagtgctggccgagccagggccgagttttatgtccagtgcagcctgacttttgagcaggtgaggaagccctccctgagtgggggacccgaggcccccgagtttccaggaattttttttgtggagacccaaaacgggcggagattgccccaaatggaaatgtggggtgaactttgcccctcggccaaaggggccatcatcctttacacccgggttcagggaagtccccctgggggggccctagggtccccccccccaccccccccgctttgaaaaaaaaaaacgactttatttttggga

SEQ ID NO: 502997 - DNA, 973 bp, Homo sapiens
  misc_feature (17)..(17): n is a, c, g, or t
  misc_feature (147)..(147): n is a, c, g, or t
  misc_feature (149)..(149): n is a, c, g, or t
  misc_feature (153)..(153): n is a, c, g, or t
  misc_feature (235)..(235): n is a, c, g, or t
  misc_feature (257)..(257): n is a, c, g, or t
  misc_feature (260)..(260): n is a, c, g, or t
  misc_feature (262)..(262): n is a, c, g, or t
  misc_feature (280)..(280): n is a, c, g, or t
  misc_feature (295)..(295): n is a, c, g, or t
  misc_feature (297)..(297): n is a, c, g, or t
  misc_feature (365)..(365): n is a, c, g, or t
  misc_feature (367)..(367): n is a, c, g, or t
  misc_feature (375)..(375): n is a, c, g, or t
  misc_feature (381)..(381): n is a, c, g, or t
  misc_feature (385)..(385): n is a, c, g, or t
  misc_feature (889)..(889): n is a, c, g, or t
  misc_feature (898)..(898): n is a, c, g, or t
  misc_feature (931)..(931): n is a, c, g, or t
caacctcggcacagagncgcaggcggccaaccagggccaaggggcggtagagcggccaaagtccgaccgggtgccaactgttcccaacccccgcctcgggcccgccgccggcgccgccatgggcaaaaagcacaaaaaacacaaagncnaatnacgctcatcctacgaggattataccgacaagcccctggaaaaacctctaaaactaatcctaaaggtcggaagaagtgaagtnactgaactctcaagatccggcnacnantccaattactataataanaagtcaaaccatgancnaaaaaggcacaaaaaaaaaaaaaaaaaaaaaaaaaaaaagtccgaaaaggaaaaacatctggacgatnangaaaaaangaagcnaaangaaaaaaaaaagcggaaacaaaaaaaggagcactgtgacacggagggagaggctgacgactttgatcctgggaagaaggtggaggtggagccgcccccagatcggccagtccgagcgtgccggacacagccagccgaaaatgagagcacacctattcagcaactcctggaacacttcctccgccagcttcagagaaaagatccccatggattttttgcttttcctgtcacggatgcaattgctcctggatattcaatgataataaaacatcccatggattttggcaccatgaaagacaaaattgtagctaatgaatacaagtcagttacggaatttaaggcagatttcaagctgatgtgtgataatgcaatgacatacaataggccagataccgtgtactacaagttggcgaagaagatccttcacgcagctttaagatgatgagcaaacaggcagctcttttgggcaatgaagatacagctgttgaggaacgtgtccctgaanttgtaccangtacaagtagaaactgccaagaaatccaaaaanccgagatagagaagttatcagctgcatgtttgagcctgaagg

SEQ ID NO: 502998 - DNA, 712 bp, Homo sapiens
taaatttcttagtcgttgggaatcctttggcatgcttaaggattccaaacgactaagaaattaaaaaaaaaaagactggtcattcataccattcacacctaaagactggaatttatctggttttaaaaatgaacttctcccgctacacagaagtaacaaatatggtagtcagtttggtatttagaacatgtttgggtacgcagggatgtttccataattttcagagattatgcattcttcatgaatactttggtatggctgcttgcaaatatgcttttccaaacttgaaatcataggctgtgaccagcggtgtcccagtttaaagctttcacttcattggggttttcaattaaggatttagaagttcccccaattacaaccgggttttaacatatgggacatacgggttctaataccggcttggcatattcacacatggtcaacggggacatgttaaacttggattggtcaaatttaatgcgggggggaatactacctatatgtatttcaacttagtttcaatatttgcattttgggggaaaaatctttttacacttcctcatggatagcggtgaatatatactatgctaaatctttatatcccggaaatatcagtacttgaacaaattcaaagcaccatgggtttataaaccctgggtccttgcagtggccataaggtcaaattataactgattacatttcaggtaaatta

SEQ ID NO: 502999 - DNA, 282 bp, Homo sapiens
agctctgcatgttccccctcgtggggggaaacccattgtcagaaggatgtttgatggccccctcccctcccctcctttacctcctaagcagtcctggcttttcctcatcactcccctttacagtgcctggtaacaaaggtacattggaggaccccaaccttttggtaagaattgtcccgtagcttgatattacagatggggtattttgccataaggtgtaaggctttttgcccagagaataagttatttatattagaaattaattttattaattaattgcca

SEQ ID NO: 503000 - DNA, 472 bp, Homo sapiens
gaggaaagtgctgaagcaggggccagtagccaccggtcggacacagaatcctatgagagagcgacgaggcagagacttcacatactaaatacttataagccccaaaaggatagctggaaaagtcggcaggtcatcctcttctggaggccatacttatcgcgcgtcacccatagatcatcacaagaaacctagatcaggacacagaaacatctatatagtaataggtttatatgacaaactagctaacaaaacctctgacatctaaatagaaaatatcatcacttgacgggtacttcacagcgcggacaagttatttcctatctcatcccagcggccacccctcccccaaactctcaaacgtacttctggtgaggatccactcccagctcaggatagaacatgtgacctaggccccaaccaatcagcacgtctcatccccttggccaccatgattagctcaccgatgggcatg

SEQ ID NO: 503001 - DNA, 709 bp, Homo sapiens
ggaggcgaaggtgaccgggaccgagcatttcagatctgctcggtagaccgttggtgcaccaccaccatgtgcgtgcagaggtgatgtgtctccggacattaccttctagggttgccacccagctctcaccaaggctctcccctgttgtgaagaattccatcacgaagaatcaagtggctgttaacacctagcagggaatatgccacaaaacaagatatggggactccgggtgtgggagaacctgggcaagaatcttcacagagcgcagcatttggaaccatcgattggacaaaattattagaaattgatcagatgggaagatggtttgttgctggaggggctgctgttggtctgtggagcaatgtgtgcctactatggctggggacgtgtctaatgagatgtggagctatgtgaaaaaggcttgtaaatttgggcctcagtcttgtcacggatagaattcattccaccctatatgtacttagcagggaagtatcgggttaaaacaagcttgtgtcctggccataagcaatcaagcagaagcgcctgtctccattgaaattccatgatgacggaggctcttggggtgcccaattgggggtgcccctttggcaacgcaatggttggcacgcttggaatgctgggtacgatcaataccattatgacagagcccaggcccaaagcattctgctgggtgccacattctggtgga

SEQ ID NO: 503002 - DNA, 172 bp, Homo sapiens
aaccttttttctaaaaaggggcccccctttttttttacaagaaaaaacaaaaaaattttccccaagcctcccccgggggaaaaaaaaaaaattgttttagttaaatggcccaaagggggggggggaacggggggggacttgggccttaaaaaaaaaggacctttttttttta

SEQ ID NO: 503003 - DNA, 319 bp, Homo sapiens
  misc_feature (78)..(78): n is a, c, g, or t
  misc_feature (297)..(297): n is a, c, g, or t
gatctgaagagcgtctgggtcactgggcatcactaaggtcttcagcaatggggctgacctctccggggtcacagaggnggaccctgaagctctccaaggccgtgcataaggctgtgctgaccatcgacgagaaagggactgaagctgctggggcatgtttttagaggcataccatgtctatcccccgaggtaagtcacaaccctttgtcttcttaatgttgacaaatacagtctcctcttcatgggaaagtggtgaatccaccaaatactgcttcgtctaccctcctcatcctggcntcctggtgcataagaggtggtg

SEQ ID NO: 503004 - DNA, 112 bp, Homo sapiens
cagatcatggacaaggaacggcattcctcctgaccaggcacaggttgatcttatgccggaaagcagctggaacatgggcgcaccctgtctgactacaacacaccgggcgatc

SEQ ID NO: 503005 - DNA, 359 bp, Homo sapiens
gttacattcacatgttgaagccgtaacccctagtacctcagaatgtggtcttacttggaaagaaagcggttgcagatgtcattagttaagatgaggtccttatatgactggggcccttataaaaaagggaaatctagacccagacatgtgcatagagaggacgccatgtgcagatgaaggcagacagggtgatgctactgtaagccatggatgccaaggattgccagccgccaccaggagccagagggaggcgtgggacagattctcactcccagcccccagaggaagcaaccgtgcccaaccttgatctcaggttccagcccccttcactgtgagacaatacacttctctagtttgtg

SEQ ID NO: 503006 - DNA, 1209 bp, Homo sapiens
agcggcttggttcatttcttttcattcttttttctctaaacttcccttctcgcttcatttcattcatttcatcttccatcactgataccctcacttccagttgatcgcactcggctcctgaggcttctgcattcttcacgtagttctcgagccttggctttcagctccactcagctcctttaagcacttctctgtacttggttatcctagtcatacagtccatctaacactgtttcccagaacgctctctgcaacttctttgccttccgtttgaactttcctcctgttagcttcggagctcgctctgactcgctctgacagtcttcttctctcaactcagtcaaagtcattctccgtcccgcttgctcccgctgctgcgtgacgcgaactgcattccttcggcccggaggcacgcacgcgcctcctggctttcttcgcagcttctccagctctccctagctctgcttcttattccgccacctcttaagctggctcttccaactcctacccttctcgggctcattgcatgcactggctgactgcagcagatgaagctcttcacgcgttgtgcgcactgctcccttttcctgcttctgtctacgctttttccgctgtcttaccccagcagccacgggaccccttcgagcctggcagcgctcctgcttcgggcacgcttctctgccctcacgcacgtgttcccaccatctcaggcacgccctgttctgtgccctagcgttagccctctcatgccgcggtggtcctggcccaatccagccaccactttttggctgggaaaccccaaccgaaaattgcactggcttgtgtcttggagctccgctttcccttcctggggacacccttcctcgctcctccagcagccgcagcctcacctccttgctccggtcgctttgcaggcctgtccatggtctcgccccctaatctgcgggcggatcgcctccctcatttacgggctggcctccgctgtcctgtcacatggacgctccacgcgcccccccccacttcgaccagcgaggccctctcttggcccgctcctcccatcattctcccagtcttgcctggctgtcggcgacttacctctgtctctcccttccccgctgctcccgctctgcgtcctttctccttcgccgctcggctttctgcctgtcttcttctgctctcgcctctttcccgtccccctgtgtggcctcc

SEQ ID NO: 503007 - DNA, 123 bp, Homo sapiens
agtgatcccttgatgataccatctccatccttgttcaaatgcatgaaaatgctctgaacatgccctccagcctaactgagtacaacctgcctggtggtggtacctgatgctcgaattctgtaa

SEQ ID NO: 503008 - DNA, 863 bp, Homo sapiens
gtcccggccccgccgttttttacccccctcctatagggctgccacaacccttttttgcaggttgtaagcatatgaacagggtgaacctttataccacggcgtccttacagatgctattcgtttgtaaaagagaccgtttgattcgtgggagttaatacaacacaattctgtgttacccccgcagtctcttttttaaagaaagcggggctgtttccgcccgagagggggtgatttcaacaggccccctgtgtaatcctcccctcccgcccgccgggagcgaaaatttccgctctcacctttttacacccccctctagtttaacagcccctgtttccctctatcccccctcgcgctcattgataggtgcaaggagactttctgatgaggcgacatgtgtcttagggcgaagtggcaaaccccttttgtgacgacagaaattagaaaacctttctattgaaagtggagcacacccgcgtacgacaccactccgattcccgcgtgaagtgcgcgccacacataaagaattattagtgagcaaagacctcttgcgagcgccaatcttgagatagagatatggtacacaccactcatctcttctgaaagaaaatacagaacacggaatttttaaccccccgcccgaatatattagcaaccaccgactagaacaaaatactcccctacttaagcgctaccccaacaaatactagggccacatatgtccccactccttctcatactacaaattctgaagaagatatagaaacacccaatattagagcaaattcatacaattcttcccacaagtcttccagacaatcaagaagttccaaaccccgaacccaaattttggaaaaccccataac

SEQ ID NO: 503009 - DNA, 238 bp, Homo sapiens
tcccgggccagcatgccctatcgtgggaatcgttgctggacctggctgtactggttgtcctagctgtaacataggagctatggtggatgttgtgatgtgtaggaggaagagctcaggtggaaaaggagggagctgatctcaggctgcgtccagcaacagtgcccaggcctcgagagtagggcctggagagaaggctgagaggcaggagctgggtctaaagaggccattgtcaagacgg

SEQ ID NO: 503010 - DNA, 257 bp, Homo sapiens
gaaaaaatttgcccccttaaaaccccttttttttaaaaaaaaaaaaaaagaaaatttccttaggggacttatctttgcaggtggggacttaaattttttttaaaaaaaacccctttggattggtcccattgtttgacccagtatgttttgtaaacccgttagttaaaatccccctgtatctttaaaaatggggggaaatgaacccgccccttccccttggaaaaactgatggttttaaataaactaattccctaata

SEQ ID NO: 503011 - DNA, 246 bp, Homo sapiens
tatgggccttaaacctatttgacttcctactggactgaccctgacaccctccagtcacaacaactcacatggactgtcctccctcagcgacttcaggtatagccctcatttctttggacaagctctagcccgaaacctcacttccttaaacctgtctcccagtcatcttcaatatgtggacgaccttcttctttgcagcccctctctaaaagactctcaaactcacacggccattcaacgcctccg

SEQ ID NO: 503012 - DNA, 145 bp, Homo sapiens
  misc_feature (9)..(9): n is a, c, g, or t
  misc_feature (80)..(80): n is a, c, g, or t
  misc_feature (133)..(133): n is a, c, g, or t
tgaagctcnggcacttcacgccggtcccgcggagatatcgatataagaagaaatgggctaccacagaaccacaattcacnggccagtcggcttgctctgcagaattttgacatgacctacagtgtacagtttngggatctttggc

SEQ ID NO: 503013 - DNA, 165 bp, Homo sapiens
ggtctctgacaggctaccttccccaggattctgatcttaagcacactgccaagttctctattctccagtatctagaagattgctccacaagattcctgcccccatgctcccaataaccccaatgtcatttacttactatccaccaattgtgtagaaacttgaact

SEQ ID NO: 503014 - DNA, 392 bp, Homo sapiens
caaagtttgcatactctcgctattacggtccacgtacagcgctattagtactgtgaccgttttccgcctctgtaaacgtgtaagcgtacagcatggcgcatactaggcagagtagacccacttactatcactaatggagtgaaagtagagcaacttgagcataagcccattggacggtgccttatgatactaacgaatgagtactggaatattgacaggccctattttggagaacgcctaatgagagtgatagacgcagaagtccgttcttatgcaacggatctaggcagaggtagtatatacatacgtgggaatacagccttacaagactgtgcaagttcaactacgggattgacggttgccttcacagggtgctggtacacattcccggg

SEQ ID NO: 503015 - DNA, 179 bp, Homo sapiens
cacgaggcggatgggcatccgcaatcgcgcggattgagggggctcgcggcgcttggttcctggtctccgggtcagggcaatgtgtcgcacggtagtgatgatggcggccagcctgtccctgaccgcggctgtggtggctcacgccgactatctcagacaccagttctaccccactgtgg

SEQ ID NO: 503016 - DNA, 1014 bp, Homo sapiens
  misc_feature (3)..(3): n is a, c, g, or t
  misc_feature (136)..(136): n is a, c, g, or t
  misc_feature (144)..(144): n is a, c, g, or t
  misc_feature (159)..(159): n is a, c, g, or t
  misc_feature (162)..(162): n is a, c, g, or t
  misc_feature (282)..(282): n is a, c, g, or t
  misc_feature (299)..(299): n is a, c, g, or t
  misc_feature (306)..(306): n is a, c, g, or t
  misc_feature (312)..(312): n is a, c, g, or t
  misc_feature (467)..(467): n is a, c, g, or t
  misc_feature (479)..(479): n is a, c, g, or t
  misc_feature (539)..(539): n is a, c, g, or t
  misc_feature (541)..(541): n is a, c, g, or t
  misc_feature (593)..(593): n is a, c, g, or t
  misc_feature (599)..(599): n is a, c, g, or t
  misc_feature (619)..(619): n is a, c, g, or t
  misc_feature (623)..(623): n is a, c, g, or t
  misc_feature (643)..(643): n is a, c, g, or t
  misc_feature (655)..(655): n is a, c, g, or t
  misc_feature (747)..(747): n is a, c, g, or t
  misc_feature (766)..(766): n is a, c, g, or t
  misc_feature (790)..(791): n is a, c, g, or t
  misc_feature (803)..(803): n is a, c, g, or t
  misc_feature (812)..(812): n is a, c, g, or t
  misc_feature (828)..(828): n is a, c, g, or t
  misc_feature (842)..(842): n is a, c, g, or t
  misc_feature (852)..(853): n is a, c, g, or t
  misc_feature (860)..(860): n is a, c, g, or t
  misc_feature (869)..(869): n is a, c, g, or t
  misc_feature (920)..(920): n is a, c, g, or t
  misc_feature (937)..(937): n is a, c, g, or t
  misc_feature (947)..(947): n is a, c, g, or t
  misc_feature (951)..(951): n is a, c, g, or t
  misc_feature (961)..(961): n is a, c, g, or t
tantgcttttttaatactttccagttctgccaacattcctgtcatgcatccttaataacaatgctctcccagaaccgggatgcgcgcgggcggtgaggtggggttggtgggggagtacgtttctgagctagttagngtcacgtnaggagggccgcgtgnctngatgtgtgtggagtgacaattagaaattagtcatgggagggcatgtctaccacagatatctttcctcacatttaaattattccatttcttcctacagtcctccttctatctttagttccnttttaaattacccttcntccttcnttcccntttttcttgcttcctttttctcccttttgtccctctagtttaagagattgtgcttctgtttactgtcctgttgtggtgcgtttaaatcaaaatgtgatcgataattattgtttaacaaagttcaggttgcgtgctctaaaaacataagtggtttnctgttggatgcncttccgctctctttgtttcctttccgagttgatgtctcttcgtatatttcctttttccanangggcaccttggcttttaaagtatcaatggcatagctcaaagcttcaagagangcagcnctgtgggctgaggacaaagnaatnattatgcttgcttctgacantggaaccaagcnaagtctatggaacactgctatgtgtttgactggccatttctgcctaatgtcactacaaatctttctgacttcattttccgccatgggtaganatgcttcatattctaagcnaatgacttttttcccttcaaagtnntttcttgtagtncctacaaanagggatattgcaccanagagcggcgaaatnaccaactgtnngacttcntctactganagtttctcggcagtaaagtttgtaacatctttagatttctcttcaacttcntccatatctttcctggntggctcaaancacnatctccactnatggggggggtacggcaatttcgtctccggctgagcccgggggcgctctccag

SEQ ID NO: 503017 - DNA, 892 bp, Homo sapiens
actcgtcgcggggcccgcatgtccccagcgcttgggcctcattgggggttcttattgggccccgggtcgcgccaaacagtccgtggatagccgtttagaggttttaaagtgtcaggtttctcagggccttcaacggcccgctggattctacaggtcctcccccgagtgccccatgtctatttcaggctgggtgcgtctcagccgcgtctccgcccccagctccaaggggcagggttctccttccggaaccggggagtgtcctgatccccccacgggcacgcttgtcttgctgggagcctttgcgccgttcgtccccccctggttcgagaaaaaaagggggtttgccctcttcccagcacggggcgcccatgtcagtcccaccttggttggaagaattgttctcacggaggcagagggcccaaaggggatcttctccaagtactacttggcccgtaggggggacaagttttcttaaaagaaggaacgggccaaacccaaaaatgtggatgacacatcgtgccctcctaacaaatgctagctacgtcagtccccggctaacatctgcgcgcttcccttgttcagttataattcgcagagtaagctgcctttctcccttcctcggtcatgaaataacaacagtttgtcacccagttagtcttttgcaccaacaatggtagttgtcaccaacacaagacccgcgttgatttcttgtgtaaaaagacagggaagcctcaccctccacttggcgattctgaaatacatatgccattcggaaggtcatatcaacacagaaaatattaggagaggacggtcgcaacaagagagtaaatagtggggagaccccaaaaaaaaacgggcaaaagcccccttttttaaaacagccaacataaca

SEQ ID NO: 503018 - DNA, 970 bp, Homo sapiens
ggcgcgcgggcggcgtggcgggctggggatccgccgcggcagtgccagcgtccagcgccagacccgcgccccgcgctctccggcccgtcgcctgctcttgggactctgcgagcccgcgactcccgccctgtcctgttctgctgcccgagtatggagctgcgtgtgttgcgaatggcaccctgtgcatctgcgccccgggtccggtgccgtgaccctgctggctgctgtggggaccagcgtgtcctgctagagcctgctccgcctggagtgagcagctacgtaccccgtgcctcctacttccagtgcgtgcatctgggcagatcaagccgtacattgcggaagatgctggcttactggatgctggaggtatgtgaggagcagcgctgtgagcgagcgaaggtcttccccctgggcttgagctaccttgggatcggcttacctgctcttggcgtccccactcctgatcacgcgccgctagttcgcgagggtccttgcgttgccgcgtctgtagtgctggctgggccctcccaagcctagtgacgaagaacgagggccccattgacccattcggaataaaccatgttgcatcatagcaagcgaacccacgacgtgtcttctttcccacggcgcagttgccgaggaccatgcggcagacgtgcttgcgtccctaagggcgaccaggcttccaagcagcgagaacccaagggacccgatctggtgcgatcagacacaattgaacaactaccctgcgcccctcccaatactcttgcaagcccaggaccacactacacaataaacaccatgaatgaaatcccgaaccactggcccccatccgaaccaccaacaaaaataaacactatgccctacacgaaaacccaatacagctggacccccgtatcttgttagcactaaccaaaaacattaactcaatccactattagcccaatgataacccccgagtcaacacaac

SEQ ID NO: 503019 - DNA, 705 bp, Homo sapiens
aacgatgaagtaactggcgaacatggtccggcccaagcctcggatgatactcatggacatatgtctaccgcgccgaaggcttctgcggtagctaactgggcataattttcgccagatgatgactagttgcgggaatacagtagcctggcatgtgtgttgacgcaccatgaccgctgcgcttatcgcgccccgtacgttgcggaggcctcgcttttttcgagggccaaacgctgtgcactaagctggcacacgatgatcacatgtgaatccgaggacaggatggatcgtcgcgtggatgcgtcgggcaccgtcgacgtcgctgaagagacgaaaacccagagggcgcaacgtttcgagcgtgacgccctcgaataccttgaccagctctatggcgccgcgctgcgcatgacccgcaacccggctgacgccgaagatgttgtccaagaggcctatgccaaagctttttcctcgttccaccagttccgacctggtacgaacctcaaggcttggctgtatcgcattctgacgaatacctacatcaactcgtaccgcaaggctcagcgtcgcccccagacatcagatgaccaggacgtcgaggattggcagatcgctaaagctgcgtcccatgacagcaacggtttgcggtctgccgagttggaggccctagatgggctgcctgaccagcagattctagacgctctggac

SEQ ID NO: 503020 - DNA, 114 bp, Homo sapiens
actacgtctagctctgtagacgacgatgtagcgctgtaaatcttggcaccgttcaaaccaatcacgttgatccattcgtgctccattagatcggttagaagaacaaccgcatca

SEQ ID NO: 503021 - DNA, 402 bp, Homo sapiens
tgaaaggcaaaaaaaaaaaaaattttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttaaaaaaaaaaaaaaaaaaaaaaaaaaaaaacttttgggcccctttggcccatttattttttaacttgggcaacttttttctttgggcccaaatttgggtctatttggccaattcccccttatggggggtgttttaaaaattaagggcccggttttaaaaaaggtggttttgggaaaaccctggggttcccccatttaaaccctttggaaaaaaacccctttttcccagttggggtaataccaaaagggcccccccctttggccttttca

SEQ ID NO: 503022 - DNA, 465 bp, Homo sapiens
  misc_feature (72)..(72): n is a, c, g, or t
  misc_feature (181)..(181): n is a, c, g, or t
  misc_feature (189)..(190): n is a, c, g, or t
  misc_feature (341)..(341): n is a, c, g, or t
  misc_feature (360)..(360): n is a, c, g, or t
taggagtgtttgcttgctcttgctgtgtttcgatttttgatgcaattctttaattttggaagcctatgaatnatcagttttcattttggagataaaattaaatggatcactgatattttagtcattctgcttctcatctaaaattccatattctgtattaggggaaaaaggaaaaaaaaanaaattacnnccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacancggccatcttttctttggncaaagttttctgtttattttgcctgtcaaattcgatggacctttaaggtgtctttatgaagtttgctattctggcaataaacttttagacttttgaaaaaaaaaa

SEQ ID NO: 503023 - DNA, 267 bp, Homo sapiens
gattaataaatggcttttcataattatcatcctctattacaacttcattggctgtacgataattcacattttcatctcccaaaccaaatgtatgacgagcttccccgtatttcatcataaatactgcaggctcaacatactttttgcagaccaactgaatatccgagcattgctagggaactattgtaatcgttgccctttgatgtaggcttgctctcatcactgacagtcgggctaatcgtcttacctggcttttcactttagcca

SEQ ID NO: 503024 - DNA, 510 bp, Homo sapiens
ggacagcttcaggtatgtctttatcagcagtttgaaaacagactaatacaccatgggagccccaggcaagcatcttttcttccagaattcctgccctgagccctcaggcgccaatagctccctcctctgagttctgattcttcctccctctttccttccttctgcatctgcattttccccgttattgttgtcaaatccatctctcccccaccaacctgcaagcccctcaaggacaggattgtcaccttcctttgtgttcccatgacactaaccacgtttctctacccctccaggttaccttcctccatgtaagagaggctgtgcaaatggtttcagggtgtttttttttttaaagttttatcatggtaaacaatacttaacacaaattttaccattttaaccattattaagtgagcagtttggtggcattaaagtatgttcacattgttgtgctaccatcagcaccatccatctccagagccttcttcatcttcccaacggaagctgtcc

SEQ ID NO: 503025 - DNA, 434 bp, Homo sapiens
  misc_feature (72)..(72): n is a, c, g, or t
  misc_feature (310)..(310): n is a, c, g, or t
  misc_feature (329)..(329): n is a, c, g, or t
taggagtgtttgcttgctcttgctgtgtttcgatttttgatgcaattctttaattttggaagcctatgaatnatcagttttcattttggagataaaattaaatggatcactgatattttagtcattctgcttctcatctaaaattccatattctgtattccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacancggccatcttttctttggncaaagttttctgtttattttgcctgtcaaattcgatggacctttaaggtgtctttatgaagtttgctattctggcaataaacttttagacttttgaaaaaaaaaa

SEQ ID NO: 503026 - DNA, 125 bp, Homo sapiens
gatctagaggatcccatggcatgtagtgaggaatgtaggttctggaaaaaaatagaggagggaattgaattggttaaacattttcgtagtggagcggggagtaatggatgagtatttgcaggtta

SEQ ID NO: 503027 - DNA, 336 bp, Homo sapiens
tcagctcggtacctgacgctgaaggtcaaaggatcgcttgagcccaggaggttgaggtccagtgatctgtgtttgcactgctgcactccagcctgagcaagaccctttctaggaaaataaaaaaaaataaaaaaaaataagaaaaaaaaaaaaaaaggaaaatctgggtctgttttgccaatctggtaatttccaggaacaaggcaaacaattggttttggaacccagttctctatgggtctctccagtttcctgcatgtgtcttattgagcagatttgccctgacagcttttattgggctacatatcttccctgtacaggacattctgatagata

SEQ ID NO: 503028 - DNA, 329 bp, Homo sapiens
ccttctccgcctgcaggatggggctgggcatggttggccctgatgtggtcccatctcactctgagaacctcatgtacaaggctgtgactcaacgttttcttcatggctgagaggtgctaattggttcacacgctgttttccaagatgtgagctgggaagggctagctcttctggcgtatcccatacccgagtattctctagggttcttcacaatcctgggacagtaaagaagggaaaagtggtaggaaatgcgagtaaggcatggaaattacaaatcattggctaccaaaattactcaagctgaagaaggcagacaactttaggagatg

SEQ ID NO: 503029 - DNA, 408 bp, Homo sapiens
  misc_feature (329)..(329): n is a, c, g, or t
tatccccggctctgggtatatttaagataaagttttttttaatcgcagccaaaagacacatgaaaaaatgctcatcatcactggccatcagagaaatgcaaatcaaaaccacaatgagataccatctcacaccagttagaatggcgatcattaaaatgtcaggaaacaacaggtgctggagaggatgtggagaaataggaacacttttacactgttgctgggactgtaaactagttcaaccattgtggaagacagtgtggcaattcctcaaagtcctaaagacagaaatgccatttgacccagcaatcccacaactgagtgtatacccnaaggaatataaattattctgttataaagacacataccacacgtttactgcagcactattcacatagaaaagacagaatc

SEQ ID NO: 503030 - DNA, 499 bp, Homo sapiens
  misc_feature (24)..(24): n is a, c, g, or t
ctggccttggttcagagagagaantcagttgcagtgtaaaaggccattgcccactatgaccagcaaatgggtgagaaagtggaggtggccatggaaacccttcgggagctgttggacttgtgcaggaccagtgagagggaggccattgaagtcttcatgaaaaactctttcaaggatgtaggccaaagtttgcagaaaggattggagactctattagatgcaaaacagaatgacatttgtaaagggaacctggaagcatcatcggattattgtttggctttacttaaggatatttttggtcgtgtagaagaagcagtgaagcaggggatttattctaagccaggaggccatgatctcttcattcagaaaacagaagaagtgaaggctaagtacttcgggagcctcggaaaggaaacaggctgaaaaagttctgcagaaatatttagagtccaaggagtctgtagtcatgcaatattacagactgtccaggctctccaga

SEQ ID NO: 503031 - DNA, 221 bp, Homo sapiens
aaaagggataaggagacgaggagaagattttagagtggggagtctcaggagctcatatctcagatataccaagtttgaggtgtattaagacaaccagccaggtgcagtagctcatgcctgtaatcccagcaagttgggaggccaaggcgggcagaacccgaggtcggtagttcgagaccaacctggccaatatggtgaaatcccgtctctaaattttgtat

SEQ ID NO: 503032 - DNA, 1781 bp, Homo sapiens
gtgtcacgcctagagatggagcgtcggagcgaagaagaaggctgtatgagtatgcagaggcaatttgtgtgtgtgtacgtctgaagagactgcagtcttaaaaatcgatgcatgaccgagagtgcgtgtgatgagcgatgggttgatgatactcgaatcgtagatactatcgacgtctcaccaatgactctagtgatatcacatgatacgttgactccataacttggagcctaggcagcccatcatcatcatgtcatccgatgtgacagatatcgtaatgagtcgtccaatccgaaccagtcatgctgtggaccctctgatatacctgtgaggcgaaccagtgccatttataaaccacggtgcatgcatgactccagggagtgcatcactggacgtaatggacaagcatatagatacacaagaaaaaaaagcaactaaggtaacaatacaggggaatatcccgaatgaagtaaaacaaaaggacacacaggaaggggacaactgagcggaaatgaccagggaaagggaagtcccacacacaaagtgccatgggggaggccaaccacccagagaagagcagcactagccaaagaaaacaacgggcaagaccacgccaacaaaaaaacacaagcaaatgtagccgagccacaggagcatgcacaagaacaggcaagaatgccaaaccaatcaatgcaaaaccaagtggcgatccagcacatacaacacaacggtgtacatggcaacttgcccaaacaaggacaagaagcgagacaaggaccccactgaaccaaagacagacccaaaggacaacagatggaacatcaaaaaaagaggggacagaggacacaaagaggaaaccaaaataagaggacaaataaaagcaatcaacaaagaagaaagagaagaacagagaaaaagaaaaacacaaatacacaggtataccccctgttcccacaagaacgcagggcaacagacaaacagaacccagcaagaggaaaaccaaaaacaaaagagaataccctaacccacccagccaagaaacaaagacataaacacacagaaagaaaccacaagacaggacatcgacaatgaaccgcagagtccaaacaccaaacagcgcacaagccaccgcacacggacaacacaaacgccagagcgagacaacaccacaacaagaacacacccactgaaagcccacaaaaaccccacagaacaaacaccaaccaaaacaacagcaacccacacacgacacacacaacaaaaaacaccgcgacagccatacagcaacaccaccacacaaacagcgcaacacaagacacacccacacgcacacagagtaccaaacaaaacgtagcgaccacgcaaacaacaagagaatactcacaaaacacaacccaaacgacacacacacaagaaaccacatcaagacgacagacacaccaaaacagcggacgaacacaacggcacaacaagcagaaccacaccagagctcacaacaaacacacacaagaaatacacgcaaaaaaacaaataagagacaacacaccacaaaaacacacaacactcgcaaaatcacacagcgtagcacacccgacgaaaactacgaaccacttaacactcaacacccaagaccacacactcgaacatatacaatagcaacaaccacaaacataaaaccaaccacagcacaacacaagccaactacaacaccaggcacaagcaagctaacaaacgcaaagcagccagagaacacagccacacgctacatccatactacgccc

SEQ ID NO: 503033 - DNA, 137 bp, Homo sapiens
ctttgcccctttttccccggggggcccccccccattgggggcccccgggttttttttccccccccccccccccccccccttgggtttttttttggtaatgttgggggggaatgaataaaaaaaggggttttttgcca

SEQ ID NO: 503034 - DNA, 233 bp, Homo sapiens
ggcagacagccatggtcacatggtgaaaaccgtctctagtaaaatagaagaatgagctgggcgtggtggcgggcacctatatcccggcggactcaggaggctgaagcacaagaatcgcttgaacccaggaggcagaggttgcattgagccgagattgtgccactgcactccagcttgggtgatatagcgagactcagtctcaaaaacaaaacaaaacaatcttcatatgtacc

SEQ ID NO: 503035 - DNA, 187 bp, Homo sapiens
tacatcccctttacagtgtatggcagctcacgcagaatacttgcctctatgtgggactaagcatacgaggccataagcctacagtcaagatggattctcaccctccatagcccgtcccaacttttgttcatatataccgtatctggggaaatccctgaagccccaagcagacagactgtttccacct

SEQ ID NO: 503036 - DNA, 256 bp, Homo sapiens
taccgtggcctgtatggtgacaccagaagggagagcatggctcaacccctctctggctcacccctccagctctggctccccatgtatcattatatagtgacctcctatgtctgttctgacaaattctgactgttttctcttttgtatgatatatgtatagccgcctgtgctctctttttggtaccatttgcatgagattttctatttcttcacttttatctcatgtgtgaacttaaaacaaaagagtctgttatag

SEQ ID NO: 503037 - DNA, 399 bp, Homo sapiens
ctatccagagcatgggatgtttccatctgctgtgtcctcttggatttctataagcaggggttgtagttctccttgaagaggtctttcacttccttggttagctgtattcctaagtattttattctcttggtggcaatggtgaatgggagttcattcatgattggcatttcttctggtctgttgttggtgtataggagtgctggtgacttctgcacatggacttggtatctggagacttggctgacgtggcttatcagcttaagaagctttggggctgaaatgatggggttttcgagatataggatcatgtcatctgcaaacaaagaaaatttgacttcctctcttcctatttgaatacgctttatttctttctctggcctaatggccccgggccgaatg

SEQ ID NO: 503038 - DNA, 329 bp, Homo sapiens
  misc_feature (104)..(104): n is a, c, g, or t
  misc_feature (189)..(189): n is a, c, g, or t
  misc_feature (198)..(198): n is a, c, g, or t
  misc_feature (227)..(227): n is a, c, g, or t
  misc_feature (229)..(229): n is a, c, g, or t
tttattttcaggcagggtctcgatctgttgctcaaactggagttctgtggcgcgatctcagtttactccagcctccacctccccggctcaagcagtcctcccanttcatcctcccaagtagcttaaactacaggtgcatgccaccacatctggctttttttctgcattttttttttgtagaaatggggntttgtcgtntggcccaggctggtctcaaacttctgggntnaagcgatttctcccacctttgcctccgaaaggcgtgagtcaccagggccagactagattgagtttaaataagatttggttgtggcagccgagccgggtgg

SEQ ID NO: 503039 - DNA, 830 bp, Homo sapiens
gggaggttgtggtgagctaggatcgtgccattgtactccagtgcttgtgtaatacagagcgaaattctcgtctctcacagcgagaaattgcgttgactcctggtgagcgtggagtgttgtggtgagctaatgattgtgccattgcatcctccagaccttgagtaatttgataggaagctgatgatcttccgtctcaatatagcagcaaaaattaaacacgaacagcccactatacaatatcacattacatctcatctcagatcttccaggaactcatatgcctggacattttgctgcggtgacctggtgcacatgaagcgtgttgagcatccgatattacccctagtagttgctgaagagatgtgttcgcgcgcacatctagcactgtcttgctgggtcactagagactgacctttattagtgtatataccacttgttgcatcgcgtgtgatccgcctcgaaaatgtttctgtcaaacgcaaaacctcactacacactgcgcctgctccgtaatgtgaccaactcagatccacgccaagttttgcaacatctatcagcaccacacaataacatataacccgtaagttacactgttcccccaccaccgttgctttcctggaccccccttgggggatcttgtcaccttcaaacgggcgaattactcgtagcggcgcccctggggtgaccagaggtttctttgataccacgtggtcttgccatttcacgctacactttcgggaagcgtgcacacgtgttctccccctggcaacaatctctcacacctattggaggacacacagatctacggcaagagcgtaattcccacacgc

SEQ ID NO: 503040 - DNA, 112 bp, Homo sapiens
ctctgaagcactacagcttcttggtgcaccatcttctgataaattgtctttaatgacgaggtttgtttcctccattcttcctctggctgaagaaggatccaaatatcaatga

SEQ ID NO: 503041 - DNA, 410 bp, Homo sapiens
tgcctctttctcgggattccgtgtgttctcatcattgggtttcagaatagtctctttcgcatacacttaaactgtcagatccgtcacgtttaacatcttgtccaaaggtgtatacaggatatgggagtcatcagcggcttagaacgtgtatcttgttcttaaatgcctcctgtgaagtccatgtctatcagggttctatagcaccagaacttatgtactgggcttatgcgtatatctttaacatagctatcgtatatgtctcatagctattgagcacccgatctacagtcttgctcttcgaccacaggagcacatattcgcctgtgggtccacgatgcactcataagctccacgacacagatccaccgctagactctgactgttcgactgtgctacagagagcccgagcg

SEQ ID NO: 503042 - DNA, 200 bp, Homo sapiens
ccacgtgcgccgagcccccttcatttggcagtggagcccaggcagccgatgtgctggagcttctcctgagggaggcgcgaaccctctgcccgcatgtacggtggccgcaccccactgcgcagtgccatgctccggcccaaccccatcctcgcccgctctcctccgtgcacaacggagcccctgagcccgagggcgaggac

SEQ ID NO: 503043 - DNA, 189 bp, Homo sapiens
aactatagttgataataatgtattgtatattttgaaatagctacaagggaggattttaaatgttctcccccctaaaaatgctgattattatgaatttatccttttaccttggatacatgcataaaatatgttggaccccataaatatatataattattatttgtccattaaaaaccggcttccttctga

SEQ ID NO: 503044 - DNA, 277 bp, Homo sapiens
atgatgcaattgtcactaatttttaaatgcttttgaaatgaaatgcctaataatcacctggaaaacatagatgaaagtattaattaaagaggaaacctgcaaatactgaggttcaataggtagaaaagacattttaaaaacagcttttcatacaaattttgacatacaatataaattcagttaatataaagtgcacccgtaaagaaatcaataaaaatgatagtggcagcaaattaaatgtaattctgtatccaaagatttaaataataattaacaa

SEQ ID NO: 503045 - DNA, 428 bp, Homo sapiens
  misc_feature (42)..(42): n is a, c, g, or t
gacctgggggtcaggtgtccaaccaaaagcaccctccccganattgtttttcccacaaatggagtccagacccccgggccccccagggcctacttccttaaaaaggaggggagtggcatcagtggtttccagggcatgaccccccccccccaatttggaaagctttggattctgggggatgtttttacccccccggattttcccttttttgaaaggggaaaaaaccaggtggggctggcccccgggggttaaacctaaatttttttaccccccccccaggaagatttggcctttgtcctgggccccctttaaaggaatttaattttcccggctgtttttccccggggagggggggggttttggcccctttccccttcccccccaaaaagtaaaaaaaaaacaaaccccccttaaaccggttttttgga

SEQ ID NO: 503046 - DNA, 936 bp, Homo sapiens
gccgccgtgccgcgccgtgcgggcgcgtctcctcctaccgtcgggtggcccgggcgtcctctgccgtgttctcgggcgttcctacccggcgctccccgaggcgcggggtctggggctcgacgataggacggcccgtgcgcccgccggggccgccgctccctgggcggcggggggcaaggcattgaagctcttccaagccaggaccataaattctgcaagcagggagagccgcgcgttgtgtttgcaagccgcacggagggggggcctcaaagttccggacccggattatgattctaactttttgggcgttggaaattccccatttggttggggttgggaagaacgggtgctttggagaacaattcaattttcaatttcagggtgggaagtagtacttccacttggcattggatttggtgctcatatgttttattcaacccagttggtccttggttttctggaccagtaaggcgtggtcccaggggtgtcactggaatttaatacacataagggtgccaggtgagaaatactacctgcggcgttggtggaggttggcacccttccgaggggtaaatttccaaaagtgtttgggattcagtggagctggataaaggcttcctcccagggcgggctatattccaaaattgcggcagaaagctttggggggcaacctccccaggggaccattggtgtctggcaaggtcccaaaagtgggtggcgtcttcatttctgaagtggaccctagggtcttgggtacaagttggagaagtcatgttggttacaagcagggagagtttccttcctggtggcccagtctatgagacttgcttaaacagtgtgggctataaaaagtcgagaaggagaggggggataggggaagagaagattattagagagggaggagagaggcgaaacaagggggggtagtgtgacatg

SEQ ID NO: 503047 - DNA, 175 bp, Homo sapiens
agacgatgatggtttggactgattctggtggtccatcaggttctctgagacgccagtgtggccgaggcctggctgcttggactggagccgtacctgtccctgccgatcatgtataggccacgatcgtgtgactcatgtggcgccagctcatcaattcgcctcgaggtcctttgaa

SEQ ID NO: 503048 - DNA, 136 bp, Homo sapiens
acgattttccctatttactgtaggaattacttccaggtagttggatctatcgatctctttccttcttttgacattctgtgatcttcttcctggaaactcagactctcccttggttaaccgtttttcacacaacccc

SEQ ID NO: 503049 - DNA, 144 bp, Homo sapiens
cattaattttactccaagttttcaaaaactactaaagaaatattatctaccatatcttgtatgcctctatattttctcctgcctacaagagaatacaggcaatgttagtcaggtctgtcctatatttccacttgttgtaactcg

SEQ ID NO: 503050 - DNA, 153 bp, Homo sapiens
tacatttcagctcggtaccccacaccacctgagtctccgcatgatgaaacttcggctcactccttggcgcctgcctgatcctccaaatcaccacaggactcaggtggtgtgactcaggtggtgtgactcaggtggtgtgactcaggtggtgtg

SEQ ID NO: 503051 - DNA, 195 bp, Homo sapiens
atcgagctctgtacccggtcacatgcacagttaatattttgtatttttaatgtaggcatagggtttccaccatgttggccaggctgtgtctgaactcttgacctcaggagatccacctgctttggctcccaaagttctgggattacatggcataacgcaaccacacccagccttcccaagccaatctcaaactct

SEQ ID NO: 503052 - DNA, 230 bp, Homo sapiens
aatactactactactaggtggaagtataataactagatagtgataatactacaagcaatgtacaaggtatagggagaaagatagagcacatatagggacaatgcagggaggtatagtagctagaggtaggcctgagcctagacgtagaaggtagaatatcagaccagtgagaaggcatactaaagccagaagcaaaccgaggtaaagccagcagagcaggtaacggcagg

SEQ ID NO: 503053 - DNA, 162 bp, Homo sapiens
  misc_feature (55)..(55): n is a, c, g, or t
tttctttagagatgtccgagatccttccagatgattcaaaattcatatgtaccgnctctactttgaagctctatgaatcagaacttgaaatggaacctcttctatttgagctcacaatgtctgtctgcagccaagctccatgactcgaggagttagcctaga

SEQ ID NO: 503054 - DNA, 115 bp, Homo sapiens
atttggataaggagcacacgtgcacacattcacaccaaacctccaattcaaattaaacaattaatataaatataatacaatattctttataacaaaatgaatatgaggatttacc

SEQ ID NO: 503055 - DNA, 290 bp, Homo sapiens
cgcaatgctggcatggatatctgctcgaaggtgctgatgacagcgcgtaccttgtcaggcgtatctgcgacaatcaaggttccatgtgtagtaaactgaaggaatgctgtgaaagacctctgttggattccactgcattgtcgaagtcgagtgcggatgcatgcacctatgctgaggcataggatgacttcctgggcatgtatttgtgtgaatatgcaagaaggcatcctgattactctgtcgagctgctgctgacacttgccatgacatatgctgcactctagagggtg

SEQ ID NO: 503056 - DNA, 207 bp, Homo sapiens
taaagtctctgtgcttataatttagtcttcaacatattgtttctattctagttgtcctgtcttcttcatccagaaagtatacaaattctaagagtctatcttcattttgtatatcagtgtctatatattcttacaaactaacaccatacttaccattttttaatagttcttcagtgtctgaagttggttcatgatatcactagtaga

SEQ ID NO: 503057 - DNA, 270 bp, Homo sapiens
aaaaagttggggggtttttttggggaatatgagagggatggccccccccaggggccaaaatgttataccagggggttttttttttaacataaaactttcagagggggctgttttattcaaagcctaggggggtttcccgccccagtccccctgtttgggctttcagctggctaggtccttttggggatcctttgggccttcagccccttttccaaggtttttctatgggggggtgtttaactcccattaaacatcccgccttggttccga

SEQ ID NO: 503058 - DNA, 1730 bp, Homo sapiens
gagatgtttctaacatttaaataagaaaaaaatcaaatcgaagtcagcctgctggaaaagtgatcacatggcagttgcagtaacttgtatggaaagagaaaatgcaatgagcccagttactgcacttgccactaccatgctgtccatggaaggaataatcagcagttcagttgtcacaagccgcccttgaagaaaacgcagcaaaatatcttcattttaaaatattttgctgcgttttcttcaagggcggcttgtgacaacgcagcaaaatattttaaaatgaagatattgcagtccccagagccagtgaaggtttcttttggtaaaatgaaattgtgccattgtcaaagtaccccgtagtgatgagcactgactggttcactggccacattttagttcttcataataataggccacaaaagggctctgtggtttgcctccatgtgcactggcccctccccacccctagggggcactcagtagctgctgagaaggcctgtccacgaggctgttggaacccctccaataaatacttagaggtagtgtatctgatgcttgttttcatggagaaaattgtattggagaacttaaaacatcacgaatatttttaataggatccgcagacacccaaaggagaagcttggtcttttccaggtatttccaacttgagttcaacccaaagcctttgaaaggaatgcattaccacatgaccacatgctgagaccccatggggtctaacacgggacctaagaaagtctctgcagccagatagtacatggtgtctccacaaaactaggcattctggagattgcccagaaagggatgtgaggggaccgttaagatctgtcttgcttatctcatgcactcacattccttcagcctcctggagttcctgataaaaggaagccagggtgttgacattttttagctattgatttcccaatagcttgtggatcagttgtacacccacacttccttctctgcctaattccgtttttctggaaaaagtagtatgcccatgtatgtgtgtttttcttaacacaggtccatgaaagtttggcttcctggtttgatgtctgttgcgtggcctggaaaccagggagcagcaactattgagatggtttctgtgttcagtgaaaaattctatttcattgagacaattttttctttatccacagtaattttttgacactgtcatcatgaaactacccttaggaaaataagattacctgcaaaaaaaaaaagaaatgagttatggaataggaacagttatgtgatgattctgaaactttaacttagagcttcattactttaagaatggaaaacaacctctgagtttgatttcccaaagtttcataaagcccctaagctcatgattttcatcaactctttgcccacatagtcatttacctccacagccgtttgttgtcatagaaggggtggtggtgtttggatttgatttttttcaacttgcagtgagaaataggataggtgacaaaaccttacttgttttcttaagacaattcagtgcttgagcatctctgtcagaaatggaatgaaatactgttagccaattagaattattttatgtattgttattgtgttttgctgatttttatatgaaaatataattattcattcttgatctctggaagcaatcattattatgaggatcattttactttggaaacactttcataataaagataagtattaagaaaaaaaaaaaa

SEQ ID NO: 503059 - DNA, 142 bp, Homo sapiens
gcctgaggaccgcaactgggtcgagtcctgaagactcaagatgtaataactaaaagtgaggtctggtacctttacatgattccccggactcaaatgggctaacacgcttctcttctccagcagtcttcctgtccgtgaagtt

SEQ ID NO: 503060 - DNA, 1821 bp, Homo sapiens
gagatgtttctaacatttaaataagaaaaaaatcaaatcgaagtcagcctgctggaaaagtgatcacatggcagttgcagtaacttgtatggaaagagaaaatgcaatgagcccagttactgcacttgccactaccatgctgtccatggaaggaataatcagcagttcagttgtcacaagccgcccttgaagaaaacgcagcaaaatatcttcattttaaaatattttgctgcgttttcttcaagggcggcttgtgacaacgcagcaaaatattttaaaatgaagatattgcagtccccagagccagtgaaggtttcttttggtaaaatgaaattgtgccattgtcaaagtaccccgtagtgatgagcactgactggttcactggccacattttagttcttcataataataggccacaaaagggctctgtggtttgcctccatgtgcactggcccctccccacccctagggggcactcagtagctgctgagaaggcctgtccacgaggctgttggaacccctccaataaatacttagaggtagtgtatctgatgcttgttttcatggagaaaattgtattggagaacttaaaacatcacgaatatttttaataggatccgcagacacccaaaggagaagcttggtcttttccaggtatttccaacttgagttcaacccaaagcctttgaaaggaatgcattaccacatgaccacatgctgagaccccatggggtctaacacgggacctaagaaagtctctgcagccagatagtacatggtgtctccacaaaactaggcattctggagattgcccagaaagggatgtgaggggaccgttaagatctgtcttgcttatctcatgcactcacattccttcagcctcctggagttcctgataaaaggaagccagggtgttgacattttttagctattgatttcccaatagcttgtggatcagttgtacacccacacttccttctctgcctaattccgtttttctggaaaaagtagtatgcccatgtatgtgtgtttttcttaacacaggtccatgaaagtttggcttcctggtttgatgtctgttgcgtggcctggaaaccagggagcagcaactattgagatggtttctgtgttcagtgaaaaattctatttcattgagacaattttttctttatccacagtaattttttgacactgtcatcatgaaactacccttaggaaaataagattacctgcaaaaaaaaaaagaaatgagttatggaataggaacagttatgtgatgattctgaaactttaacttagagcttcattactttaagaatggaaaacaacctctgagtttgatttcccaaagtttcataaagcccctaagctcatgattttcatcaactctttgcccacatagtcatttacctccacagccgtttgttgtcatagaaggggtggtggtgtttggatttgatttttttcaacttgcagtgagaaataggataggtgacaaaaccttacttgttttgttaccattctgatgttggagcggccgccaacttttttttttttcaacttgcagtgagaaataggataggtgacaaacccttacttgttttcttaagacaattcagtgcttgagcatctctgtcagaaatggaatgaaatactgttagccaattagaattattttatgtattgttattgtgttttgctgatttttatatgaaaatataattattcattcttgatctctggaagcaatcattattatgaggatcattttactttggaaacactttcataataaagataagtattaagaaaaaaaaaaaa

SEQ ID NO: 503061 - DNA, 226 bp, Homo sapiens
tgccaccccggccaccctggccctggcccccatcctcttgaccaccctttggggtctcctctaaagcccccgaggcagacccacgcaagaacaaagctctcgagacacaatgttacaccgtgggactcagctgaccctgcctcaccctccacactccttgcgacctcatgagccatgcgcagggtggttgttctgttcaaataaagggacgtgttttccacactga

SEQ ID NO: 503062 - DNA, 746 bp, Homo sapiens
  misc_feature (35)..(35): n is a, c, g, or t
  misc_feature (95)..(95): n is a, c, g, or t
  misc_feature (183)..(183): n is a, c, g, or t
  misc_feature (200)..(200): n is a, c, g, or t
  misc_feature (325)..(325): n is a, c, g, or t
  misc_feature (365)..(365): n is a, c, g, or t
  misc_feature (381)..(381): n is a, c, g, or t
  misc_feature (429)..(429): n is a, c, g, or t
  misc_feature (437)..(437): n is a, c, g, or t
  misc_feature (483)..(483): n is a, c, g, or t
  misc_feature (658)..(658): n is a, c, g, or t
agtgcatctcatccctccctctcttcctctcttgnaattaggattgaaagttctggtgaagaacctgggcttcacaagaagcagtctgtctgagnagggccaatacacccggttggctttggtgccatgcttagagttagcatccaaggtgttaacagagctcttgtaggccgtggggcccgnaacggggaagggccggnccacccacacccctgggctcgttagacctgtcttcttcatctgacatcagttcctctgtcacatcattccacagacgttggtcctcaggtccaaaatgcctcatgatactggatcggttgcaaanaagcggatatcggcgacttcggagtttcttctcctctttntcctcaggccctttangggggttcaggagctccttatcagtgtaattgtggggactggtcacangctctgcnttgagcttttccagaagaaacttcactactgaaatatcccaagagnacttgatgctttcagacccatgaatctcttgtcattggtgatgtggttatgcacattgtggaccagtttagagagtacaagatcccgcttgcgcctggagttcatctgcccacttcctctggtcctgcatggggaaacggtcagccctagagagtgtctcagctcccagtgctcnccagggcctgactcttccaaggcactgtccagcgcagcagcggcattgagcatgtcctcagggcggggtggtggcagcttggttccat

SEQ ID NO: 503063 - DNA, 707 bp, Homo sapiens
ggctaaaagtaagggtgtcgtgctgatggccctgtgcgcactgaaccgcgctctgcgctctctgaacctggctgcccccgagcgtcggaccgccccatgcacaccgagtcgtgttccccgcacgcccagatgatgaacaatggactccatccaagcagaccatcatgacattgatgttgcatcaccctgacgcacagatatctatacttcatgtggagcacttaatgcacaactattgtgtacctggaagagtacagtaaccaagtacaaacattacaccagattcaagatgagtgaagctctgggagtgccgagcaacacacagtgccgaatcccgggatgccatggtattggccaggggagcacacaaaagaaaaacggatactcagaagtgaactcagaacttatcagtggcgactaacacaagaacatgagaggagaagccaaaagatcagggaaaccacactttgaacggacgcaaagggaataatccaaaggatacagaaatcattggaagtaacccgtcgataacgggctaaacagaccacgaaccattaagacatcatggggttcaggccatgagagaagggcaaagacagggagacaagggactgcggaagataaatcaggcacaacaaaggcacaaaccacatggatcaggggcaggggagaattaccacaaccgtactgaaaccgcataaaacgaa

SEQ ID NO: 503064 - DNA, 388 bp, Homo sapiens
  misc_feature (240)..(240): n is a, c, g, or t
  misc_feature (358)..(358): n is a, c, g, or t
tgagacagggtctcactcctgttgcccagactggagtgtaatgatgtgatctcagctcactacaacctccgcctctgggctcaattgattctcctgcttcagcgttcccagtagctgggactataggcccatgccactatgcccagctaattttcgtatttttagtagagacaggttttgccatgttgcccaggctggtcccgaactcctgagctcaagtgatctgccgtcttcggcctncccaaagtgctttggattacaggcttgagccaccgcacctgggcctatgctgtttattaaattaagctacaagaattcaggcaaggaaatcactctaaaatctgtatataaaattgtncattaggcaatttgggattttcagtcttaa

SEQ ID NO: 503065 - DNA, 273 bp, Homo sapiens
atagtacttgccggagtacgtcttgaaaactacgcgggtgataggtgtaatacgcctcacacgcattctcaaacccccggacaaaacacatgggctagcccgtatcctgtgtacgatccctatgaggcataatgattagacaagctccatctgcctacgacgaacagacctaagaatcgctcatggcatactcttcagatcagccacatagccctcgtagtaacagccatgctcatccaaaccccctgaggcttcatcggtgcagtcatgctc

SEQ ID NO: 503066 - DNA, 600 bp, Homo sapiens
ctgctccagagtcagatctttcctcctgagttgttcctacctcctacctcaaaggcaaagattgaggtgatgtttcataagccaaggaatgccaagggattgccggcaaaccaccggaagctaggcgagaggactagaacagattttcccacagccctcagaataaaccaatcccctgaccaaaaaaaaaaaaaaaataaaaacacaaaaaaaaaaaaaacaacgaaaagaaaacaaccaaaaaaaaggaaaaagcaaaaagaaaagacagaaaaaaacaacaagaaaaacaaaaagagagagagacatacgaaacacgagggggcgcgcacagcctcagataccgcgaaggcccctgaccaaaccgctctggctatcagtatggtggtgaggagactgcgacgcgaagtcgctgcgaaagtggggagatgagtagagaattaaagcaagcagagcagcgagggtggactaggagactatcaactaactcggacatagtgaagagcctggggaaactcgagcctagtgtcgcactcgtgggtagaggagacacacacactagctcgggagggtggcgagtcgtgggagcggccagcgggt

SEQ ID NO: 503067 - DNA, 240 bp, Homo sapiens
actgccaacactcagttttcagccattctgatgggaatctagtggtatctcattgtggttttattttcatttccccgggtgactaatgctggtaagcatcttttaaggtactttttggccagttgtatattttctgtgaagtggctgtcaaatcttttgcccacttttaattggattgtttgtcttattgagttgtaaaagttctttatatatactgtattaaagtcctttgtaagacac

SEQ ID NO: 503068 - DNA, 105 bp, Homo sapiens
ccttttatgttttgccccgtttgggttaaaaaggggttttttttttcccctttggaactcttgggttgttaataaaatgaaatgattcctttttaattaaaatga

SEQ ID NO: 503069 - DNA, 837 bp, Homo sapiens
  misc_feature (21)..(21): n is a, c, g, or t
  misc_feature (116)..(116): n is a, c, g, or t
  misc_feature (125)..(125): n is a, c, g, or t
  misc_feature (176)..(176): n is a, c, g, or t
  misc_feature (182)..(182): n is a, c, g, or t
  misc_feature (187)..(187): n is a, c, g, or t
  misc_feature (190)..(190): n is a, c, g, or t
  misc_feature (193)..(193): n is a, c, g, or t
  misc_feature (208)..(208): n is a, c, g, or t
  misc_feature (211)..(211): n is a, c, g, or t
  misc_feature (217)..(217): n is a, c, g, or t
  misc_feature (222)..(222): n is a, c, g, or t
  misc_feature (230)..(230): n is a, c, g, or t
  misc_feature (232)..(232): n is a, c, g, or t
  misc_feature (238)..(238): n is a, c, g, or t
  misc_feature (242)..(243): n is a, c, g, or t
  misc_feature (261)..(261): n is a, c, g, or t
  misc_feature (268)..(268): n is a, c, g, or t
  misc_feature (289)..(291): n is a, c, g, or t
  misc_feature (316)..(316): n is a, c, g, or t
  misc_feature (325)..(325): n is a, c, g, or t
  misc_feature (335)..(335): n is a, c, g, or t
  misc_feature (341)..(344): n is a, c, g, or t
  misc_feature (374)..(374): n is a, c, g, or t
  misc_feature (381)..(381): n is a, c, g, or t
  misc_feature (390)..(391): n is a, c, g, or t
  misc_feature (435)..(436): n is a, c, g, or t
  misc_feature (446)..(449): n is a, c, g, or t
  misc_feature (806)..(806): n is a, c, g, or t
gccagggtcgcggcagctgcngggagagatgactggggagcgacccagcacggcgctcccggacagacgctgggggccgcggattctgggcttctggggaggctgtagggtttggntgtttgccncgatcttcctgctgctgtctctggcagcctcctggtccaaggctgagaacnacttcngtctngtncanccgctggtgaccatngancaactnctgtnggtgaccngnacacanatcnnctcactcgacaccttccncatcccnctcatcacacccactcccccnnncactcttctcccctttcctcacccnaggaaaatntcctcatccnatgacnnnnccaacttcatccccctcccgacctccatgnaccaccncaccacatnntctcctacacccttcattgtcaatcatggggatgtcccccatcnnctcaaccttnnnncactactcacccatcttcacacaccactactatttcttttctactccctttttgctcacaaggccggctcgccaggtggcctctaccatgttggtatggagcaaggatgatggtgtttcctggagcacaccccggaatctctccctggatattggcactgaagtgtttgcccctggaccgggctctggtattcagaaacagcgggagccacggaagggccgcctcatcgtgtgtggccatgggacgctggagcgggacggagtcttctgtctcctcagcgatgatcatggtgcctcctggcgctacggaagtggggtcagcggcatcccctacggtcagcccaagcaggaaaatganttcaatcctgatgaatgccagccctatgagc

SEQ ID NO: 503070 - DNA, 210 bp, Homo sapiens
ggtgggtttggagtgggcgtcctgcctcagcctcttcagtgagccatggtgctttgagtgctttgaaaagtgggggctgtgatgacttaagagcttcctgtcagtgggctccttgtagtgttgtggtacttgagtgcctagaatatcccaatgggctttgtttttaccttttgttataaattagtaccacttgctcctttagccatgagg

SEQ ID NO: 503071 - DNA, 937 bp, Homo sapiens
atagggcccgtgctctgttgcccaggccgggattgcaaggatgtgttaattctcagcctcactgtgcatttcctgtgacctctccgtgtgtgctcaagcgattccttcccaccttcagcctctcccaagtctcagcgtgggactacaaaagcacgccaccatgtgcccgtgcataatttttctcatattttttgtgtggatagaagaagtggggtttgtggccgagtgttggcccaaaggggtgggctctccaagtgtgaatcctctccgcgccttcaaccctccccaaaaggtgcgtggcgacatccacgagggtgtgtgacacccaacgagcccacctcggctcgtggtcctttctccttttttctaataacaccttccccctgtgggggaacacacctactttattttcccccttataaagagtgggggcccaacaagagttttatatcctcgcgcggagattatagagaaaaacaaatctcccccttccccctatattcgcgtgaacaacccagagagagtgagagcgcacggaaaaaattatccctaaagagacgcccccacaacatctgtgtggccccggggggggccacagttattcgtccgcctaaaaaacacccacaagaagacatctcaaaggaggggttctctccctctcccccttcaaacgctttctctttttgtggcagcacctgttgtgtgggtggtttgtgggggggcactattacccaaaagtgttcaaaaagggcacactatgcggacagctaagtttccacaccattaaccaaaacatcgcgactcttggccagggcgtgaaccacacttccccctcgttcattacaacaacaactctaacacttttatccatcaattcggcctctataacccccacagaggggaaatctcccctttcaatgcgcgaatcagcatttca

SEQ ID NO: 503072 - DNA, 156 bp, Homo sapiens
tttttttgtagacaccttaagaaaatgaaggcaagccatagattgggagtaaatattcacaaagtatctctgttaaggctcagactatttaataatttcattactctatataagacaactcgtctaaagcgaggacatacagagctgtagcagtcc

SEQ ID NO: 503073 - DNA, 264 bp, Homo sapiens
tcctactggtgcagtctaaactaactctatgcctattaacaaagcatcaacatatatatctgctaccaaggagttacaaaatagagctttctgacaaggatggtgctttcgaggttatactattttctttttacacggtacgggtcctgataaaggacctcttccttaaattctaaaattttacccaggcaaagaaagcacagagttaaaccttacaattctcggttctgcctaaacgtttgtcccggggtatttatccgggga

SEQ ID NO: 503074 - DNA, 904 bp, Homo sapiens
tggtgaaaccctgtctctactaaatatacaaaaattagctgggtgtggtggcgggcacctgtaatcccagctactcaggaggctgaggcaggagaatcgcttgaacctgggaggtggaggttgtggtgagccaatatcatgccactgcactccagcctggtgacagagtaagactccgtctcaaaaaaaaaaaaaggcttaataaatttattacttcccaattttttaaaatttggagtgccttggcagtggggatggtccctaaaatggcgtttagaattaagggcccagaattggtgtgtaaggtcctgaatctggctaaaatacagcgggcatgtctgtttggaattatgaggcataagtagccagtatctatagttagaatctacaggcctcctttttgcccctgttagactagattatacctgtatggcggccttggagtgttatctctcagtggctagaggtgctgttcaagcacaatttagcactacgggttgaaccactcttgtgtgcaaactcattggtgggcccatgtacatatccctaccttcagtccacagcaacatttaaggaatcctaacggacaggggattggcttttcagaagtaaaaggagggccaagggcatatgggaaacttttcacaactgctttcgggtcatttgggggtcctgcacccggttggcatcaatagggcctaatctgcacgaatttgcggggctctcacccaaaatttcttgggggaagacggtttccattaacaacagggagggggagtcccacccgacccggcggatatgaggtataagtacccccagagattattgttcggaggtgggccactacatgggagcggcttctcactattttgtggtctctctcgtgatctgctcagccctttgt

SEQ ID NO: 503075 - DNA, 366 bp, Homo sapiens
ccgatatggaacgaacatgggaaggacaaagatggagagaacagatgagcatgtgctagaagatactacgggagaggatctaggatgaaaaatttgatcttaagacaagcgcctaggtaagaaataattgggctaagatttctaaaccccactatgtgcttaagagtcatcctcgccattggggctgactctgtcatcctctccttcctcagcctctttttcatcatccttgatcagtccagctggtcatccccccgatcttcattatcatcatcatccagtaggtccccctcctcagcagagtcatctgcacccccctcagactccatcttcacattagtctcatctttcttcacggagctgctg

SEQ ID NO: 503076 - DNA, 405 bp, Homo sapiens
tcctttgtccgcgtgcttccaagctctcgcaagattacacggatttgcttggaaagacagtcatgcaaatcggaagcatgtgatagacgaaattcatatcgcttctgctccgtccgtctgtggaatggacgctttgagggcaggaacagtaggaacagagcgggctgggatgggatgggatgggacgggatgggatcggaagagaggctggggaatggggccacacgggggtgcagagtgtgctgtgacatagagcaagatcacaagaaggcctatctgtgactcctttaagataaggtgcagaagcggactgcaatgtcgctatctgctgcctatgtacatattcacaagaataagaagaattccaggtagttcccattatctcgtccgtgctgaggcatccac

SEQ ID NO: 503077 - DNA, 434 bp, Homo sapiens
  misc_feature (77)..(78): n is a, c, g, or t
ccagtgatttctgtcatgtataagtaggccttgccattgtcagcagtaaatgatctggaaagaccaacttctgttannatgtaatccacaatctagtgaggggattatagctatcaaacatatttctcagtccactttttaagaagtagtcatttaggctgggtgcagtggctcaggcctgtaattctagctctttgggaggctgaagctgtaggattgcttgaggtggagtgtgagacccacctgggcaacatagggagaccctacctctacaaaaaataaaaaagctggatgtggtagcacatgtctgtagtcccagctcttgggaggctgaggcagaaggattgcttgagcccgggagttcgaagttgcggtgagctattattacgtcattgtactccagcctgggtgacagagcaagaccctgtctcttt

SEQ ID NO: 503078 - DNA, 106 bp, Homo sapiens
cggtcctaaagcaagcccgactactgtgacttaaaaagagggaagaggagccagtgccgagggtggcactggtggctggaggtccccattcagttgcactacaggt

SEQ ID NO: 503079 - DNA, 252 bp, Homo sapiens
gccaggttcaaaggcatacttttgcaaaaagtctccttgaaaataaacatttaggacgggcgcagtcgttcatgcctgtaatcccagcactctgggaggccgacgcaggtggatcacttgaggtcaggagttcaagaacagactgtccaacatgctgaaaccctgtctctactaaaaacacaaaaggtggtgcatgcctgtaatcccagctactcgggaggccaaggcaggagaatcacttgaacccgggag

SEQ ID NO: 503080 - DNA, 607 bp, Homo sapiens
gctgattttattagggttctctagaaggacagaactaataagatatacgtatatataaaggggaatttattaaggagtattgactcacacgatcacaaggtgaagtctcacaataggccatctgtaagatgaggaacaaggaagccagccggagtcccaaaacctcataagtagggaagccaacagtgcagccttcagtctgtggttgaaggtctgagagcccctggcgccctactggtataagtccaagagtccaaaagctgaagaacttggagtctaatgttcaagggcaggaagaatccagcacgagagaaagatgaaggccggaagactcaggccagtctagcccttcatgattcctctgccagcttttattctagccacgctggcagcagattagatgggtccacccggattgtgggtgggtctgcttctcccagtccactgactcaaatgttaatctcctttggcaacatcctcacagacatacccaggaacaatactttgcgtccttcaatccaatcaaattgacacccaatattaaccatcatactgatgatattatatgataatattctgtaaactataagatgctgttgaaaatgca

SEQ ID NO: 503081 - DNA, 221 bp, Homo sapiens
ccccccccccccccttttttgggggaggtggtttttcctggggcccccccccctgtttttggggggggggttttttttttttcaaaaaaaacccaactgtcccccataaggttgtaaagccctccccccaacctttgatgtttcttagaggcattcaggttctttaaaatctgtacagcaaaaacaacttattcaggcaaataaaaatgcaaaaaacaaaa

SEQ ID NO: 503082 - DNA, 101 bp, Homo sapiens
ctgctctagacgatccccctatgcgtgtctcatatttgggcttaaaatatcaagaagggcacttcaaatggctttgcatttgcatgtatcagtgctagagc

SEQ ID NO: 503083 - DNA, 368 bp, Homo sapiens
  misc_feature (37)..(37): n is a, c, g, or t
  misc_feature (40)..(40): n is a, c, g, or t
ttaaatcctttccgtttgtatgacttcccaaacttgnctntgtactcctaatatggaaaaaggtcattgggacctagaaatgcagtttcatgggtgccaaaaaagaagataggatacttgtttgctggaggcttcacagcgccctctgggagttcatcaatccgggccggccagtgcgggtagcccttcatcttggcgaagaccaggtcgcccgctttgtactcgcggggccgcggacgcgccatcccagccgctccccttcctggtagtccttggtcgccgcgaagatgccgggaggccgcccccccgcgggccgacgaattgcgccgcgctccccgcgggcctcaagccgggcggacgagcggccg

SEQ ID NO: 503084 - DNA, 482 bp, Homo sapiens
aacaaatgcctgactccactgcctttcagttacgcccttttataccttatatcctttctctttctctttcctctagtttcactctcttcaaattgtttttaaggtaactagaatatgtggtagcatattcttcagtgacctgtccgttggtgaactgtcagttatcaggctgtttcttcacattttggttgaggaaaaagcagattgagtgttggagggcttactttaatacatggttcatgctctactggagagctgacatctgttcccctttgctctagaaaaagaaattaggtagcaaatgtgtgttttataatttctgctgaagactttagcgtgttttctttaaattttctgtagtaagactcatgtagataaaaatgagtgttgtagaaaaaaaggaaatagttcatgaaggcaaagaatcaaaaattttttcattcttttaaaaatgctgattatattaggtcttgaaaaaaaaa

SEQ ID NO: 503085 - DNA, 495 bp, Homo sapiens
  misc_feature (187)..(187): n is a, c, g, or t
  misc_feature (249)..(249): n is a, c, g, or t
  misc_feature (257)..(257): n is a, c, g, or t
agcgggcccaccgcccgcccgccagccgagaagccgggctggtcgcgctcggtttctccgcgaaagccggccgtgtacctaggaattaaccggcccgcgcgggagggaaggggaggggagcgggaagcgggaagcggggcgggggggggatgctgagcgcgcgcgagaacaataataagatcgtgtngcggtcgctgcccgagaaggaattcggagcagacgcgaggcccggcgctcgcgccgcgcccnggagcccnggagggagaccggcagcggcggcatgaggcaggcgacgcggcgctggtgagcagcgcgcgcggcggcggcggcggcggcggcggcggggaccttggcgcggccggacgcgggcgagcgccgaacggccgggggctcccctcccccgctgccgggccgtgatttgccgggcctgctgcgccccccgcccaccccttgcctcagccgccgcctcgccgcttcccctcgtcggagcggccg

SEQ ID NO: 503086 - DNA, 408 bp, Homo sapiens
  misc_feature (37)..(37): n is a, c, g, or t
  misc_feature (40)..(40): n is a, c, g, or t
ttaaatcctttccgtttgtatgacttcccaaacttgnctntgtactcctaatatggaaaaaggtcattgggacctagaaatgcagtttcatgggtgccaaaaaagaagataggatacttgtttgctggaggcttcacagcgccctctgggagttcatcaatccgggccggccagtgcgggtagcccttcatcttggcgaagaccaggtcgcccgctttgtactcgcggggccgcggacgcgccatcccagccgctccccttcctggtagtccttggtcgccgcgaagatgccgggaggccgcccccccgccccccgctgccgggccgtgatttgccgggcctgctgcgccccccgcccaccccttgcctcagccgccgcctcgccgcttcccctcgtcggagcggccg

SEQ ID NO: 503087 - DNA, 365 bp, Homo sapiens
accccttaggtagatttgtgtatctaaacagatatagtaatagaaaaagtatagtaaaagaaatctaaaagattaaaaatggaagccgggggcagtagctcacacctgtaatcccagcattttgggaggccaaggcgggtggatcacaaggtcaggagatcgagactatcctggccaacacagtgaaaccccatctctactaaagatacaaaaattggccggacgtggtggtgcgcgcctgtgatcccagctgctccagaggctgaggcgggagaattgttggatcccgggaggaagaggtttcattgagctgagatctcattactgtacactccagcctgggtgacagagcgagactccatctc

SEQ ID NO: 503088 - DNA, 1005 bp, Homo sapiens
gataaaaaatttggtcatttggtactgactttctctctctctctctctctctttttttttttggacagagttctcgcacgtgtgtgccgtgggcttggaatgcaggtggtgcgactctcggcttcactgtgcaacctccgcctcccgggttcaagtgattctccgtgccttcagcctcccaagttaggtgggattacaggcgcccgccaccacgcccagctaatttgggtgatttctaagtcagacgatgggggtttcactatgtgggccaggctgggtctcgaactcctgacctcgtgatgggcccacctcaggctcccaaagtggctgggtataacagatgtgagccaccggacccagcctgagttctcgtttctctcttttaaactttatttttggaaaaaccgggtagacttgggggggagcatttcggtggataatttaccggatctaaagctgagtgattttttaaaagaattggaattgggcttcctcaccagtaatatgtctcctggcttcttggaggtgatagtttcggaaatgggtggaaaatctaatagatctggggtgaattggcggtgtcgttatgaagtccaccctggtgggcaccaataacataacctgtgtggtaggacgttgttggagctattcgggagattatggggggagagtatactaaaaggcttaaaaaccatgtttgtggcgctgtttgaaccagtaagccacttttttggactttggaagacttcggaaggaatattagaggcttgataaaatttgtgggtggaagtttcctcccaattctttttactacgattgggccatgttctacatggacccactgggcaaggggtaagcagtgtatgggcttgggtggaaaaatatgcgattgttaaggaaacaattgtgaaaaatttggacgcgtgtggcatgtcaggggagacccagatatttgaggagtatgtgacatttgtacaaggaaggcgtaaaaggagggtcatagga

SEQ ID NO: 503089 - DNA, 105 bp, Homo sapiens
cagagagtcccagtgcgagaggtaagtagtatagtgatgcgagcagctaggactgggagagatagcagaagtaggatcgctgtgattaggacggatcagacgaag

SEQ ID NO: 503090 - DNA, 868 bp, Homo sapiens
tggtctctccgcagctcgctgggtcacatggccctgcctgagacaatggtggatgccctgcgcctgagctgcgaggcgtggaggaggtgaggctccgtgcgcacacccaaacctgctgctgctgccctgcatccttcctgggcccctggagatggctgcctccacctgggatgagctagccagcctgggcaataccagaggctggccctcgtgctgctgcgcagtgtgacctgagctggtctgccccaacctgggttttgatttctgatgactctgtgcctgagttccagtgatggttttttctatgggaccagacatgaacaaaagttggacctcatgagcacttcaacctctccagctgccatgctcctcctggagtgctgctggcgactgtcctgggggcagcactgctagtccagctcttcatcctaacagtgcgtgactgttttggcctgctggcaccccctggactgtcacgcgacttctacactcttacttctatctgcgccattggcatcttgaaccaaatgagccaagagtaccttgcagacaaagcttgacaagaggggtagagagctgacctaccactattttgaggaggccttccctctgccaatgtctccaggtgccgtttgtcttgggacgccaacccactagggccttgggttggtgctcaccagtcagtcacgtggggagcgggcagctgggtatcagtaaagtcttcgagggttgtgcccaggaacagcgggtactacaggaatgtgccccatgttcgatgggagcaatctattagtgggacagatgagcgatatagtacgatctagtgcaagtagccagcgattccatggccgacacagggaggagagac

SEQ ID NO: 503091 - DNA, 788 bp, Homo sapiens
  misc_feature (8)..(8): n is a, c, g, or t
  misc_feature (114)..(116): n is a, c, g, or t
  misc_feature (128)..(130): n is a, c, g, or t
  misc_feature (133)..(136): n is a, c, g, or t
  misc_feature (142)..(145): n is a, c, g, or t
  misc_feature (160)..(160): n is a, c, g, or t
  misc_feature (196)..(196): n is a, c, g, or t
  misc_feature (202)..(202): n is a, c, g, or t
  misc_feature (205)..(205): n is a, c, g, or t
  misc_feature (218)..(218): n is a, c, g, or t
  misc_feature (231)..(231): n is a, c, g, or t
  misc_feature (235)..(235): n is a, c, g, or t
  misc_feature (238)..(238): n is a, c, g, or t
  misc_feature (255)..(255): n is a, c, g, or t
  misc_feature (269)..(269): n is a, c, g, or t
  misc_feature (272)..(272): n is a, c, g, or t
  misc_feature (274)..(274): n is a, c, g, or t
  misc_feature (284)..(284): n is a, c, g, or t
  misc_feature (286)..(287): n is a, c, g, or t
  misc_feature (293)..(293): n is a, c, g, or t
  misc_feature (297)..(297): n is a, c, g, or t
  misc_feature (301)..(301): n is a, c, g, or t
  misc_feature (325)..(326): n is a, c, g, or t
  misc_feature (328)..(329): n is a, c, g, or t
  misc_feature (344)..(344): n is a, c, g, or t
  misc_feature (349)..(349): n is a, c, g, or t
  misc_feature (356)..(356): n is a, c, g, or t
  misc_feature (365)..(365): n is a, c, g, or t
  misc_feature (379)..(379): n is a, c, g, or t
  misc_feature (401)..(401): n is a, c, g, or t
  misc_feature (411)..(411): n is a, c, g, or t
  misc_feature (426)..(426): n is a, c, g, or t
  misc_feature (437)..(437): n is a, c, g, or t
  misc_feature (446)..(448): n is a, c, g, or t
  misc_feature (541)..(542): n is a, c, g, or t
  misc_feature (547)..(547): n is a, c, g, or t
  misc_feature (558)..(558): n is a, c, g, or t
  misc_feature (575)..(575): n is a, c, g, or t
  misc_feature (629)..(629): n is a, c, g, or t
  misc_feature (784)..(784): n is a, c, g, or t
ggattttnttcagtgcatttcacagcaaaaatgaacaagggaatcattaaaattgttgtacacaaaccaactctttttcttataatttacaatttgttgaaaaaattattgttnnnctgttttcatcnnnctnnnntctttnnnngaacacaatttatcngagcacaaagcttaaacttcttatgatgatgcaacncatctncanccacctacaatgnctgacaaacaacncgcntgncacacacactgactggnagaccatatcaganaananagagtaaggnannagtctngggnaatnggggggggttggggtggggggggnngnnggcgcatggtgggtnggtgntcattanatacatgantgattgatgaaagntataatttgttctattcttttntttgccagcnatttttcaacctcancttaatttttntttaggggnnnttttgtacctgaatacaacttcctgatctttttttcctgataccttttcatttcgttgtttctttagcatttaaatttcctcaaaaaaaaagnnttttnttttttccttnccttacatgcgcgttcngttacacatataagttttgggttactgacaaatatgaatagaatcatttatttnaatttttaacagaggtaaaataaagcatacttatccaaagggataacacataatactggatattacctaaaggtgaaaagaaagaaggaaaaaagtaacagttttattttttaatatttgctattttctttaatgccttagttctggagaaaggntaaa

SEQ ID NO: 503092 - DNA, 485 bp, Homo sapiens
gatgagggatgctcaacctggtgaatgggagtgagggagaatctgtttctgtgtgtgctggacctgaagcttcctgtgagtctcacagctgtgggcacccatcttcccttgccctgcgcagcctatttctttcatttctacgagattctaactctcctattttcttttttctgtttactgacactcctccaaagagtaccagtcttctctttgtatctgattcttctcaagaaatatcgcttatctcaggctgccacttccagtctcactcttttcagatcctttcttatagattataaatgaccaaatccaaacatatattctgcattagggcatttagttaaacttttctctagggttattttagctgtgtttctttatgttttccaccctactttacatttttcccctataatttcttaaacatcttcacctctctcctgtgtcttaggtatgtagcagcaggtgtagtattatttccttag

SEQ ID NO: 503093 - DNA, 524 bp, Homo sapiens
acgcccaccacactgaatccccctcctcacagttgccattgcactccagcccaggtgacagagggagactccatctcaaagtgggcgttataataagtgtttacttggtcctaggcattgttctaagtgctaagcttgaatcctctttagtaagtttatgaggtaggtaggcattactgttatcctcattttacagatgagagaactgaagcacagaggaacttgtccaaggtgactcaactagcagtgcttaccaggcagtctagttccactgccaaagaggtagagggagaagactaggaagagtggcagtaaggaagagaaaagggcatttcaagaaggagattagtcattaatgtattgggtgggtgcaaaagtaatggtggttttggccattaaaagtaatgggaattactttggcaccaacctaataaaatgctgctgaaaggtccagtaagataaaggactgaaaagcatccattggttttcacaatatggagatcattgacaactttgaccttcag

SEQ ID NO: 503094 - DNA, 102 bp, Homo sapiens
gtcccaatcatccaacagggcacatgcatcagccattgcacaggcatctgtgggcatttggtcactgcaagctctgcacattctgtcaatccataggtccat

SEQ ID NO: 503095 - DNA, 309 bp, Homo sapiens
tccataatgtgtgccagccgggcatggtggtgggctgctgtaatcccagttactcggaaggctgaggcaggagaatcgcttgaactcggcaggcagagattgcagtgagctgaacaacagagccagactccgcctcaaaaaaaaaaaaaaaaaaagggaaagagtgggggggttttaagggtgtaaccggggaaggaggatctcatttgaacccagagagcgcagaggtgtgcagtggggatagaattcatgccatggcactcacagtgggttgacagagcagaggtcctgtctcaaaaaaaaacaaaa

SEQ ID NO: 503096 - DNA, 114 bp, Homo sapiens
gatgtgagggatgtagtatgtctagttatataccaatttgagcatgcaggactgagatcagagtgagggaggtagggatgggggagtaggggaaggtggagaagggaatgcttg

SEQ ID NO: 503097 - DNA, 679 bp, Homo sapiens
gctcacgcctgtaatcccagcactttgggaggccgagatgggtggatcacctgaggtcaggagtttgtgaccagcctgaccaacatagtgaaaccccatctctactaaaaatacaaaaattagccaggcgtggtggcgcacacctgtaatcccagctactcgggaggcggaggcaggagaatcacttgaacctgggaggcggaggttgcagtgagccgcgattgcaccaccacactccagcctgcgcgacagatcgagactctgtctcaaaaaaaaaaaaaaaattcatacttatgccatggcttttacctttagatacacacgttacaggtaattccacgtgggtgacagtggcttgtcaccggttaactaagggaagggactggcgggtaacttaccctgcaggggctgtaggtggcctggcagggcgctccagggcccccagccggttgatcccgatgtctaggtctcatcgtcctcgggtccctttgggccactcgtttaaagcgctggcccaatggggatcccctccattctagtggggcattggctggaactcatcctgcccctaggctgggcttctaaccaccggggggaaagctacttaagcctacgagggtccctccttgagaggctcagaacccccaaagctgctgctggcagtgattgagacggagca

SEQ ID NO: 503098 - DNA, 1178 bp, Homo sapiens
ggcggctcgggagagagtggacgcgggctgcaggcgcgatgcttgtgctagagtgacgcgtcctgacggcgtgccggacgctgaggtggtcgggggctagtcatgcccgtgcctggtgcatggatgcgcggggtggcatgagcctctggacgtttggggctgcgcccagtcctgagcccccgtgctgctgccgtgaagttgctgagctggctgatgctggctgatgctggctgagctggccctgctgtgatgacccatgtgagctagcctggcactgcctgcgcgatgcgccttctgactgccgtgcgggaatgacgctggctgtgtgtgccaagtggcacagatgcagtgctggacctgctgagtggtgcctgatcctggctgtgaagagcaagatgcccgaagggctgagggcgatggtgcgacgtgcaggcgtgcatgcctgcatgacacacaaactgcacaaacggaggccactgtgtgtgctgccaatgtttgccgaccatgagctgcacaccagttggccctggcattatctgtggtgcttgactctcttgtgaattgcttgggggtgcccaagagcttgcaacactgtgcgttgccgctttctatcaagaccaaagacgatgtttacttctagcattaccaattacacgttgcgtgcactccaatgggaggagaggcaccaacaggccccattgattggggatatcctttcgttggttgaaaccacaaagatctggcttggggacgccaaaattgacgccagttggtgagccagacgtggaagtcgaccaccctttgagcatggtttattggagaccggtttgttccgtgggggcggaacgacgcacggcggcccatcccggtcggccccagcatccggactagtagagcaaatgatgcagaagagcgcgatctaggcaagcacccaaggggcaacagaagcgcgatgacaggaggcaatcccccaggcgacagagccacacgagggacacacgcgcacaggaaggcacgcaccaaacgaaacaaggcgaagcgatgtacagaccgacgcggcacacgacatccataccggaaacacaagaagacgacagcccaaacgagaagatcgacacacaccacacacaggcaaacgaggactgcacacacgatcgccagacgaaaaagcgcgcgag

SEQ ID NO: 503099 - DNA, 108 bp, Homo sapiens
gagcacaatgtatgatatgagttggcaggtgtcatctacagcagcatcctcactcctctgttgccatttttagcaagtactcctgtcgatcttgaacagtctccaact

SEQ ID NO: 503100 - DNA, 230 bp, Homo sapiens
ggaagatttgaatattttctttgtaatactgaagtattggcctttaattctaaataaaaattgtatatgggcactgtcctattgctggggtgaaatgattcacgttatccttggtacttgcagaaacgttcttatgtttgaatcttgtgggacactcttactcttttaactacaaagatgagtatgaatcccctccattgctctcaaaagcaatgaagtgattacacccc

SEQ ID NO: 503101 - DNA, 534 bp, Homo sapiens
  misc_feature (122)..(122): n is a, c, g, or t
  misc_feature (244)..(244): n is a, c, g, or t
  misc_feature (256)..(256): n is a, c, g, or t
  misc_feature (468)..(468): n is a, c, g, or t
gaggatgtggagaaattagaaccctcgtgcattgctggtggaaatgtaacatgggtgtaaccactgtggaaaacaatttggtgattcatcacaaagttaaacagaattatcatgtgattcanttccacttatataccacaaatattcagaagtagggacttaaacagatatatgtataccagtgttcacagcagcatgattcaagatggccaaaaggttgaaataaccagtgtccattcataantgattgcatgancaaaatatggtatatatacacaacggaatattattcagccttaaaaaggaaaggaattctgacatatgctacaacatagattgaaccttgaggacattttgctaagtgaattaaccagacacaaaaggacaaatactgtttgattccactttatatgaggtacctagaacaggcaaatttacagagacagaagagaggttaggaaatataanagatttaacccgggcatgcccacggcctatggtcccagctacttcgggagggctgggggtgggagg

SEQ ID NO: 503102 - DNA, 723 bp, Homo sapiens
catagtccagcggctcggaggactgcacggtcatggtgtggcagatcccagagaagcgggctgacctccccgcctgacagagccggtggtggtactggaggggctcaccaagcgagtgggcatcatcgcctggtacaccctactgagaccccggaaacggtgcttgcatcagatgtcaggcctgtcggaacaaactgttggatactcgatcgtggaatgtggtgcacagacggagtgcagcttgtactcagtcctgtgacatgctctgcatcccatgtacctccatcgtacagattgtcagtcgtgtgatacccacaaattggtccatgctctgtttttgctcatgcagtgcaacggacaagagcgtgctgcatcatccgacgccccgtcggggacaccctggatgggcagacgcgggacgaaggtctcatgagagggtgcccggcccatgcgggccatcttcctggcagatggcaaggtgttcaccatcaggcttcagccgtaaatgagcgagtcggcagcatggcgctctggtgaccctatgaagaacctcgaggaagcccagtggccctgcatggaactggactcgagcaacggggccctgctgccccttctacgaacccgacaccagtgtggtctacgtctgcggcaagggtgactccagcatccggtactttgagatcacagaggagcctccctacatcacttcctgaactacgttcc

SEQ ID NO: 503103 - DNA, 425 bp, Homo sapiens
  misc_feature (49)..(49): n is a, c, g, or t
  misc_feature (94)..(94): n is a, c, g, or t
ggaactccctaatccctcagtctttcccctcaccccctggagcctcganccctcacggtacagggaacagtcaccgaccttctgtccctttgtngggctaactgccctcagcaggcagggtggctttgagcagtggaggttggggttcacgcctataatcccagcactttgcgaggctgagcaaggcaggagaatagcttgagctcaggagttcgagaccagcctggacatcatagtgagacccccccccgaccatctctacaaaaaaatttttttaaattagcagggtgtggtggtgcacgcctgtggtcccagctaatcaggaggctggggtaggagggtcacttgagcttgggaggtcaaagctgcagtgaaccatgattgcaccagtgcactgaagcctggggaacagagtgagaccctgt

SEQ ID NO: 503104 - DNA, 452 bp, Homo sapiens
  misc_feature (59)..(59): n is a, c, g, or t
aaatagagctgttagagctcgagacattggcactgcgagggcccctataaaagcacttnatagactgttatcgtttaatgtagaaagatttaggtatgcatatgtaccatgctgacgtcccccatcttaccttccaccgcgaaaattgaggccctctgatcccaggcaggcagtcggtccccttgaatcaccccaggatcttcccagacattcctaaacaggcagcaaagcagtgaatggcagtggcagcttcaggcaggacaggcagtaacagcgtgtgcttgtcacctgatctcagctgtttgttataaagtccgtcgttcagatttccagttttgccaactggttgactatttctatctctgtattataaatggaaaactgtacaatgagacttaattttccaacccatgtaaaagatcactgctggctcaggacagagcctgagaacc

SEQ ID NO: 503105 - DNA, 737 bp, Homo sapiens
ccagctgctcctcagacagtgcatggtgttcacgtgacgtcggccttctgctacatgctgagacgctagatgctcactgcgcgcgtcatcgatcgttctgtcgtccattctggcacggttgagtacgtcatttgacttgagctgagagactggatttacccatgactcctatacgaccagggtatatacccgtgaatccccattggtacgtcccacaagttacctcgtctcaggcctttcttctggtgatcatgttgcttaggtacagggaagtggctgtacgcttgggtctcaatatgacccatcttggggagtatctatattgggaggtatatgagtagaacaggtgatgattgggccaggattgtatgatcgtacaagtcatcatgaatgcaaggagtattctaggcatatttgtcaggagatcgaaggatggtgcaagactcagcttttgatcgttctatgcattttgtcatactaacgtatatggcactgatctatggtattggtgagctcttgagaagtatagacacacgaatgaatgggttcccagtaagcgtgcgtgcgaacaatgccaccaccatgacgggattcctatgcacctggggatcttgtccaagagtagcctgtgtgcatctgatcaagttacttaaaacaatgactcctaattttacatgtccaccatttacgactgagcgaagacgtctcatatgtgtccagacgcaaagatcaaggta

SEQ ID NO: 503106 - DNA, 280 bp, Homo sapiens
ggtgcaagcatctccttcttcatgtaacacagggtacaagattatttggctcgacttctagttcgtgtcctaactcttgcccctctgtccagtggagtgacccgttgccagagtgcagagaaatttattgtccagcaccaccacaaattgacaatggaataattcaaggggaacgtgaccattatggatatagaccgtctgtaacgtatgcatgttattacaggaattcaccatgaatggagagcactctatttattgtacagtgaataatgatgaacga

SEQ ID NO: 503107 - DNA, 1052 bp, Homo sapiens
ccagattaccaaagggggaattacaagcaaaccaccccaaccattgttgggttttcttttagtttgggagaatgagggagattcctgtgttgtgaaaattcatagtcctcaagccccaaagggcccgccttggttttagacttgggcccaaatcctcgctggcgcacccacatggtgtgttggcccgcgggggtcaccgttttgcccccctggtggcacaacagaggaaagttggtggccctgggtattacccccccgctcctcggcgtgctctgtgtgccaccccacggatgctgtgtggcgcccccccttcaacgaagtggtcaaatgctctctcttctggaggcaccgcactgtcgcccctgtcacgccacggttcgaggaccttgaggccacgatgtgaagtagaatgtcttggggcacacgaggatggccctcggggaggaaaaaggtggtttgcacgccccatgtcgtttgtaaaaggcgtcttcgtcgggcaacctgctggaacgccgccccacacctgaacacgccccacttctcttccagagagcttgttcttatatgtaactccactggcacaggtttctaagaagagcttaaaggggaaaaacctgcttttcacaaggccacccacacactggttctgtggctccccacacaccacgcttctattctgccctcttgtggttcactctttgtataattttggtgacacgctgagagctgcccacaggagccacacgtgaaaaacaacataatttctattatagagacccacaaggccctgggtgtcctaacccgctgttgggggcccactgttgggaaaccctcttgctaagggttgttcttgtgctcgtgtggtttgttttagtgttgcccccttattttgctttgcttacccacgttcttcccttaacttcttggaaggctttcttaaccctccacggcacaaccctgtgttccccctgtattcaggctctgctttaaagcaagccactgaggctgttggagtttctgtttagggcattataaaattccccgccaactta

SEQ ID NO: 503108 - DNA, 622 bp, Homo sapiens
ttcctcagaaatcgcggtcacacagtacaacatggatgagtcttgaggacattacactaagtgaaataagtctgtcacaaaaaacagacatggtatgattccacttacatgatgttatctaaagtagtcaaattggtagaaacagaaataatggtggttaccaggggctagtaggagggggaaaaggggagctgttgtccaacaggcatagagtttcagatacgcaagatgaaaaactcacagatctgttttccaacagtgcgaatgtacttaatgtcacagaacgcttaaaaatggctaagttagtgaatgttgtgggttttttttgtttttttttttctgagacagagtcttgccttgttgcccaggctggagtgcaatggtgcaatcttggctcattacaacctctgcctcccgggttcaagccattctcctgcctcagcctccctagtagctgagattataggcttgtgccaccacgtccggctaatttttggtatttttagtagagacaggttttcgccatgttagccaggatggtcttgatctcctgacctcaggtgatctgcccacctcggcctcccaaagtgctgggattacaggcatgagccactgtgcccgc

SEQ ID NO: 503109 - DNA, 996 bp, Homo sapiens
ccacaaggaccccaccggcctgcctggcgtgagcagagagatgccaggacaggccggtgtgtgtccttgtgtggacacggagtctccccttctcgctgggctcgctgggagactgtgctcgcgaggagggggggagccgttgcacgcgtggttgggagtgcgcgaggggctgctgggccatgatagcagcattgcagcagttgatgcaagccgttcgtgggagtgcgtaacgcgttctggagctgcggtacacgttggtcggtcgtcgaatgaccttcgcgtcaacgacgcttctcccgttgagtgactttgtgcgatgaagcaagcatcagagaggagtaagctcggatcaggcgccgtttggatttgccagcaggtgagtccattggccagccagggcgagatagatacgcggtagcagcaggtggcgattaccgtgggtttccaattggcgggagcacctagtcgtccatgcctcagggacacaatgtgcttcggttcggactaggcatgcaagcgagatcctttaattgtttgagcttgcgcacacacagcacagcgggagttggacttcggtgtccagccttttggcgaaaacgcatgcgaaaagggtttgcgcttccacctcgttccggggggaaagcccccaagtttttccatccgcaggagagaattggttttcggcgcaaaggcgtaaggctaacggggagagccgtttggttaccaaccgctagtatgggaaaatgcacgatcgaggtttgaagctagaacttagaaccgtgtatccggggttcgattccacagtggagtttaggaacgaagaatcgcagggacgctccgagactatcattaaggaaaggtaattcagccgcattccagatagggggagaggacccctagagaaggccattatagctgccggggataccccgcgcaagagcaattattatctcttcttggtaacagagaagagggtgtgggtttccccccctttag

SEQ ID NO: 503110 - DNA, 247 bp, Homo sapiens
ccaaaaaaggccttttgaaagaaaccaatcgattgtaaactgtctagttttattattattattttctgatggctacagaccatgtgggctctcacacctagactatcttttctggtggaagggcttgggcacagacagacagtcagggcttctggttttcctttttttttttcctttttccttttttttttttttgaggaaaaaagcttagagtttgattggtttgacctcaggggttcccgacctc

SEQ ID NO: 503111 - DNA, 653 bp, Homo sapiens
  misc_feature (11)..(11): n is a, c, g, or t
  misc_feature (96)..(96): n is a, c, g, or t
  misc_feature (100)..(100): n is a, c, g, or t
  misc_feature (102)..(102): n is a, c, g, or t
  misc_feature (234)..(234): n is a, c, g, or t
  misc_feature (236)..(236): n is a, c, g, or t
  misc_feature (240)..(240): n is a, c, g, or t
  misc_feature (245)..(245): n is a, c, g, or t
  misc_feature (257)..(257): n is a, c, g, or t
  misc_feature (261)..(261): n is a, c, g, or t
  misc_feature (268)..(268): n is a, c, g, or t
  misc_feature (273)..(273): n is a, c, g, or t
  misc_feature (275)..(275): n is a, c, g, or t
  misc_feature (306)..(307): n is a, c, g, or t
  misc_feature (319)..(319): n is a, c, g, or t
  misc_feature (345)..(345): n is a, c, g, or t
  misc_feature (364)..(364): n is a, c, g, or t
  misc_feature (386)..(386): n is a, c, g, or t
  misc_feature (404)..(406): n is a, c, g, or t
  misc_feature (451)..(451): n is a, c, g, or t
  misc_feature (453)..(453): n is a, c, g, or t
  misc_feature (508)..(508): n is a, c, g, or t
  misc_feature (510)..(510): n is a, c, g, or t
  misc_feature (530)..(530): n is a, c, g, or t
  misc_feature (532)..(532): n is a, c, g, or t
  misc_feature (534)..(534): n is a, c, g, or t
tgggaaaatgncccgctagtatgaaagaaaacattttctatatgaagacatttgttttatgttaggtagcttacattttcccccctgcgtgtgtgngaangngtgaaaaatcagaaatttagcatactatggaaagaaggcatggagcacttgggttaagaggaaccaaaaacaacatagcaacaaagacccagatgtaacaggtttgaaagagctcaacgccaagaacaagancnactngcaanccaggggagttntctnttgagtngtatntnccctgttcgcatgtccctgtcccttgtggannccacgcatggtngcacccccgcctgctgtgtttcccanacttaagaaaaacgaggtnccagttggctgatagaataccntttaggtaggacaaaacnnntctgtgaagagtgttgagggggtgaagataggtaagaggtaagcncnatttttaatttaggctctgaaaaagtgtattgttctaaacgtatttggtatgccnanataggtctttaaaaatgggnangnatgctgtttaatgggcccgtgacctttttccattaatattggactgttttacattaatactgcatgcttttctatgtgaattgaataaagaatgtcataagccctgtgaaaaaaaaaaa

SEQ ID NO: 503112 - DNA, 171 bp, Homo sapiens
  misc_feature (76)..(76): n is a, c, g, or t
gcaagtaggtctacaagacgctacttcccctatcatagaagagcttatcacctttcatgatcacggcctcataatnattttccttatctgcttcctagtcctgtatgcccttttcctaacactcacaacaaagacctacctactacctatcaatctcaagacgcgtcaagg

SEQ ID NO: 503113 - DNA, 879 bp, Homo sapiens
  misc_feature (34)..(34): n is a, c, g, or t
  misc_feature (119)..(119): n is a, c, g, or t
  misc_feature (121)..(121): n is a, c, g, or t
  misc_feature (196)..(196): n is a, c, g, or t
  misc_feature (246)..(246): n is a, c, g, or t
  misc_feature (253)..(255): n is a, c, g, or t
  misc_feature (261)..(263): n is a, c, g, or t
  misc_feature (271)..(271): n is a, c, g, or t
  misc_feature (275)..(275): n is a, c, g, or t
  misc_feature (278)..(278): n is a, c, g, or t
  misc_feature (282)..(283): n is a, c, g, or t
  misc_feature (292)..(292): n is a, c, g, or t
  misc_feature (294)..(294): n is a, c, g, or t
  misc_feature (296)..(296): n is a, c, g, or t
  misc_feature (298)..(298): n is a, c, g, or t
  misc_feature (300)..(300): n is a, c, g, or t
  misc_feature (302)..(303): n is a, c, g, or t
  misc_feature (315)..(315): n is a, c, g, or t
  misc_feature (346)..(347): n is a, c, g, or t
  misc_feature (363)..(363): n is a, c, g, or t
  misc_feature (391)..(391): n is a, c, g, or t
  misc_feature (398)..(398): n is a, c, g, or t
  misc_feature (518)..(518): n is a, c, g, or t
ttttttattcttttggtttcctttccactcattnaataaattattaacataattggttaactaattggttaacacaacccctcctcaattctggggataagattatgcctcatttcgangnaggggaaaggcttgacggtgaaattgaaatgcaaagaacagagttcaaggctcatggttaggttgttattcccanaaaaaaatacaaaccagcaatggtgctattctgagcccttatccacaggnggttagnnnccaaannngactctgncgcnagncaannaaaaaaaanananananannccagaccctganagaacttgtttggccaaatctattctatttnnaaagaagctgtaagancttttcttcttctgttccctcacaaacnaatctgngtatgacaacatctttctgctgccctactcggtaaattcggtcacaagcttgatcttcaagtgatggattccagtgcatgtccaaaagggagaggtgatttcctccagtcaggttttttncaacacctccggccaagagagagattagcattacctgagggcctctggagtggttaaatgcctctaccaagtccattctctgcttgggattgacagagccatcgatggtggcataagtcagtccatgcttcttcaggtgcaatgctacaactttcagcatgttggtccactgagagacaatgacactcttttgggatgctgaatttctttgaattgcctccaattctgccaacagagatgaaatcttggtgctctctcgcatgccttcaaaaagctccatcttgaagaaggtgccgttaagggaaacagtggaagatggctctgagtcacggagttctgacaaggtcaaagcactgagctg

SEQ ID NO: 503114 - DNA, 483 bp, Homo sapiens
  misc_feature (329)..(329): n is a, c, g, or t
ggagaggacaaggtgcccgtcttaggtaagcccagggttgccctctgggtcattttgtttccgccctcctttagagggttcaagccaacaaggcccccttggggtgttttataagtgatttttccccgggagccgggcaagtggctgggaaggaaaaaatcagccccgtcaaggggggggggggggccccccccccctccaaacaaagaaacaaaaggtagggggccagcagctttttgggcctcacgcctgagcagtggaggtcccccaaaagttacagttgccgggttacgcataaggggagccccgtggaaaaaacaggggccccnaaagaaggtttatgggttttaacccctcccccccccccggggagataaaaggggggggatcccagggggggggtttttcctccccccccaggggatcaagcccttttcccggccctcaataaacccccaaaaaaaattttctttgtcaatcaga

SEQ ID NO: 503115 - DNA, 293 bp, Homo sapiens
ttcctttttgaaccccgcttcccccccaggactctctctcccttaggggttatgggttattcaaggggggggctttttaaagacagccacgccatttttggaacttgggtaaatagccccctctttcagggggaacccctttttccctttgataaggccgggattccgggaggagggaaatagtttaggggattttttttttggtggggtttggtttttagaaggcaatatgtcgggttttttttattgcttgaaaaaggtcctttgaaaaaaataaatcccttttcccccca

SEQ ID NO: 503116 - DNA, 218 bp, Homo sapiens
ggcggaagatgttatatgggaggactcagcatccgagaatcaggaggggctcaggaagatcccatcctacttcctcaatgaagggtcccaagcccgtccccgtttttccccccgatatttcctggaacgcggcctggagtcagcaaccagcctttagcagctgcctttacgcgctttacctgcttccccaacccagacattaaaattgtttaaggaga

SEQ ID NO: 503117 - DNA, 413 bp, Homo sapiens
  misc_feature (87)..(87): n is a, c, g, or t
  misc_feature (386)..(386): n is a, c, g, or t
gaaggagggtacggcgcaggacagagaggagagggaaaacagaaaaagaattgtgtgccactatgtctgaatatatcttctacttgnagataattacatccaagttgcccttttgcctttttatttccgtttttggacacctctttttatcatccagccaactggaatagacaaagcaccgctggtgccctgagcgacagaactctggtagggggctggctgtaaattgacgtggcatggaaattctccgctaagttgtagcagcttgcatgtttctctaagatcaagcccagcctcctggagctgtagcttaatcatgggttcaatgactttacagaaaaatggatagaaaaattcttcaactcctttctttggacccagatggntttttttgggttttttttttttttttg

SEQ ID NO: 503118 - DNA, 106 bp, Homo sapiens
gcaggaaaacaattgggaacaataaattaggatttcatgtgggtatcatttggcataacacaatcaggctgttttttttttctttttcattataaatataaggaaa

SEQ ID NO: 503119 - DNA, 200 bp, Homo sapiens
  misc_feature (80)..(80): n is a, c, g, or t
  misc_feature (125)..(125): n is a, c, g, or t
  misc_feature (163)..(163): n is a, c, g, or t
tggcatgcgcctgtaatcccagctactcgggaggctgagacaggagaatcacttgaacccaggaggcggaggttgcagtnagcagatatcgcgccattgcactccagccttaagagatatctgtnctttacacacaagagatatctaggccacaagatatctntggccttaagagatatctgggccacaagagtgaaact

SEQ ID NO: 503120 - DNA, 475 bp, Homo sapiens
cttagaaaattaaacaggggccagaaggaaaagatacaacgtcaccgtccgagccaaagggaaaggctgggttgggggtctatgtgccggggcctcccctcataaaccaatgctttcaggtcgcagggatgggtcgcctgggtggtccgggggctctggcagcaggggaactgggccctgaagcagtccctcagctccctgttgaagaggaagcacacgacggggttgatgccggctgcgcgaaggtcagccacacggaggccgtcaggtaggcctgggggacgcgccgggccgcaccaggaccgcaggtagctgccacgacgtaggccccagaggagcggaagagaggtgcgcgtgaacattgcacagccttttccgttgaattttcagcacgaggacggggcgccgcgccgcggccggatgcccacaagcgggcggcgtggcccgcagaagcccgccgtccagttggcggcgc

SEQ ID NO: 503121 - DNA, 257 bp, Homo sapiens
gatataaggagtatagtagaaccaatggatggttatagttgagaccctctgcattgtatgttacctatttcaagatttaagagtcattgctgggcacggtggctcacacctctaatcccagcactttgggaggccgaggtgggcggatcatttgaggccaggagttcgagaccagcctggccaacatggtgaaaccctgtctctactaaaaatacaaacaattagctgggctgatagcaggtacctgtaatcccagc

SEQ ID NO: 503122 - DNA, 538 bp, Homo sapiens
  misc_feature (1)..(1): n is a, c, g, or t
ngggcccatggttacttccaggcggcaaaggacagtatgttcccccggtttttttgggggttctttcaaccagtcgctttttccaagcctgtaatacctataagggtccaatgcccgccaccctagctccagggctttttagtagaagggctaaaaggaagcactttttcccccattcctggaaattgacacaaattaaatttgaacggctggaaatccaacccatgttaaatcttaagtccaagggggaaaaaataaatccgttattgaaacataaaaatgaatcccaagggcctgttcaattttcacccagcagtttccttgcaacactttcagctccccatgttccagaatccccccccaaaaaaataataggctttaaaacaatatgggcccctcatccaaagaacaactgttgtttgaaaccccccattacctgagggtaaaaaagggccttttatgaaccagttttaccagtggtaggttggaaagaaaaaacctccacccaaaaaaaaaataaattttctataaccctccc

SEQ ID NO: 503123 - DNA, 209 bp, Homo sapiens
gctggaccgggaggtgcagtgcacaatcacacacactgtagccttggctcaggtctccagtggtcctcctactttagcctcccaggtagctgggaccacagacatgtgttaccaccaccagctaaagtttttatttatttatttattttttgagatggcgtctttctctgttgcccaggctggagtgcagtggcgctatctcagttcac

SEQ ID NO: 503124 - DNA, 1354 bp, Homo sapiens
taactcaacataactaaactttcagaaaattaagaacgctgactttactattcggtggttctgaagtatcttgttcgttcgcattctgtaactactgctacacaacaaggcctaataaaatgccccacgaaaatacttcacgtgcactttatagagaccggctattcttcgtagtcagctcactacgtaactgtcgtcatgtacgataccacgctttacaacacgactatcacatggacactcccgctgtaacacttcatcaaaccaactgtcgactactcacaccacggactctcaacgacaccttggaatatcccatgctccactacaactagcacacacttataacctgatctactactgatgctgcgagaggaacactgactgcactgacattcaccaagaattggaagactcgcatgacgagtgactgacgcacctggcgctgacaccagcccaatccactatcaacactggatgaataactccctttcaacacgcaacgataaccagaacatacacaatatactacaacactacatctcaaccacaccttgctacttgcacaatcatgtcaccccaagactccacaccaagatatccacctcccttggacctgcacacacagtacggtccattatcctgcccacaccatctaccaccagtaacactaagtaacagcgaaaggttacaacattatcgggcatacacatggatcccatctgaacccacaatatagatcaccgcaggctaacaaggactgacgatacgcgcggcactaagagacaacaataataaacctaggaccagcaactagggcaaataaccacaacacaactaccaagacaacaaaaaggacagcacagtcaaaacaaataaccagaacaaacacccaccaacgaaccaacccaccatgaaaaaagcaagaacacgaacatacaacacaacactaacacggggacaagtacaaagagaaaaagaccacagaagcgaaagcgagaaacaagcgaaagttacagcaccacgaagacttactcggaacagaatacctcacacacgaaccacgtatctgcatacaaatgtaacacaaactaaaaaaaagttcatactacatcagcacgagaactctgccctcaccgtgcaaattcgcaaatgacactagagcgtaaatctacgacgaggaacagagcgacaagccagaagtgaccatcagctaggaagacaaccatcgactaaaagcactcacacaagaatcaaaaccttagccataaacgatagcaagtaccaacaagaaccacaccataacaaaccacacaagatcatctagaagacagacatagatacgctcacaccg

SEQ ID NO: 503125 - DNA, 385 bp, Homo sapiens
agtatgtcatgcatatgaataaaaatgcacttctaagaaaaggtgttcaggttcgtgggtttcttatggaggggtggatattgctagattcccgtctgtctgtagattattggtgaacttaaaaaaatccaacttgattatttgttctgctgttaaaaataatatacatgtgtagtgggaaatgtcagccaaagtgcggttactgtttcgtgtgggagagaagctccctcttagactttgctgtcgatctcacgagttaacagaagcttattttctctaagttgtgatagactttctcagaagctatacattgtaagttccggttctggccgggcgcggtggctccaacacctgtaatcccagcacaatggcacggggtaccgag

SEQ ID NO: 503126 - DNA, 155 bp, Homo sapiens
tgcacgccgcatcgtgagacgtgcttagaatccactatgatgggaaacatttcattctcaaaaaataaaaaaaatatttcttttcttgcctgataattggttagtttctgaacgtttagattttttttttccatggggttcaaaaggtacctaag

SEQ ID NO: 503127 - DNA, 443 bp, Homo sapiens
agagaatggggcccgggctcagactggtcacgggggtgagagggggcccgtcggggcgggaggaaggggcttggccccgcgcaagcgccggccctgaccgtctgtctctcgctctctcccgggcagggaggctgccggcgtggaccgcgtgaaggctgcgctggctctcgctgggaggccaccctcacagacgtccctggaggagcgtgtccagcacctgctggacgcggtggagcacaggcagcttgaccttctggacatcatcgcatcctgccacgcaattgcactgccctttggccctcctcaccatgagccggttgcttgcgcaacgtctcattcaaactctggacgtcccaccatactgctcgttccgcacgatgctggtttttcaaatgatgctcgccacggactttccacaccctgaccatacccgcatccaatac

SEQ ID NO: 503128 - DNA, 172 bp, Homo sapiens
agacgtcattctgcatccagtcaactagggtgataactattatcacctagtcccagctactcgggagactgaggcaggagaatcccttgaacctgggaggagtaggtggcaggtgagccaacatcgtgccactgtactccagcctggacaagaagagcaaaactctgtctcc

SEQ ID NO: 503129 - DNA, 857 bp, Homo sapiens
  misc_feature (471)..(471): n is a, c, g, or t
ggcaggagcaagtgtctgccgcggtggccgggtgccgatttgacaagattcaaagtctgtaggaaaatggactgtgaggttcatagagatggaaggatctgggatttcgattgatgactgcttggagagaagtacataggctggcttatgattggactgtcgtcaactaccactgaagtgagcttcctgtacacctgaaggacatgacaatggtgtgcatccactagaactctgtcaagacgcaacaagacacatgatacgtggatgagaccttagccttagcgagctagcctccactgagaagtgttccccccatttggagaatctgatctgcttgggtcctttcttgtggatggattttctcaaagttacacaggatcaaagcatggtgtggtgtattcgagtctcgcaaattccaaaccatttgcagttaatcaaatcgagcaacgtgccgaaatacatgtgcacccnattgttagtttgtgggtagcgaaagttgcaatgcgacaattgaattgagcaacacggtagatttctcctagtaatggtgaatatttcgctctttaaaccttaaaaagtcttcgattgacgtaagcatttatagtttgacacactgattggttaggaaagcatttggctcttagctctgattttgctttgctgtcgaaggttttgacaaccttccaactacttatgtgtgtcctgtaacacaggtgattgaacgtatgagagggaaaggccaaggaaaaaggaagtcagacactaagagaattcattattctcatacttccccacattgagaagcaattcggagtgtattaggctgtgatgttgtgatgtggcaacatatcccattc

SEQ ID NO: 503130 - DNA, 680 bp, Homo sapiens
gtggcccacctggtcgcactgtagtccacgatcttttcggcttcgtatcttcggtgcgccctcgctttcgcgttgttccctccgccaaacccactggtcctgagcacaaactcccgaatatggcctgagagattcgacgagaaatttcgagtataagttcgcaatatctggaaagaaagatcacggagatacgcaatgtagaaataaatgccacctgccctttccacaaggaatatcgattgaatcacggatgaatgcacagtcacggcgatattcgttaatgaaggccgtgcgccgccacatatggcacctgtaaccttccaccgagcacttgccttcttaattttaacttgcttttaggctgtttaaactttgtaagaagcacaagagggttggaatcacagtttaaatgactgtgctgcccctttcacatcaaagaactactgacaacgaaaggccgcgcctgcctttcccatctgtctaatctaatctggctggcaagggaaggaaatgaacttgcaatgttggtgaaggaagaatgtggggatggaagaagtaggggtgggactgacagtgaattctagagtaaaaccatagatggcccaatggtgttcctgcaggtttgtattgcatgttttagtcatgtatgttgccaatttttttttacgtctaaggaaatt

SEQ ID NO: 503131 - DNA, 104 bp, Homo sapiens
gacggcaggaactgcgtatattactgtgcgaaagaagggggctatttactatggttcggggagttatgtctaacggtatggacgtctggggccaaggtgaccac

SEQ ID NO: 503132 - DNA, 342 bp, Homo sapiens
tactacacccgcgaagccggcgtgcgtgcgctcgaacgcgaagtgggcaagatctgccgcaaggtgatcaagcagttgctgacccagagcgatcgcgccaaggccgaaggcaagaccttcgaactcaagccggtcaacgtcacgggcgacaacctcagcgattacctcggcgtgcgccgctacaccttcggcatggccgaaaaggaaaaccagatcggtcaggtgaccggcctggcctggacggaagtcggtggcgacctgctcacgatcgaagtggcggacatgcccggcaagggggtgatccaacgcaccggctcgctcggcgacgtgatgaaggggtcg

SEQ ID NO: 503133 - DNA, 1350 bp, Homo sapiens
  misc_feature (1048)..(1048): n is a, c, g, or t
cattccttaagtcctaattgggaaaaaaaaaaaaaacaaaatgaaagtagttggaagaaactctgggggtgtaaccaacattgatttggtaacccttacacactatttcaataacgtacgtaaggaagggagcattcacacagattttcacgtctaattctggccctttcttgtggcgccataattataaccattaaactgtgtgtgtgtgttacgtgattaaaaaaggttcattttctctttcaaaagaagaacttacagcttagctgtgcacattgtggtgttagaagcagctttctaacattgggtaagaactttgggtgttggacaagtggtaattatttcgtattttattgggagaacaaagtgtgatttataaacaatgttatttatttgttataatctcatatagaaaatctcagggggttttgtgggaatggttatttggcacatattggtgtcgactcgagtgaaaaagtgttcccagagaatttatatttctcttaaagtgtgggcccaaaatatattgtgggggaacacatttagagaggaaagagcgcaacaatttacaaaggaaattgcgcgttttctcccactatttgggccacacaatttgtcaaacgaggcttctcctttctactcccacgggcggtgtgcggaacgacattttcacacctgtggggggaacatctacaaaatcaacgaccccgtttggttgtgcggccccccgttggacaaactatcacacagcacggataattctccaccacgtggtatacggcgaaagaaggaaccttctgtagaagctcccaccctatatacggggctataacgcacacacacggtaagtcggcgaactcagttacatcctcgcatgggggagaagacccctcgttccgaaaagctgatgcttctctcagcgagggaaacattgcccatcttcttcctatcaagacggtggcgtacatcttaaccacgcagtggggaaaacgtttagcaggccacagtctaaccacgatagatacgccgtatgtaagtcgaccccacnaacgtggtttgtccgagcaggccgacacattttgcacgcacgctctaacgacaatctgtactacttctcagcggcgactaggcgcacataactgatacaatcttcctgttgaaacccccacgcgtttagacgtcttcaccacaacagggccacttgctggcttccgcgctgtgctgcaaacactgacacaaaagtcgtggcgcacaccatctctgcggcgacgctggctctcacaccgcacagctgcgcctaagcggaccactacgtgacgacccatccgcccagtgacccccccacagcca

SEQ ID NO: 503134 - DNA, 265 bp, Homo sapiens
cctccacaacagctacacttttatgtgttagtatggaactcggtggtatgaaaactatgtataaaaccaagagcccccatgctaattaactgaattggtactttgaatgttaaagctggttcttggttttactttgggactttccaccttgattggtgagatactttatttgataaaccgtccattctttggccattgtgggtgggcattgtgaacttcatggttttttggtgtttcgccagaaaactgtttgtggaggtaagca

SEQ ID NO: 503135 - DNA, 1073 bp, Homo sapiens
gaggtgggacagcagcacctttgagcgatggggcgtctgggaaccccagaggcagtggcaagaggaggtgcggcggtggtagtggtgggctcctgatgaccgacctgtcagtcttacttctcgtttgccaaaaactggagaaaccatccatggacataagttttttattggctttggagggaaaggtgccaaccagtgtgtccaagctgctcggcttggagcaatgacgtccatggtgtgtaaggttggcaaagattcttttggcaatgattatatagaaaacttaaaacagaatgatatttctacagaatttacatatcagactaaagatgctgctacaggaactgcttctataattgtcaataatgaaggccagaatatcattgtcatagtggctggagcaaatttacttttgaatacggaggatctgagggcagcagccaatgtcattagcagagccaaagtcatggtctgccagctcgaaataactccagcaacttctttggaagccctaacaatggcccgcaggagtggagtgaaaaccttgttcaatccagcccctgccattgctgacctggatccccagttctacaccctctcagatgtgttctgctgcaatgaaagtgaggctgagattttaactggcctcacggtgggcagcgctgcagatgctggggaggctgcattagtgctcttgaaaaggggctgccaggtggtaatcattaccttaggggctgaaggatgtgtggtgctgtcacagacagaacctgagccaaagcacattcccacagagaaagtcaaggctgtggataccacgggtgctggtgacagctttgtgggagctctggccttctacctggcttactatccaaatctgtccttggaagacatgctcaacagatccaatttcattgcagcagtcagtgtccaggctgcaggaacacagtcatcttacccttacaaaaaagaccttccgcttactctgttttgattgctattagtcccaaaataaatatacctgggaataaaatgtacttgggggtggctgctcctggctaatgcttattagaaaa

SEQ ID NO: 503136 - DNA, 375 bp, Homo sapiens
cgcgatctctgtgctcaaaatttatacctgtgcagattttcaatcagagactgtgtgctcaatattatgctactcggtcttcaggccacctgaggcacatactctctgaaaccgctattgaaaggtatggccactctggactggacacattctaaagcaccacaagagctctaacattttctgagagccacagagaatttggccataaatgagctctcaatttttcacacttgactggcaatctaactctaaaaattaataaggttacttttcaaccactcctggaaggctgggttttacctgtcccttcattaccatctaaattataggctggccttgctgtgtaacatttacacgagaagctgtttcccgccg

SEQ ID NO: 503137 - DNA, 315 bp, Homo sapiens
  misc_feature (46)..(46): n is a, c, g, or t
attctccgacccccacccgcgctccgcggcacccatccgcaacccncaccaacccttgaggtgctggtgacagctttgtgggagctctggccttctacctggcttactatccaaatctgtccttggaagacatgctcaacagatccaatttcattgcagcagtcagtgtccaggctgcaggaacacagtcatcttacccttacaaaaaagaccttccgcttactctgttttgattgctattagtcccaaaataaatatacctgggaataaaatgtacttgggggtggctgctcctggctaatgcttattagaaaa

SEQ ID NO: 503138 - DNA, 850 bp, Homo sapiens
  misc_feature (46)..(46): n is a, c, g, or t
  misc_feature (649)..(649): n is a, c, g, or t
  misc_feature (693)..(693): n is a, c, g, or t
  misc_feature (717)..(717): n is a, c, g, or t
  misc_feature (724)..(727): n is a, c, g, or t
  misc_feature (732)..(732): n is a, c, g, or t
  misc_feature (746)..(746): n is a, c, g, or t
  misc_feature (751)..(751): n is a, c, g, or t
  misc_feature (760)..(760): n is a, c, g, or t
  misc_feature (780)..(780): n is a, c, g, or t
  misc_feature (785)..(785): n is a, c, g, or t
  misc_feature (787)..(787): n is a, c, g, or t
  misc_feature (801)..(801): n is a, c, g, or t
  misc_feature (810)..(810): n is a, c, g, or t
  misc_feature (820)..(820): n is a, c, g, or t
  misc_feature (823)..(823): n is a, c, g, or t
  misc_feature (831)..(831): n is a, c, g, or t
  misc_feature (833)..(833): n is a, c, g, or t
  misc_feature (835)..(835): n is a, c, g, or t
attctccgacccccacccgcgctccgcggcacccatccgcaacccncaccaacccttgaggtgctggtgacagctttgtgggagctctggccttctacctggcttactatccaaatctgtccttggaagacatgctcaacagatccaatttcattgcagcagtcagtgtccaggctgcaggaacacagtcatcttacccttacaaaaaagaccttccgcttactctgttttgattgctattagtcccaaaataaatatacctgggaataaaatgtacttgggggtggctgctcctggctaatgcttattagaaaatgtcctcgtcccctttctttgcaaatattagttcttttacgaagtcatcctcaagcttcaatttatttataacgatgattcttttgctttccatgcatttgcacaaaacaaccagaattaaagattccacaaccaagatctgtacaaacataaagacaagtaacctcaattgtcaacagattgttaatgccccatgtgcaccatatggcaggggttgtggacaacagtgtctagagtcagagcagactcttcttaaataagggaaagggcactttctaagaggggcagctgatactcaacttcagcttagtgttgtcaacgcctctggttttgnaagggaaggcagaagtttggatatttattgaaacccttcaatgnttatgtatcagcaactaatttttntttaaannnnaacancacaggggcatggnggctnacgcctgtnatcccaccactttgggaagnaaggnanaagaattgcttgancccaacatngcaaaacctnatntctactanananacaaaaattggccgg

SEQ ID NO: 503139 - DNA, 908 bp, Homo sapiens
gaggtgggacagcagcacctttgagcgatggggcgtctgggaaccccagaggcagtggcaagaggaggtgcggcggtggtagtggtgggctcctgatgaccgacctgtcagtcttacttctcgtttgccaaaaactggagaaaccatccatggacataagttttttattggctttggagggaaaggtgccaaccagtgtgtccaagctgctcggcttggagcaatgacgtccatggtgtgtaaggttggcaaagattcttttggcaatgattatatagaaaacttaaaacagaatgatatttctacagaatttacatatcagactaaagatgctgctacaggaactgcttctataattgtcaataatgaagtgaaaaccttgttcaatccagcccctgccattgctgacctggatccccagttctacaccctctcagatgtgttctgctgcaatgaaagtgaggctgagattttaactggcctcacggtgggcagcgctgcagatgctggggaggctgcattagtgctcttgaaaaggggctgccaggtggtaatcattaccttaggggctgaaggatgtgtggtgctgtcacagacagaacctgagccaaagcacattcccacagagaaagtcaaggctgtggataccacgggtgctggtgacagctttgtgggagctctggccttctacctggcttactatccaaatctgtccttggaagacatgctcaacagatccaatttcattgcagcagtcagtgtccaggctgcaggaacacagtcatcttacccttacaaaaaagaccttccgcttactctgttttgattgctattagtcccaaaataaatatacctgggaataaaatgtacttgggggtggctgctcctggctaatgcttattagaaaa

SEQ ID NO: 503140 - DNA, 362 bp, Homo sapiens
tcgcctggtcgcagtcggctgggaagaggcgctcctcacttcctagatgggatggcggccgggcgcagacgctcctcactttccagactgggcagccaggcagaggggctcctcacatcccagacgatgggcggccaggcagagacgctcctcacttcccagacggggtggcggccgggcagaggctgcaatctcggcactttgggaggccaaggcaggcggctgggaggtggcggttgtagtgagccgagatcacgccactgcactccagcctgggcaccattgagcactgagtgaacgagactccgtctgcaatcccggcacctcgggaggccgaggctggcggatcactcgcggttagg

SEQ ID NO: 503141 - DNA, 183 bp, Homo sapiens
ttcaaagcgcacagaaattataaactctctgaaattgtatggagagtagtacagcagctcagttgacctatagcataactcatatctcatttcgcagacagtaatgtaagaccatatagatgaaagctgaattcctagagatgttaaatccctatctagaatagaaaagcagtattaagctct

SEQ ID NO: 503142 - DNA, 1608 bp, Homo sapiens
  misc_feature (1407)..(1407): n is a, c, g, or t
  misc_feature (1451)..(1451): n is a, c, g, or t
  misc_feature (1475)..(1475): n is a, c, g, or t
  misc_feature (1482)..(1485): n is a, c, g, or t
  misc_feature (1490)..(1490): n is a, c, g, or t
  misc_feature (1504)..(1504): n is a, c, g, or t
  misc_feature (1509)..(1509): n is a, c, g, or t
  misc_feature (1518)..(1518): n is a, c, g, or t
  misc_feature (1538)..(1538): n is a, c, g, or t
  misc_feature (1543)..(1543): n is a, c, g, or t
  misc_feature (1545)..(1545): n is a, c, g, or t
  misc_feature (1559)..(1559): n is a, c, g, or t
  misc_feature (1568)..(1568): n is a, c, g, or t
  misc_feature (1578)..(1578): n is a, c, g, or t
  misc_feature (1581)..(1581): n is a, c, g, or t
  misc_feature (1589)..(1589): n is a, c, g, or t
  misc_feature (1591)..(1591): n is a, c, g, or t
  misc_feature (1593)..(1593): n is a, c, g, or t
gaggtgggacagcagcacctttgagcgatggggcgtctgggaaccccagaggcagtggcaagaggaggtgcggcggtggtagtggtgggctcctgatgaccgacctgtcagtcttacttctcgtttgccaaaaactggagaaaccatccatggacataagttttttattggctttggagggaaaggtgccaaccagtgtgtccaagctgctcggcttggagcaatgacgtccatggtgtgtaaggttggcaaagattcttttggcaatgattatatagaaaacttaaaacagaatgatatttctacagaatttacatatcagactaaagatgctgctacaggaactgcttctataattgtcaataatgaaggccagaatatcattgtcatagtggctggagcaaatttacttttgaatacggaggatctgagggcagcagccaatgtcattagcagagccaaagtcatggtctgccagctcgaaataactccagcaacttctttggaagccctaacaatggcccgcaggagtggagtgaaaaccttgttcaatccagcccctgccattgctgacctggatccccagttctacaccctctcagatgtgttctgctgcaatgaaagtgaggctgagattttaactggcctcacggtgggcagcgctgcagatgctggggaggctgcattagtgctcttgaaaaggggctgccaggtggtaatcattaccttaggggctgaaggatgtgtggtgctgtcacagacagaacctgagccaaagcacattcccacagagaaagtcaaggctgtggataccacgggtgctggtgacagctttgtgggagctctggccttctacctggcttactatccaaatctgtccttggaagacatgctcaacagatccaatttcattgcagcagtcagtgtccaggctgcaggaacacagtcatcttacccttacaaaaaagaccttccgcttactctgttttgattgctattagtcccaaaataaatatacctgggaataaaatgtacttgggggtggctgctcctggctaatgcttattagaaaatgtcctcgtcccctttctttgcaaatattagttcttttacgaagtcatcctcaagcttcaatttatttataacgatgattcttttgctttccatgcatttgcacaaaacaaccagaattaaagattccacaaccaagatctgtacaaacataaagacaagtaacctcaattgtcaacagattgttaatgccccatgtgcaccatatggcaggggttgtggacaacagtgtctagagtcagagcagactcttcttaaataagggaaagggcactttctaagaggggcagctgatactcaacttcagcttagtgttgtcaacgcctctggttttgnaagggaaggcagaagtttggatatttattgaaacccttcaatgnttatgtatcagcaactaatttttntttaaannnnaacancacaggggcatggnggctnacgcctgtnatcccaccactttgggaagnaaggnanaagaattgcttgancccaacatngcaaaacctnatntctactanananacaaaaattggccgg

SEQ ID NO: 503143 - DNA, 1300 bp, Homo sapiens
  misc_feature (307)..(307): n is a, c, g, or t
  misc_feature (405)..(405): n is a, c, g, or t
  misc_feature (420)..(420): n is a, c, g, or t
  misc_feature (441)..(441): n is a, c, g, or t
  misc_feature (446)..(446): n is a, c, g, or t
  misc_feature (513)..(513): n is a, c, g, or t
  misc_feature (517)..(517): n is a, c, g, or t
  misc_feature (523)..(524): n is a, c, g, or t
  misc_feature (536)..(536): n is a, c, g, or t
  misc_feature (538)..(538): n is a, c, g, or t
  misc_feature (540)..(541): n is a, c, g, or t
  misc_feature (554)..(554): n is a, c, g, or t
  misc_feature (560)..(560): n is a, c, g, or t
  misc_feature (1009)..(1009): n is a, c, g, or t
aatagcaccccctctgagcccggctctggccgggggcctccccaatgaggaatgaagaagaggaggatgaatgaggaagaggctaccaaggaagatgctgaggcccaggcatcagagatcatgagagcctgtatggcggcaccacatgtttcaagaggagcccccagcactgttcctgctgctgtctgtgtgtgctactgggcgaaactggccagggcctgcaaactgggaacccctttcccaccccaacgtgctctcctcttctactcacttttcccactccaagcccagcccatggagattgacntggatggggcaggccacctgggtctcacctctaggtccccatactcctatgatctgagtcagagccatgtcttctccctggaatgagttgaggccacngtgttccttccgctnggagctattttccaggcttcntgtgnggctgggacaactgtcccacctcctgacacccttctcccactctcctaggcattctgacctctgggnttgngatcanngggtaggaatgnananngatggagcatcanacagcnaggggtgggcttgtggggcctgggaggggcaatcctcaaatgcggggtggtgggcagcatcgaggagggcaggccatccttctgaggctcctggtccccatgtctatcacctattatcccagctgcctagattcaggcaacacgtggagacagcttgtactgggaggggctcctttccagtgaaatgcctctgactgatgatcaacggccatttttcctgtttgccgaacccaacgagtgtggggagtgtagatgtaatcatcaaggagactttggggcttccgagttgttcgggccaaggaccgggagatctgacagggtgtgactgatagccatgggggtgggagtgttgagcaatcgtgtccccccttgtagatctctgaaggcgacaaatacgatgcttgggaaggactcctagctgtctttttgactctccgcacgagtgtgcnaggcagcattatagtgatgtataatcacgccgagctcaagggacgaccatgtgtagaacggtgcgatacaggaaaattagcacacaaacttgaaagacccagcctgggggcacatcggccttcccatggggcccaatgagggccggggccccgaagggggggggaccttgagcggggaggccagggcaccacacggcggcccagggacaaggtgtcacgggaaaaaagggcccctcggaagaacgtagccccgggagaaggagcgacaaacaaaaagacacgcgggaggta

SEQ ID NO: 503144 - DNA, 415 bp, Homo sapiens
gaggacggaagctatactagtcccccgaggattactacaaagcatagggggctctatgctcgcgcgtgttcgtaactcagccgaggggcaaggaaagctccaaatccgtgacagtcagagtctctgactggacattaccctgaattctactagttcctccaattccatcttctcccagggaacctcaaagagcaagacccactctgttccagaagccctataagtcagagtgggacaactcaatgtaaatttcatgggaaaatccttgtacctgatgtctgagccactcagaactcaccaaaatgttcaacaccataacaacagctgctcaaactgtaaacaaggaaaacaagttgatgacttcacactgtggacagcttttcccaagatgtcagaataagactccccatcatga

SEQ ID NO: 503145 - DNA, 832 bp, Homo sapiens
tctaggtgcgaggctgggtttgaatcggccgaggccgtgtttcggcctgcgcatggccgcggtggacctggagaatgctgcgggcgtctgggcgcgggcaaggccatcggcgtcctgaccagcggcggcgacgcgcaatggcatgaactgctgctgtcctgggctgtgacgcgcatgggcatttatgtgggtgccaaatgtcttcctcatctacgaggtgctatgagtggcctcgtggagtggagtgtgagaacatcaatgcagtgccaactggcttgagctgtctccaacatcatccagctggtgcgtgcactatcattgtgcagctgctcgctgcaatggcctttaccaccagggaggggctgcctgggcagcggcctacaacctggtccagcacggatcaccaacctgtgcgtcatctgtgcgtgggatggcagccttacaggtgccaacaatcttccgcagcgagtggggcagcctgctggagtgagctggtggctggaaggtaagatctcagagactacagcccggacctactcgcacctgaacatcgcgggcctagtgtggctccatctgataactgacttctgctggacctgacatgaccatcggcacggactcggcctccacctgcatcatggagtgtcatcgatgccatcaccacaactgcccagagccaccagaggacttcgtgctggaagtgatgggcgggcctgtgggtacctggcgctggattctgctggcccatgggccgttggtgtgcatcccggggtccaccgaggagcttgggacttctgtttgagagtggtggaccgagccgggcccatgcata

SEQ ID NO: 503146 - DNA, 1183 bp, Homo sapiens
gaggtgggacagcagcacctttgagcgatggggcgtctgggaaccccagaggcagtggcaagaggaggtgcggcggtggtagtggtgggctcctgatgaccgacctgtcagtcttacttctcgtttgccaaaaactggagaaaccatccatggacataagttttttattggctttggagggaaaggtgccaaccagtgtgtccaagctgctcggcttggagcaatgacgtccatggtgtgtaaggttggcaaagattcttttggcaatgattatatagaaaacttaaaacagaatgatatttctacagaatttacatatcagactaaagatgctgctacaggaactgcttctataattgtcaataatgaaggccagaatatcattgtcatagtggctggagcaaatttacttttgaatacggaggatctgagggcagcagccaatgtcattagcagagccaaagtcatggtctgccagctcgaaataactccagcaacttctttggaagccctaacaatggcccgcaggagtggagtgaaaaccttgttcaatccagcccctgccattgctgacctggatccccagttctacaccctctcagatgtgttctgctgcaatgaaagtgaggctgagattttaactggcctcacggtgggcagcgctgcagatgctggggaggctgcattagtgctcttgaaaaggggctgccaggtggtaatcattaccttaggggctgaaggatgtgtggtgctgtcacagacagaacctgagccaaagcacattcccacagagaaagtcaaggctgtggataccacgtgtagacctggctcaagacccaagagtgaagcagcaagtgtgaagaagcagaaacattataaataacccagagaatccttttataacagcaactgcctactgattttgtggcctaacagctcgagcaaaaatgaatataaatacaacattgtgcaatgactaattactcaaaattttgtgcatcagcagaagtggaacctgtggttggtgctaatattatgaaatgcctttgctgtttaataatctggtagctctgtattatttagcatgcatttttcttggagaacaatgattttatttcaagtacctctcactgaaataaaaaagcagctgttagaagatgaacaatttggcgggaaaaaaaaa

SEQ ID NO: 503147 - DNA, 131 bp, Homo sapiens
cgatctttcacacagggaaacagtgtatacgtcctgaatggggaaaaccctgtgtggggcttttcacagaacacgctacttggggaaaaaccctgggggcttttaaaaaaaaaaacagctttactccttcg

SEQ ID NO: 503148 - DNA, 194 bp, Homo sapiens
aagatgttcgagcggagctcgcgatgcagccagcgcggatactatagcactggtcaaggacacctgtaccgatgctcagaggatgcacatctaaggtgttgtgcatcaatgcacgtattcgatctcacgatgtcgatgcactctagccgccaagccaattagcatgtcgaattcacgtaaccgtaacgcagtgt

SEQ ID NO: 503149 - DNA, 740 bp, Homo sapiens
caccattcgcctatttaggtttccacccttcgaatacatcatgcgcccatgttaccagaacactaccttgccatcaggcactgaatgtgatcactcctggccggaagcacgtgagtcgggggaccttggagtcctcgtctgccctttgggatcatcctatgattctggattagttcgctggtgctttggtcggaaatgagctatactgcaagccatccctgcgtgcctctccaggcctccaggacctgcagggtctcaactggctctggtgagactgtccataggagctgtgggtgaatctggactctctggcataatgccagcttcctctcacaaatctccgccactcagcaaagggcgcttggggttccatggagagcagagcttccacaagacactttcgaacgtctatcagttccttctcttagggggccacgtgcctgcgtggtcaagaggtgaactgttcagctaggacccacagtcgccacatcctcatgtgtgctctacagcgcatgtaattgtgtatcactcgggggcattattttcaattgtaatgttcatctcccacgcctgctccagcctcgatgttggttatattttgagcccgccattccaccacccccgtttcctggggtcacaagtgtctgtgcatgtcccccaggagccaaccgtggggagctcgatggggaggggatggagaaacaagacagggcatatctcaggggcagtggccgggttcc

SEQ ID NO: 503150 - DNA, 993 bp, Homo sapiens
ggacgcgtgggtttcgtcagttacgagctggtctaggaagggaacccccaaatataaattagggcgttaacggacagattgaccattagtatagtgagtactgtatattgtacaagcagtgaatcacgcaccatagggcatgattaacgaagcaaactgttcccttcccccgagtgattgagcgaaagccccgttttcccttcagctagcttgtaatgttccaagatctaggaaagcttcaggcgggacctactagaaggcaggaaaagaatatggccatcacatcatgttccctctcactttcagtaaaaataaataaaacagcagcaagctaatactaacttaaaaatgaagtagcacagaaacagaatgagataaatatagtgtcgtgcagcattcatacacaaaaaagaaggggggagcgcgcctctaacagttaacccacggagggggcgaggatgaacgtcgtacccaacattgctgggcacgaacgggggcccgcaaagagtggagtcggaatgatgaaccagagcgcatcgggccgctgaatgacaaccgccgggggcatggggaacagcactgggcaaggcgagggcgaccttggggaaggaacccatacctcatgctggagggactatatctgggtccaagagagcatacacgagaagtttcaagggcgctagggtgcacattctcgcatcctgaggcggctatacagcgcgcttacacagacagagcggcatatgtgctcggcgcatggaacagtgttcgccaccccggcgactgaacgtcctggacccagtgcttgccatgacctcgttgagaaaacccacataacggaacagcttaacccaacgccacacaacgccacgcatgtggggacaacttgctacaagtccaaggaagcaatccccaggaggaaacgggcgctccggggcaccggcacgccgacaaaccaccgaccgaagagacgggccacagaactatagggac

SEQ ID NO: 503151 - DNA, 166 bp, Homo sapiens
agtagaaacatacagtgggctctatacacaccatttgaaataagtttccatggccagtgaaaatggcccatgcctgtaataccagcatcctgggaggccggggcgggcggatcacctgaggtcgggagtacaagaccagcctgaccacaggatgtcggagacggga

SEQ ID NO: 503152 - DNA, 603 bp, Homo sapiens
ggtgatctagagatccccgtcttacccacagggcactggcaatgtctgggcacacagtaggtttccaacaagcatcggtggactgactagaatgtatgactgaatgaacaaatcacagtgaggccctacagctgatagtcataataatgtatttggcggacaccacctgggttacaaatctctctcttcctgaataaacatatgcaaccggagacagacttccaagataatttacaggaggggagcccagacacatccaggcagtgagtcagtagaaaaccagacacgcaagatcaacgggatttctagaaggtcctaaaggaccgcagtgtccagtcactcggggaaatcttggagaataaagcgggcattaaggcattagtcagcaactggcctgggtcaaccaaggaaagataaacgagctcggtgctttaagcggggggagcagaaactgggggtaagtggcggaaatcaaggagtctcaggatccactgacattaccctttgtgattcagatggagaaaggtggtgcaggatgaattccggtgctaatgaggaccaggtatctatcctgcgataaggcagagaaggctggtggtaaga

SEQ ID NO: 503153 - DNA, 103 bp, Homo sapiens
ggattactgttcgaggcacaaattcctgatatgatcgcagattcaggcaaatatataaaactgcaaaacgtttaccgtgaaaaagcaaagaaagatgctgccg

SEQ ID NO: 503154 - DNA, 473 bp, Homo sapiens
  misc_feature (32)..(32): n is a, c, g, or t
ctctggatgcaaagtgtcataaataagacatncccctaccccgactcagctccttcaaaacccagatccagacccctgtcctccccagtcccatctgttgtcttggttacctccttgcctttgggctccttatccactcagttcttacaacccactttttcatgcactgcccctttgtggctctgttttcacatgtgtgcatttgatgactgcaggtttcttagagtaaaaatcgtatgctctgtttcattgattcctttcttctttctaccaccctatatcatctggatattccaacccagttggaggtccattgttcccccaacaaaaccttgattctgctgcatctatgcctttgctctcccatccatctctgcttctttctgtgctcagcacgaactctaccttctctgggaaacattgcctttccccctgtaccaggagttatattttctccagacacttgatccaga

SEQ ID NO: 503155 - DNA, 139 bp, Homo sapiens
aacgatcgttcgatgttcctgcacacctccagaacagctgggagagttattatctaggaattatgatggtgactggtctgcttgctatatatcatgaattacatcattagggaagaataaaaacacgtcgcctatgcac

SEQ ID NO: 503156 - DNA, 375 bp, Homo sapiens
ccttttcttgcagggcttttgctttttcatgcaacagcatttttgctgatgaaacaatttgcttggcttggcgtcttgataaatgatcaattgtccttacgagcactttaggatttgcattagcttagtgcattagactttttgtacctgcactgtataactgttttggtcgaccctttaaaactccagtaactttcttgagagggattaattttggcttttcacagtaagtcagcttctttggtagttctacccaaagggttttgtaaacccaaaacttcttaagctttttccagaaatgttccaccccaatatgggaatggggccgttcccgtgagaaaaatttggatttatccctcggggcttttttatttt

SEQ ID NO: 503157 - DNA, 821 bp, Homo sapiens
  misc_feature (1)..(1): n is a, c, g, or t
  misc_feature (6)..(6): n is a, c, g, or t
ncactntcttctttctctcaaatctcccccgggccttttcttttccgcattcgtccctccggtttctcaattttaacgccttccttgcctcccccgcttctttcatggaactatttggcccactttaactgacaaagttttcgttcacagaaaccaaccctttcataccatgcctgctcgaaacattccgaaacccagaagtgtgaattgaaatttccgccagaaccattcctcccgcttcgccctaatgttatccccacacaatgattttaggaaaatattatcgcttagagggcccacagggaattagattacagatggttccgccagttacacaggcccataaatttttcgcccgcttttcaagctattacccactgtgcgaccactgcacccggtaccgcaccatttggaccaagatatgctaacccactagtcctccaagtgcagatctttttgtgaaaatccacccgtgtcttatagggttacaccgccccacaccaagccccttagatggcttatttgtataaatggaggttactcaaatcacatattaaagtttaactacttgtaaaggtggctcgcaccctggtccccacatagtagggtcttcctagtatattagtttgaattaatatctgagaagtgtatataatttgtggtataaaagattatatatccttaagtatgccctcccgttttaaaaaagtatatattctacacatatatatatatgtatatctatatctcttaactctgttaattgattaaatttggccaattaaatttacctttaaataaataatttttttcccaaaaaa

SEQ ID NO: 503158 - DNA, 103 bp, Homo sapiens
ctctattccaacggtacgccgctgttccacctgctgacctggcgccaccatgctcggtgccttcttcatctgtcacctgacccggtttccggcgctaccagta

SEQ ID NO: 503159 - DNA, 287 bp, Homo sapiens
  misc_feature (13)..(13): n is a, c, g, or t
aagtgctgtacanagctcagtggtacttcttttgtttctgctagtaaagtttatgagacgaagtcttgctcctgtcacccaggctgagtgcaatggcacgacctcggctcactgcaacctccacttcctgggttcaagagattctcctgcctcagcctcacaagtagctggggttacaggcacccaccaccatgcctggctaatttttttggtatttttagtagagacagggtttcatcacgttgaccaggctggttttgaacttctgacttcaggtgatccacccg

SEQ ID NO: 503160 - DNA, 977 bp, Homo sapiens
catattacccggtattttgtcccatttcccccgcgggggttccctctaataaatgcgccccctaattgttcccacaacggagtcgcccctacccaaaaatgggccccctcctttttttccaaaaaagagtttttcgcccccctcgtttagtcaatcatcgcgggtcaactttctttgcaacgcaggagcactccagcgaaagcccatactatcacaagatcgtgtgcgatcacgcttgatacatatcactcgtccctatttccacgctgcctttctttacaaaaaaacacattgtttaacccgcgcggcattatttcttccaaaaacaccacgggggccatcattttctattcttcctgttctacacaaaatgcctcccaagcccctcttaatttacaaaaactatttaccaatttataggcaacccccctgcaaaagaggcgaaatacacaccaccctaaaaaaaataattttttctcccaaacaacaacatccttgcaaaacctccagagcggctgttttaatctatcctcgtatacccccactttttgtaccacacacacacccagtccacgcagttctttccaccaccactacataaaacaaaagaaggaagcttattaaccctgcacaccttggttcgaaaaatatctaatgttctcgccccaccagcctttcctttccctacatagtatgtctcctccgagaaatcacccacaaaaataagattgtgcacgcatatctgatgctacaaccaaaaagcaaaaacagggattttcttcaacagcgagcaccacactttcataaccccctctgcctctcttgtaacataaagaattggggaccaaacccaacctgcgtgcccccctctattctcgattaaattcccaccaataataatgaacccgctccccttctctttataaatctctcccggccccggggccccttttaaaaaggggtctccccacaaaaac

SEQ ID NO: 503161 - DNA, 156 bp, Homo sapiens
ggacattggctctcgtcgtgttgggcactagcggtaccgtggtgctccatgctgagcctgggactgctctgccctgtgcacccctccaggcttctgctcctggcatgctctagggggcaggctgtccccacacatagggcactgttccacttggta

SEQ ID NO: 503162 - DNA, 145 bp, Homo sapiens
tccccccccggggggggcccccccttttttgggtttttttccccgggggttttttcctcccccccggggggggggggggaccttttttttacctttttggcccggggggggtttttttttttttttaccttcccccgtttaaata

SEQ ID NO: 503163 - DNA, 153 bp, Homo sapiens
gactcgtgaggatcccctcatcgaaacccttgccccagtcaggctttaggtcgacagtcttgcagcttatctcataagccttctggtagtctcctttgcgtggcataggcagcagaacggttgctgtcacagcacgtggttagggtttgatga

SEQ ID NO: 503164 - DNA, 328 bp, Homo sapiens
  misc_feature (22)..(22): n is a, c, g, or t
  misc_feature (74)..(74): n is a, c, g, or t
  misc_feature (103)..(103): n is a, c, g, or t
  misc_feature (154)..(154): n is a, c, g, or t
  misc_feature (192)..(192): n is a, c, g, or t
  misc_feature (209)..(209): n is a, c, g, or t
tggctcctacaaacatttgagngggccagacactgttctgaaaaatacgcagtcgactttgaacagcacaggcntgaactgcatgcggccactaatactcggncttccttctgcctctgccatccctaagacagcaagacccacccctcctgcncctcagcctactcgatgtgatgatggtgagtatgaagncctttactttatgatgntccacttccatttaatggatagtaaatatattttctcttcctatgattttcttaataccattttcttttctctagcttactttattgaaagaatacagtatctaatacatatgacatgt

SEQ ID NO: 503165 - DNA, 858 bp, Homo sapiens
agcggagtcgagactgcagctgccgcgccggggctgagctgccgctcctccgcgcccgaaaacccgtgagtgccccgcacaggtttagacccagtgtgcctggtgggctgtgcccaggttcagagtcatgccactctgtgggtgaagcttgaggcaaaaatggagccacttcagcagcagcagcagcagcagcagccagcaacaaacagaagcaagcacaaccttggctcctctgcaagatggatgccaagagagaagcaggggccagcagatgagagaagcccaggtctaggtatgcccaaaagctgggtcacacagccgaactctacctttccgccacagctggggaagaccttctggcagcactcacttaggtcccttaagccagagtaccaacccaacgcagcagtgtgccaagtgttgaagcggggcaactatgaactcagatgcttgagtgaagaggacgggaggtaaggcagcatgaggatggggcatgatgaagttgcagaggtgggttgagaaagaaagcccgaggcatggtttcacaactattttcactgttgcagcacgctgtaggcctcgccccaaggaatccccagaagtggcaaccccaattgttacaatatcataactttcacaagcaaacccagggggctaccccaaagcaacagattgggaccaacaaaagccataaacagaacatgactcgaataacgccacaaggacattgcttaccacaacaggggcctttcacacgttgcgttggtcattcccacacaaggacgggagacagggccagagagcattgggaacagcttggacatggcaggacaggctatcagctgcactgacaatcgg

SEQ ID NO: 503166 - DNA, 173 bp, Homo sapiens
tggcgagtattcccgatctgctatgctatccagaaaggtgatgtacaatgaggatgtactcagcgcgctaactccaatgttgaaaagaaggaagaaggagacggttctcgctacgtgttacaaaaccatgttggtggtgacaatgaactggctgccacttgagcgtcctacct

SEQ ID NO: 503167 - DNA, 631 bp, Homo sapiens
cgctgttatacagcctcatataatcgagctagtgacagcggacacctgagtcatctgttttcggccagcgttgatgagacccggttttgctaatagagagattttgtctactactaagaattatcaatctgttgtctctacattcattcgacagtgtgaggttttcttttacacaggagaaattgttcaaactacaaacattgcggctacttcaccacctctaatcccgggacagttgttggaaccaacggtgccacttcagctgtcgtcagcattgtggccttagttgttaccaccacgagtacaaactggattctcttggtctcttatgactcagaagtgaatgcagacacgctgtatttataccgccaatctagacatacctgtgtccgtgttcaggagtatactgtatgtttttttcagatggatcacattggataatccactatgtctttggactatatgcgcttaaataatcacttgcatttcacaagctaagaccattttacaaacatgacatgggagggctcaaactttttccacccgattttgtctttgtgggccaggctctattgcttcgttttcccctttttggcccgtgtcatttccctgggggcccctgtgccccttt

SEQ ID NO: 503168 - DNA, 315 bp, Homo sapiens
gggggggggggaaaaaaaaaaaggggggggagctttttttgggggtttggggggggggcccccccccccccttttggggggtggggggggtttttccctttttttttgaaagggccggggggttttttttcccttttcccggcccccccgtccccccccattttgggtttttgggggggggggccttcccttttttttgggggggggggggggagggggccttttccccccccccccctcccccgggaaagggggggggggcccccccctttttttttacccccggggttttttttaaaacagggggccccccca

SEQ ID NO: 503169 - DNA, 374 bp, Homo sapiens
tgcgtaagctgttcgcggcaggcaatctggaccttcagcagaaaagtatagcgtggccaacccagactgtatcattggaggctgtcactggatggtgcacaggcttctcactattccagcaaggctctggacaagcttggctgcaacagctgctggcgagagtggattttttctccttcagccttgcaaaccatactgggtacatcaaaggttgactggacaacgagctggagaaggacatgaacgaaacgccatcccagcagctgaagatccgctaacgagcaatcagatacctactgaggtcaggagcaacgctgaggaggtgtgtccttctgtgaagaacaaatgtctagtaacgggggatacccgcccgc

SEQ ID NO: 503170 - DNA, 736 bp, Homo sapiens
  misc_feature (736)..(736): n is a, c, g, or t
gcgacaacaaaaaaactaggctatgtacgagccggtgttaatcggccgagggcagctgtccctgttatgccatcccagtggaatgttgacctcccagtgacagcctgctaggtattgagttctcgtggccgagacgccatgctggcaagcgtgtgatgtggactttgtgcctgccaagggcctggccacctctgtcctgctgtcacctgtgacttcctctgtggattgtgccttccaactggacgctggagtgaggctggcctcgtgtgcctgtctgtctacatgcactggcctactactgcgctggtggtgctgtggtgctgggtgctgccccggtggagactgctgctacatccactcgtggctcgtggctggctgtggtgccagtgcctgccatctggcatctgcccctcagtcttgggcttgcctgctgtcttcaccacctgtggggtcgtgctgaggaagcgggctgtaacctccatggccaggttcccccagctcgacatgcaccagcttcgccaactcccgtggacacatccttctgagcagcatgtgctgttggcacacggggcgggaatgggcgttgacctggtcttgaactccttggcggaagagaagctgcaggccagctgtgaggtgcttgggctacgcacggtcgcttcctgggaaattggcaaattctgacctttctcagaaccaccgctcggcattgagtatctttccttgagaacgttan

SEQ ID NO: 503171 - DNA, 185 bp, Homo sapiens
gagggactcagtatattgaggatagtaatacagagcttcttcctgacctcaacagtcagccattgtccaaaagggccatttggtacaaacaccctgccagtattttgaatctcttccacattatctctgccatgtatacatgtacatgtcccatgttgtggaactcactgccactcaagacagtt

SEQ ID NO: 503172 - DNA, 1299 bp, Homo sapiens
acagaaggttgttcttgccccgccccccgctcgaataatcacacgttttgttcgcctggaaggggggaaacacaagagaacccttttaataatagatagatttggcccccccctcggaccccacgggggagggatttgtaaaagtgtttaataaaaggagaaaagaaattttttggcaatcatcggccacgaccggcggtttttgcaacatggtgagaaaagttccggagattggggaacaaaaaggagttccccgccagaccctgggagtgataggtatgacccgctttagccccccctcgtgcttgggggaatattttacaactggggaaaaagtgttttcacattacaaacggcaactgtttggaagcgcacaacagaactcggcggggagagaagagaaaaaattttttccgccgcgtttctcgaagatgtctgagtggaaaacacacccacaaggggggttccgccttttttgtgcgtggagaaacaattcccggggagtgtgaccaccccctcggagagagagagggcccacacagtgaaccacacagtgttgtgggcacaaaaagtgggagggagagaaagatatctcttttgtggggggcgacccacaaaaaagggagatttccccctcgcaattctcggggtggaacttcccatagtgatatggcccccgggcaccccactatccccgcttatacccccccggtatcccccttctcatattacacacaggtgtgaaatagtagatataccccactattctcacagagttttgaagatttttaagagagacactttgggccacacagagtttatctgcgagatttttcactctcacacagttttcgaacacactcgggtaaaacactcgtggtaatttggtggaactctggagaggtgtgcttaacactcttaaggagaagagattatggtgtgtggattcaccccacacacgagagagagaaggcacccctggagatctttttgaacgctgggtttctacacggtgagaaagagatgtccacaatggcaaacacagcttttgccacactctgagacctttccacacacacatttttggtatattggaacaagggcaacacaaaccactggagtttttttttccccgagggagaaagggtaatccgcctcacccacattgctgaaagaagaagaagaacacaaaagaactggcggccacaaacacagaggcacagtgggtgaaatgggtccctgggtgacaagtcagatttttgtaagtaattaaaaatattgtggcaggattaatagcca

SEQ ID NO: 503173 - DNA, 371 bp, Homo sapiens
  misc_feature (49)..(49): n is a, c, g, or t
  misc_feature (54)..(54): n is a, c, g, or t
  misc_feature (245)..(245): n is a, c, g, or t
  misc_feature (285)..(285): n is a, c, g, or t
  misc_feature (323)..(323): n is a, c, g, or t
cattgcatcctcaatcacccaggcctaagcaatcctccccccttgtagntgggnctacagctcccagcccccctggctaaaattttttttttgttgagacggattttttatgttgcccaggctggtctcaggctcctgggctcaaatggtcctcctgcctcagcttccaaaggcccaggccaagttgtagctttgtcccttgccctcatgccccacaaaaggttttataccctttaatgaattgnctttcataaattggttatgttggtgggccagttctttaanctggaaattgtaaattccccctgaaatgttttttcatnccgttcccctgaactaatactcccataaaggatggttttgggtgtcca

SEQ ID NO: 503174 - DNA, 214 bp, Homo sapiens
  misc_feature (189)..(191): n is a, c, g, or t
cacacgagtgagtgaggccctgctgctgtcagctcgccaggaggatgtgtgcaggcggcggagtgcaggtccggtggccttcacggtgctctcctcagccggccaagcagctgcccacggccgccattcctccttacagccccagtggcacgtggaggtggtcagtacaggcctggcgtgcaactgcgnnngctgtctgcgctgcagcccacga

SEQ ID NO: 503175 - DNA, 276 bp, Homo sapiens
cctgtcagtgcagcgagagaagctaccataaacataacaggtgaggcacggtggctcacacctgtaatccccgcacttagggaggctgaggtgggcagatcacctgaggtcaggagttcaagaccagcctggccaacacggtgaaaccccgacactactaaaaatacaaaaattagccggatgcggtggtaggcgcctgtaatcccagctactcgggagattgaggcaggagaattgcttgaacccaggagccgagatcgtgccactgtactccat

SEQ ID NO: 503176 - DNA, 400 bp, Homo sapiens
aatcagtgatacacccgcctctaactcccgatggctgggattacaggtgtgcacaccatgccctgctactttatgtatatatagtagagatgggtttcaccatgttggccaggctggtctcgaactcctgacctcaggtgattcacccgatactcggactcctaaagtgttgggattacaggcgtgagccactgcacctagcctgtgaccaggtcttgcgagtagggcccatatgatgaatgggatcagtgtcctgacaagagaggccagaggaagcttgtatgtctctcccgccatgtgagatgcagtgacaaggcagcagctatgaagcatgggctgacgtgagacgctgactggatctgttggcacctccagcttgaaatacccagactccagaacc

SEQ ID NO: 503177 - DNA, 421 bp, Homo sapiens
tgtacaccctccgaggacgaaagagatccttagtatctgtatttgatagggatgtttacacacgtggaagcttccggtttattcacaatgaggtgagacatctaccagcgctttgagacaaagctttatcttttcctatgatctcttctctaaagcagcgtcacagggaaaaaaagggtttaaagagaaataacttctccgggcaaaaactgaggttagcgggcctatcagctgtttcttctcactccaccactgctgctgactggaggagcagcctggaaagcagccgccctcccgcaaacaggttaaccacattacctattcctgtggcggaggcaaatggatggtcaaacctaacggggtagtgctgaagttcggggacaaaagcccatcggggagtggtataggattatttttggac

SEQ ID NO: 503178 - DNA, 530 bp, Homo sapiens
cgacgcctagaggatcccgtgcatgtgctgttaggcgcagcgatcacctaaagttcgtgcagttcgagaacagtctgagcaacatggaaaaaccccgtctctactaacaaagtacggaaattagtcaggcatggtaacgcatgtgggaggtaatatatccattactctgacctgtcttttaaaaacagagtggttgaccaggtatccttacgttagtgattctgggtcatgacagcgccaaaatccttggtgagagtacaatgaacatgcaaggatgcatacaaggttgcttttgtgtatgtcttttagaaaatgaggtttgcagaccttttgtccttttttactcgatttaaaaaattttcaacaggtatttatctgaagtaccgggtacaggccagttttttagtcgaaagaagtaagttgttttttgaactaccaccacagtcatgcaaatgaatatgagctgttgaattaattaccctatcttctacatctcttctacttcccatcacgctggcctacagcacatg

SEQ ID NO: 503179 - DNA, 1211 bp, Homo sapiens
  misc_feature (1206)..(1206): n is a, c, g, or t
  misc_feature (1208)..(1208): n is a, c, g, or t
  misc_feature (1211)..(1211): n is a, c, g, or t
ctcagcagtctggtacggtgaggatacaagaaagccactaggaaaacgtatcgatactctagtaatagaattactaacagtatcatttaatgttatttgtaaacaatggagaactgaagagcgagtgacagcatagcgttcaaccagctgcacacacttaatgtgcattactcttgcactctgtatgggaaggcaacaatttgacacaggaatggcttagagcgtgccactccagatataaagatggctcagccagtaagaggggctgaatgatagacccagtacagaccagactagtcgcattctttcccatagtcaccccgcttttgtagtggtgaagaagaaaacacgcaggctaccaagaaactgcaccttcctagtttagatgttgctgtgtgagctcttagagatgccaagagtcagatatccaggaagaggtaccctaaaaatctagtggctagcagacactagttatagcagaataaactccatgtatccaaaataaagcagcatcttaagtcagcctaagcaccagtgttgagaaactagggttccagagctgccctttctgggaatcctacaggccctgcgagcatgagacggacgtgagcagttgatacattagagcagtgatttgaagcattactttctgggctttgttatgggctattacggtcaggtgaaaatcatgggcatatagtgtaaaccacggcgaacactcatgaaacgtaaacacacagttgttacgaaaagcacatttaaagtattattagacgttaattttggactggggattctcagcgaaacctgtttccaaaagggggtgacctagcaaggggtgcccacatggggtacccgggtacgataggaaacctcacacgaacactgggaccaccgaaacgcaggcgacaggacggaagaagcgggggtacacgagacaaagaagaaacacccggaagagcgaggctacgacaacaggaagatggccaacggtaagaaacgcaccaagaagtatcacagatagacaaaagaagatgaaagaaagaataagaaaacgcgaaagcacaagtacaacagtggcaggtccaaccaacaggtaacgaaaacaagagtagaaacgaatccagcaaacaacaagcaagaccacgagcgatcatacataagaggtcctcctcgcttgcttcgtttcccgctgtcgtagtgggngnggn

SEQ ID NO: 503180 - DNA, 183 bp, Homo sapiens
actctagccgacccttttaagtaccgcgtataggttgctggagctgaaaactaaaggccgatcaatgtcgaggcctgaataggtgcgcgcgtctttccgcgctgtcttgccaaaggaccattccccagcggtcgacgccctaatgcatcgatctcgctgctcctgtctcgcgccaccctgtaa

SEQ ID NO: 503181 - DNA, 864 bp, Homo sapiens
tggctgcataaggcggctgcgggaagtggacacagggatgcggctggaggtgtgctgtcgcgtgtgatgccagggagtggaaagctcaggcatctaactggactctcgctcctgctggctggacatggaggattcggagcgaagtactgtacaggtttacttggtgtgtatgagaccttgggacattatggggggctgctcaccatctggacaggcggtgcagggaggaacgtacgagtagacagtgcttcgcgtgatctctcagcagaaaccaatgttcgcaacgggggccgctctcccgactcggaatgctgaacccaaaatgcacgtggccacgctgctcccgcgcaggggtgtggacgtgcttcatggcactatgtgtcgcccctcgaagtgcgcacgaagaaggcgtgggtaggacgtactccttcgcatggagcgccaaagctcgtggctggggccgcgtcagactgggcatggcagggttgtggcctctggcatgtgcattccgtggaaggaggcgcatggtctgatgggcgctggtgcgccctcgccgcagtgtagagccctaagtcctcgcgccgtgggagatctttgtgctgcaaggatagtcctagtccgaggatcgtgctgccccactagtgatacctgcttttgagcagcggagacaccgcacctccgcgaatgcaggctgtacggccctcgtaggctccgtgagttactgagtagggaagggggtcaggacagggctcttcgggggctagatcctgggaagtaggcctccgaacattaagagggagtcggccacttggaattgggtcccggtccaagagccaggtctcggccttaccgaggaatcccggc

SEQ ID NO: 503182 - DNA, 463 bp, Homo sapiens
ctattccatggggatcgatggacaatactcgcaccgctactatggtcgagcgtggatccctcgctcatagaagggatctgtctgatgagtacagatctggcagcatgcatgtttgtctgtgaccgtcattctgcaacgttactgattggtaataccctggagtaaaaagccgattcgctccacagtcctcagctatggattggcatgccaacaagctttttgctggcatgcaggatcatgtgacttcaaaatggctgagtgttttctgcctacattaatacgaagtggatgaaaagccagccagtacgccctggggcagcaaagatgccttttgggcatgcctgatgtcagagtttggtggcagtggcactggtggctgggtccatggggtaagtttctctgccaatgggagccgtctgggctgggtcagccacgagagtaccgtgtctgttgctgatgcctc

SEQ ID NO: 503183 - DNA, 665 bp, Homo sapiens
  misc_feature (460)..(460): n is a, c, g, or t
  misc_feature (649)..(649): n is a, c, g, or t
gggcgcgtggcgatagcggcccgggggaaagcggaccaggtaagggccccggggtcccgcgtcgccgtggctaggccagcagaggctacaccgacccctcccgacgagcgcagaacagcgcaggggataccccgccagctatatactaccacaccccaacatatactaagggaacataagtaggtacccctaggggtaggggaagcagtaggcggctaggggctaccaggggcagcagagcaaccaagagcgataggaaaaccatatacccgagtacctatagcaggaaaacggtagaacaccacggggggcgaggcggccgagggtagggagcggggggcgggagacgcggggcgctaggcagtagaggagggccctaaggcggagaaggagctagcgtatccgctagcagaagccccccggtaccccagaagccgagccctaactagcaggtactagnggggccaaggtagtaccgggggggcacctaggtaggcggaggaataggggagaaggaggagactaacaaggatagggcccaggagtaatgaggagtaccaagagagaaccgagcagaaaacaggtactacagcataggaaaatagccaaccaagaaaatagaagaaagaggagccagtagctaaataanggggagccctaggccc

SEQ ID NO: 503184 - DNA, 243 bp, Homo sapiens
  misc_feature (5)..(5): n is a, c, g, or t
ggcangggatgaaggcgcgtaataaagacgccttgccgtgtttctgtgctaaccgctccgcgagcattccgtttaccgcttcaattgttattccttgtggcggggcaaacatcgcctcgtctgacatagccatcaacagtccttattaatgagaaatccttctcacgcaatttttctggccatcagatagatggccggttcctgcacaatttcatccaacagatgaatgaattgaatgctacg

SEQ ID NO: 503185 - DNA, 218 bp, Homo sapiens
  misc_feature (31)..(31): n is a, c, g, or t
ggtgcagtgatctgtgatcaaccactgcacntccgccctggcaacagagcaaaaccccgccctttaaaaaaacaaaaacaaaaaagggcgggcatggtgggccctgcctataataacttgggaggcccgggcaggaggatcaaatcaaggcaggtggtcgagaccaaccaggccaacctggttaaacccgtccccaccaaaaatacaaaaaaaaaaaa

SEQ ID NO: 503186 - DNA, 425 bp, Homo sapiens
  misc_feature (6)..(6): n is a, c, g, or t
gagccnttacccattcaaaccaccacattcatttcatctcctttcaccattttatttaccgcagtattttgagacccatactgatcttagttcttgcccattgtacatggagttcctgcatggttagaaatttttatttaacatatccaactgaatcatttaaaggctttttatctttgaagaatacagagattctggagccgacagatatcaatagcaagtgtctgccactttgaagtgactgggattccgatcataggtggtttggacatttttgaaggtaaaaatgtataaaactgaaactggacttcatgctcatattttattaaggagaaataccttcctaagttcaatatagaatccaactggttccaaagtaatgctgccttctgtttggctattgcttgtaatgcatttgtcgacgc

SEQ ID NO: 503187 - DNA, 239 bp, Homo sapiens
accccaggcatgtacggaggcgttatggcccggaggcgttgaatggcccggaggcgttgaatggctcggagtgcgttgaatggcccggaggcgttgaatggcccggaggcgttgaatggcctcttcaaggagaactacaaaccactgctcaaggaaattaaagaggatacaaacaaatggaagaacattccatgctcatgggtaggaagaatcaatatcgtgacaattgccattcaacg

SEQ ID NO: 503188 - DNA, 338 bp, Homo sapiens
gcctactactactactactactactaaattcgcggccgcgtcgacaaagaatacattgggctgggtgccgatagctcacgcctataagcactttgggatgctgaggcaggaggattgcctgggcccaggagtttgagaccaatctgggcaacatagggacaccctgtctctaccaaaaaaaaaaaaaaaaatttaaattagccaagcatggtggcacacacctgtcctagatactcaggaggctaaggtgggaggatcacttaagcccaggaggttgaggcagctgcgagccatgattgcactgctgcacaccagccttggggacagagcgagctctg

SEQ ID NO: 503189 - DNA, 223 bp, Homo sapiens
gctcgacgttgtgttttttttgttaaaggtgagaggaagtcactcactgaagtagtgacattatgtagtgtgttaggccgttcttgtgtttcgtataaaggactacctgagactgggtaatttataaagaaaacaggtttattcatctcatgtttctgcaggatgtacaggcatggcaccagcatctgctcagcttctgaggagacctcaggaagcgtcgacg

SEQ ID NO: 503190 - DNA, 811 bp, Homo sapiens
catggtggctcacgcctgtaatcccagcacttatgggaggccaaggcaggcggatcacctggggtcaggagtttgagaacagcctggccaacttggtgaaaccctgtctctacttaaaatacaaaaattagccgggcgtggtggcaagcacctgtaatcccagctattcaggaagctgagacaggagaattgcttgaacccgagaggcagaggttgcagtgagccaagatcgtgccattgcactccagcctgggggacaagagtgagactttgagaacgaaaacgaaagaacagaacagaaaaggatgttaatgagcaataagaaatcacctgaaagtacaaaactcaccagtaataagtacacaaaaatcaaagaatattataacactataattgtgtggtgtagactattcttatcttaggcacaaagactaaaagatggaccaataaaaaataataactatggaccaggcgtggtggctcatgcctgtaatcttagcactttgggaagctgaggcaggtggatcactcaaggtcaggagttggagaccaacctggccaacatggtgaaacccatctctactaaaaatacaaaacttagctgggcgtggtggcaggtgcctgttatccccagctactcaggaggctgagggcaggagaaattgcttgaattccaggaggcagaggttgccagtggagccgagatcgcgaccatcgcactccagacctgggatgaacagagtgaaattccctttccagcacacacaacagaactatgataccttttaaagaagacgcaacgaaggattac

SEQ ID NO: 503191 - DNA, 246 bp, Homo sapiens
agtacggatgtggaagaacaagtggaaccagaaaacggatttcaggtcgggcacttgaatgtctgatttgggagaaagagaagacactgatcggccctttcttcaaataagagcagtgggaataacaaagctgttcagtggtaccctgggaatccactgaaatccggggtagggaagctccagtaccaccaacgggaaagactgggaatgcctaatagcgggtacgggcccggggtaccgagctcg

SEQ ID NO: 503192 - DNA, 349 bp, Homo sapiens
agttcgacggagactctcctaacccctatggtgttcttacacatggaggttagggagagccctggagactgacacccatggcaggaggagagggagggagtgtgtggtcctggaaaccacatgatggggtttcaaagaggaagtgaaagatcagttatatcaaatgacacttactgagatttgatcgctagatcggcaatgtagaagccactggtgaccttgtgagagcactgatggggaggagtgggagcaatgcctaattggagtgggtttgtgagagaacaggagagaaggaattggagaccataggaactcttgaggggtatcgctgtagaggggagcagagcca

SEQ ID NO: 503193 - DNA, 206 bp, Homo sapiens
  misc_feature (88)..(88): n is a, c, g, or t
caattgtcttttacgcaagtgatagcgttgctacagagaaggcagtggaactagccgccaataaaagggtatctgcttcatcgcggancaggcgcccatgaaatgccatcatctataacaacaatgaggacttccaggtcggacaagccaaggtggtcctgaagagcatggatgaccaggtgaccgttatcggggctgtggtgacc

SEQ ID NO: 503194 - DNA, 705 bp, Homo sapiens
  misc_feature (569)..(569): n is a, c, g, or t
  misc_feature (612)..(612): n is a, c, g, or t
  misc_feature (641)..(641): n is a, c, g, or t
  misc_feature (652)..(652): n is a, c, g, or t
  misc_feature (679)..(679): n is a, c, g, or t
  misc_feature (694)..(694): n is a, c, g, or t
cttacttatctcaatggctaaagaaaaaatagtgaaaataccaaatactgatgaggatacaaactggatattttatacattgctgacaggaatgtaaaatggtacagccactctgggaaagagtttatgaatttcttatcaagttaaacataattttttaatcaagttaaacataagacccagcagttgtgctcctggacattcattccagagaaatgaaaacctatattgtacttgtactcaaatattcataggagctttatttgtaatagccccaaactggaaacaacccagatgtcctacaacaggtacatggttaaacaaaccatccataacttggaatactgctctggaatgaaaaggaactaactgttgatacaagaacttggttgtacctcaggggtattatggtgaacaaaaaaaaaaccagtctcaaatggtcacatactgtatgatcgcatttatataacattcttgaggtgacaaaattattgaaatgaagaccagattaatggttgccagggatagggctggagggggtgtggggtatgttgctataagggatgacncaagagttccttgtctgatggacagtccatatgatttgtgatncgagttgatatacattgatttgaggttanccatgagcttnctgtctgaattgttggcctcatccccnatgatggtgtaactngggaccgataa

SEQ ID NO: 503195 - DNA, 477 bp, Homo sapiens
cctagaggatcctacgtcggcctagtccagctgcttcctagtagtactttcagaaggtaaatcagtggaggacctttgtgtatctgcacctcctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaa

SEQ ID NO: 503196 - DNA, 243 bp, Homo sapiens
acctacatgataacacataatgacccaccaaacccatgcataccatatagtaaacccaagcccatgaccactaacaggagccctatcagctcttctactcacatccggcttagtaatatgattccattacaactccacaattctcctatcattaggcctcctgacaaacatcctaactatatatcaatgatgacgagatatcatccgtgaaggaacataccaaggccaccacacccctattgt

SEQ ID NO: 503197 - DNA, 304 bp, Homo sapiens
ctgtagttgttgcagtgagtactatatgagggtttgaaatctgtaccaacaggtccttggacagatgcctgagcctgcccagcactgaggaaaagaggcttaataactggaggcagtgaagcaagtacagttgctgatggtgcaggtaggtctattaagaataactggcgctgaaacagcctgtgcttgagtcattggaggaataccaggacgtggaacaggtgagagcatacctggtagcattccaggcatcagaggtggtattcctggtccagagggcatcattccacccattggcatcata

SEQ ID NO: 503198 - DNA, 166 bp, Homo sapiens
gagctgatgaccccagcatgccctgtgagctgccccacatgtcagtgtactacacgaatggcttgggatggagtactacaatgaagcaatgcgcaatgtgtgcacctggaggtggggtccatggtagctccctccatgtgctcctcattccttgacgtacatgttg

SEQ ID NO: 503199 - DNA, 352 bp, Homo sapiens
gaccccgggtccatcccctttcgtgggcacacccaggtagagattactaacctccacctgcctgctctgtaggtacacgtggggctactgtccctcaccgtacacaggaaggtagttgcagacaccatcctccaattccaggtcgataacggcataaacatgctggcagtgcagggcctacaaggtgatgttcaccctgcagtcccccagagagcgaagctggccactccaaggcttaatgtcgaagggagactcatcctcaggcctttcctggagggagactgggctctccttaatgctccatgtggctgggacctggctgacgttccggatctaccaagggggatggaca

SEQ ID NO: 503200 - DNA, 985 bp, Homo sapiens
taggggggggttttttttcggccttttgggtttgggccaacccccgggttcccccgccccaggcccggcccccccctttccatgttatccccaaccatcacaacagtgttgattctggtggtggtgcgccaaaaatcgactttttgtggccagggtatgtagtcccctcgctggtatgaaaacgctctctggggaaagaattgttgtgataagtcgccccaaaataaagtggtgccgggggggaattgggtttaacaacagtggagaacaccccggggtgattccacaatatatttctgcgtgtcatcttggtgtttcaccaaaaatcccacctagtaagatggtgggggtccgggggatttcctataataggaccaccttcttgggggaccctcctttggggttccgcagatggagtgttatcacgacaaaaaatgtgggggggaaaatataaataggggggccttcgcgaaaaaaagggtgcgggggggagcaataaacacgccgtgatagtagccccccaaaaaaaacaaacaacatactaactaacacatcctcaacccaacacgctacaagaacagagtcgcaacgagatagaacaaacacaaagcggaggggcggcggccgccaataaaaataaccacacacccgggggggaccgcaatcatacgtacacgaccacacctcttacttctataggaaagcggcgcaccacccaacggatggagcatctaaataaaacaacaacgacgcggcgcgcgcctcttcaaaaaccgggctcgggggataaaaacaatcactgacacgagcagacatctagtaggagaccacacacctctggcgtggggagaaaaatgtagcgaccacaccagctaagcaatgaaagcggccggcgccacaaaacactggggtagtggtggacaacacccacatgctgcggagcgaaatgcacggtaataaagatgagcggcagaaacacacgcga

SEQ ID NO: 503201 - DNA, 286 bp, Homo sapiens
  misc_feature (18)..(18): n is a, c, g, or t
  misc_feature (125)..(125): n is a, c, g, or t
atgacccacactggagtncagtgccacgatcatagctcactgcaggcttgacctcccaggctcaagcagtcctcccacctcggcctcctgagtagctgcatgccaccacgcccagctaatttttnaactttttgtagagacagggtcttgctatgctgcccaggttggtctcaaactcctggcctcaagctgtcctcccacctcggcctcgcaaagtgctgagattacaggtgtgagccaccctggcctgattttaggcttttttttgtactggggagaagagact

SEQ ID NO: 503202 - DNA, 117 bp, Homo sapiens
gcgtagacaatgagtgcagtggtggctgctgtcgaccatgcctcaggtggagatgacaaaccacccccgagcgtcgaacaagagcggtatcatcagtgagcccctcaacaagagcct

SEQ ID NO: 503203 - DNA, 442 bp, Homo sapiens
gcgggaaccctgccatgctctgcctgtgtgccgtgcctctccttcgagcacctcctcatgaccaggcatggcagggcgtcctcttgggcctctgcctacggccattgctctgtgggtcttggctccctttggtggggaacagcgttagagaccgggatctagacacgaggtgtgctcgatgccacggggtgcctgagctttaggccctttctgtggacaggctagggaggacaggcatgctgcgtgcagttgcacacgtacatatgtaatatgtgtgtacagatctgaaacagcacagaaccgtgcctggattccgtcccaccttgcacggttctcccccacgccccatctccaccctgaggaccctggcccccagcaacagcagcatcctcacgcatctgctagggagtccagtgcacgcctgctcgagagctccagtgca

SEQ ID NO: 503204 - DNA, 145 bp, Homo sapiens
aatttgggcccaacccaaagttgagttcattcccctgttggaccagtggaaaaagaaacatgccagtgggcagaacatggtccttttctttcccgggtataaataatttttttaaaccctagtttaataaaaaccttgggcccca

SEQ ID NO: 503205 - DNA, 213 bp, Homo sapiens
acagataacggactactagaatctcagacacatgaacacaggtctagcctctatgtcatgtagccagaatttcacttagaaaataaaatcccttaatgtataaaggggaaataccggtttatctaaaacttggtttctatacaacgttgataacagatattctcattgatgccactgtaactccatatgttgtgatacctggagtctatcagc

SEQ ID NO: 503206 - DNA, 639 bp, Homo sapiens
ggccaactggtgttttacaaaggtgcaaaagcaattcagtggataaagaataattttctcaacaaaaggtgctggagaaattggatatccagaggttaaaaaaaaaagacctcaagctaaatctcacttcttatattaggttggtgcaaaagtaattgtggttttgccattaaaagtaatgtaatggcaaaatcacaattactttagcaccaaactaatacaaaaaataattcaaatgtatcatagatacatagatgtaaatgtaaatataaaactataaaacttttagaagaaaacaggagaaaatctttgagatctaaggtttctcaaagagttcttagacataacacccacacttataaaataaaaatttcaataaattggacttgcataaaattaaaaactctttatcggcaaaagactcttttaagaggatgaaaatacaagctatagactgggagaatatgtttgcaaatacattgaactacggggtcatacctagaatacataaagaattctcaaactcaccactagacaaaaaaattgaagtagaaaataggcaaaagacattaagagacatgtcaccaaataggatacatgggtagcaacttaagcgcatgaaaagttattcaacatcac

SEQ ID NO: 503207 - DNA, 298 bp, Homo sapiens
  misc_feature (37)..(37): n is a, c, g, or t
  misc_feature (280)..(280): n is a, c, g, or t
cgtaaaaggaggccatcaaaaggttttggtccaaaanccccacgggctttaaataataacgagccgtactatacggtctagtacgagctggtgcgatcgccgaggcagtctttggacgacatctctacactacacagcgagagagattacacgtgactccctccgcggcgtctacatacagcgtgctctccagatatctatcagacatgatcacttttgaccaaagaggaaggtggacgcacctgaggaagcctgaaaacagtgaaatgtgatgctacangcaaaaaaaaacaagaat

SEQ ID NO: 503208 - DNA, 172 bp, Homo sapiens
ggagactggggtgaaatccaggaggcagaagtggcagtgcgtcgagcgatctcgcgacggcaggtccagcctgggcaacaagagcgaaactctgtccccccaaaaaacaacagacaaacaaaaaaacaaaactcccgcccaggtgtggtggctcacacctgtaatcccagca

SEQ ID NO: 503209 - DNA, 860 bp, Homo sapiens
  misc_feature (1)..(1): n is a, c, g, or t
  misc_feature (77)..(77): n is a, c, g, or t
  misc_feature (116)..(116): n is a, c, g, or t
  misc_feature (134)..(134): n is a, c, g, or t
  misc_feature (138)..(138): n is a, c, g, or t
  misc_feature (149)..(149): n is a, c, g, or t
  misc_feature (151)..(151): n is a, c, g, or t
  misc_feature (156)..(156): n is a, c, g, or t
  misc_feature (161)..(161): n is a, c, g, or t
  misc_feature (168)..(168): n is a, c, g, or t
  misc_feature (173)..(173): n is a, c, g, or t
  misc_feature (178)..(180): n is a, c, g, or t
  misc_feature (199)..(199): n is a, c, g, or t
  misc_feature (214)..(214): n is a, c, g, or t
  misc_feature (220)..(220): n is a, c, g, or t
  misc_feature (227)..(227): n is a, c, g, or t
  misc_feature (291)..(291): n is a, c, g, or t
  misc_feature (297)..(297): n is a, c, g, or t
  misc_feature (306)..(306): n is a, c, g, or t
  misc_feature (334)..(334): n is a, c, g, or t
  misc_feature (344)..(344): n is a, c, g, or t
  misc_feature (346)..(346): n is a, c, g, or t
  misc_feature (356)..(357): n is a, c, g, or t
  misc_feature (370)..(370): n is a, c, g, or t
  misc_feature (387)..(387): n is a, c, g, or t
  misc_feature (400)..(400): n is a, c, g, or t
  misc_feature (414)..(414): n is a, c, g, or t
  misc_feature (424)..(424): n is a, c, g, or t
  misc_feature (435)..(435): n is a, c, g, or t
  misc_feature (442)..(442): n is a, c, g, or t
  misc_feature (454)..(454): n is a, c, g, or t
  misc_feature (460)..(460): n is a, c, g, or t
  misc_feature (464)..(464): n is a, c, g, or t
  misc_feature (475)..(475): n is a, c, g, or t
  misc_feature (478)..(479): n is a, c, g, or t
  misc_feature (490)..(490): n is a, c, g, or t
  misc_feature (500)..(500): n is a, c, g, or t
  misc_feature (508)..(508): n is a, c, g, or t
  misc_feature (510)..(510): n is a, c, g, or t
  misc_feature (538)..(538): n is a, c, g, or t
  misc_feature (542)..(542): n is a, c, g, or t
  misc_feature (554)..(554): n is a, c, g, or t
  misc_feature (579)..(579): n is a, c, g, or t
  misc_feature (596)..(596): n is a, c, g, or t
  misc_feature (607)..(608): n is a, c, g, or t
  misc_feature (616)..(617): n is a, c, g, or t
  misc_feature (625)..(625): n is a, c, g, or t
  misc_feature (627)..(627): n is a, c, g, or t
  misc_feature (631)..(631): n is a, c, g, or t
  misc_feature (640)..(640): n is a, c, g, or t
  misc_feature (672)..(672): n is a, c, g, or t
  misc_feature (680)..(680): n is a, c, g, or t
  misc_feature (682)..(682): n is a, c, g, or t
  misc_feature (685)..(685): n is a, c, g, or t
  misc_feature (688)..(688): n is a, c, g, or t
  misc_feature (703)..(703): n is a, c, g, or t
  misc_feature (710)..(710): n is a, c, g, or t
  misc_feature (772)..(772): n is a, c, g, or t
  misc_feature (855)..(855): n is a, c, g, or t
nccctcaaaatctactccataaacctcatttcctcccaaacttcaaattacacatttctcccccactcccccccccnaccatcatttctactaaatattcaccttcttaactaacntaactcacactatcatcncacnacctcacaacnancaatnatcanctcatanctaanaaaannnaaaaaaacaataaccaaancaaaaaacaaaatanctacanatattantaaaataataatacaatcccaaacatccacctcttaaattactacaaaaacaataccaataaanttatancaaatacantcttcacacatttcactcactttatttncattttatantnatttcttaanncctatatccaatnaaaccattttaaaaccnctatcaccactcnaattttacatctcnattacacttntcttttaaaanaaaaatncttaaatttcanaatcancaanattcacttttntanntagaggccctncttcttcatnatcttcantnttacatctaacaaccacaacacaccaanctcnatatccctctancctttcttcattcataaactccaantcaccatacatactcancctctcacacnnaacatacnnctccacancnctancaacacttncacaacaaatccaaagcaataccatcacccanaggacaananttntanttaaaatccacccanagttaanagagaggcatcttaaaaagccatcactttctccatcttcaagaaaattcctgtgcgcttgtnaatttctcatttgcagatctgaggacattttgcttagagatgattctctcaaatttgtaggctcctgctccaaatgtggtgcntactg

SEQ ID NO: 503210 - DNA, 857 bp, Homo sapiens
gctggggcctggccaggagagaggctcgggaaagatgagaactctgagtggacaccaaaggaaaaaaaaaaaaaaaaagttcaatgactttttccggagccccgggggtcctaaagccggggggaaatgaaccttgcttctttcgcgggcacttcgaattctattcccctccaggtgggtggtgaagccgggagtgtgagaggcatctccgtgctcatccggtgaccccagctgtactccagggggaaggcatctccagggaagagcacgctgggtcccgcaaaagcggggactgaaagaaggactttgtgactggggatgtgacgggcacggagatggagtggggggtggtggagcgcaggtgtgcatggtgacgcagttgtgtagcctccgacgttggagcggtggcgagacactcggagggctgcagagacgggcgcacgcgacggaaggccgggttccagggactaccttctcgtatgggcacgcgcagaagtaggggcgtgccctcatctcagtgtcctgatctcaggcggggacaactgccgcatgggcgagcggctcctgggctacccatctctggcggaaagggtcccagacgcattctctacctaggggaacccccaaggcacggagccgggccgaccggcagaggactacacgactctatcggaccctctgggaacacagggcggacgtcgggacccaatgcccgaccaactggcacgcctctgtgccagcacaaacacccaagcggccgcagccgcccgagagccggccttaccctccagccgcgggaaccattcactcggacagcgggcatgcgccagcacggagacgggactacggcgtcaggc

SEQ ID NO: 503211 - DNA, 203 bp, Homo sapiens
ttagtcgcgttgtttctgtggggggccagtgccctcctaattgggggggtaggggctaggctggagtggtaaaaggctcagatacacatcctgcgaagaaaaatacttctgaggtcataaataggattatcccgtatcgaatgcctttttggacaggtggtgtgtggtggccttggtatgttcttgtctcgtgttacatcgcg

SEQ ID NO: 503212 - DNA, 136 bp, Homo sapiens
agcttcctcatcaggttacccaaaagtgggtcccatcccccatccaggtgtgcttggatgttctcccccctcgaggtgtacgctgtgaaaagtttgggagccctgctttataataaaatgaaatatactacttcca

SEQ ID NO: 503213 - DNA, 183 bp, Homo sapiens
gaatgggttattaagaaataacccttagcatgtggggagaaatcagagagaggacaaggcagtctaggtccagttgatttctctttttcatattgcatttttgcttttctctcttgcagaactttgaggtgaaggcggatgacctggagcccatagtggaactgggacgaggtgcgtacgggg

SEQ ID NO: 503214 - DNA, 152 bp, Homo sapiens
gaaaaaagggccttggggcccccccttcccccttttttttcccccccctttaaaggtttaaagggttttggtttccctgggggggggggggggccccccggggtttcctttcccctttttttgggcccgtttaataaaaggggcccccttta

SEQ ID NO: 503215 - DNA, 322 bp, Homo sapiens
cacgaggggtgggcacctgtggtcccagctgcttgggaggttgaggcatgagaatggcgtgaccccaggaggcggagcttgcagtgagcccgggtcatgccactgcactccagcctgggtgactgagcaagactccgtctcatcaccctcaaaaaaaaaagaaaagtgtgtgtgtgtgtatatatatatatatatatatatatatatatgtagtgtgtgtgtgtatacatatgtatgtatatgtgtaaatatgtgtgtgtatatatgtatcatgtgtatatatatataaatacgtgtgtgtgtgtgtgttttatacatagaa

SEQ ID NO: 503216 - DNA, 337 bp, Homo sapiens
ctagcactgtctttcgtaaaatctctcatctgttcaacagccgcatttaccatttccggtagtcccaaagtactcatactttaggtcatgtaaacagcatgggattaatcatgtcgtaatccgggtatttatcatgtcggaaacttgtcacccacatgccagaattggggattctggcacacaccacttcgtgtggtcactgtaatcttccccaacagcctagcgattcactatcagcaataaggagcccatcagctttagtggtaagatcgtaatcagtacagtcagcgataacagaaccagggttttctcagaaacacttctgctagcaaaacca

SEQ ID NO: 503217 - DNA, 303 bp, Homo sapiens
atcctacatacctcatacacatcatacacacacaatcaagattaccacaccacatgccacacaacctacacaccacatcatacacagcatacacacgcatgacacatagcacataacacaccacatgccacacaacctacataccacatcctacacaccacacacaccacacacaccccataacataccacatcacataccacacacactgtattatatatcatatacactccaaaccccacacgcattacacatcaaaccacacacacaccacgggtgtgtcagcgcgagggaatccctcgt

SEQ ID NO: 503218 - DNA, 1174 bp, Homo sapiens
  misc_feature (1174)..(1174): n is a, c, g, or t
ccggccccggatcgcgagcctggagccggagccggagccggggccggccgggctgctgaggcccgagcggcaggatgcgcagcgcgggagcgctgagccaggctgcccagtctgcgatgaagcttgcctgcctgcctctgccctgccctggctgcctgcagcccctgggctggtccatgggtgctgggcactggctgtcgctgcatgtgcgcctgtgcatgcccatggatgggcagcctgcttaggctgctgcagctcattgtcccctgcatggtctgcatgccagtggctggctgtgggctgcgcccatgccccgggccccatgggagctgccctgctctgcgggtccccacactccattggaccgccttcaacgggcgggccatgaggccctggagcgggctgccgggaggggcctccgagccggcctgcccgacacgcacaaacaccaattgcacactcggcgggccacggcctttcacaacacatgtgccccagggacccaggcacgaaaccccacagacgaagccagctcagaagaaaacatcacggaactatggcaggaaggattccggtccttaggacaacccgcgacgcttagcaccacgaaccaaacgggacgctgccggagcgggccgtaaaacccacaacagggggggccccagaaggcgaaccaagttggagtggccgaggatcgcgccacccgacggtgccatttgcaggatgtacgacggacgaccaggaaacggagacccgacaagatcacacaaggcacacgcaccatgacataggcacacgctgtgccggggacaaaaacggattaaccaggacgacattttcaaacgaagaggccccaccaccacggtcatgccagagaaaggacttaagaaagtcgccaaacggttttcccaaacgacagggacaacgccgggagtttaacccctcaccaggacagccactttggaaacgccattttcgcacgcgggcgacagccggaccgcgacatgccgggccccggcgtggggtttgggtcaaccccaaaatagaccgtttcacaatcccgagatcgcgactagcagagcgccaggtttagcagggggcagtaccattggcgggtatcccaaggtggaaacaccccccggtggcttgagacttgcctcccaacaagcttcgn

SEQ ID NO: 503219 - DNA, 101 bp, Homo sapiens
tcataaactaggcacaggaagagatttatcagatgaaactctgttttattgccgtagtcacaatacaccgcaataaaagtcatgtgaaagcatgtgatttc

SEQ ID NO: 503220 - DNA, 180 bp, Homo sapiens
  misc_feature (24)..(24): n is a, c, g, or t
atctagaggatcccggggctcaangtgactcctcctgtggctcgcctcccaaaggtacctgggatacagggtgtacttggccacaccttacgcccagttttcttttctcaaagtgtcttcgtcgggcttgggcatcaggactacggtgggcctcatagcatagtccggaagagacccgca

SEQ ID NO: 503221 - DNA, 255 bp, Homo sapiens
  misc_feature (80)..(80): n is a, c, g, or t
  misc_feature (104)..(104): n is a, c, g, or t
  misc_feature (159)..(159): n is a, c, g, or t
  misc_feature (162)..(162): n is a, c, g, or t
  misc_feature (169)..(169): n is a, c, g, or t
catgaggatcccccattggtcgagacaaattagttgtggcaatgaaaatgattagggatactagtataagagatcaggtncgtccatttagatgttgtgtactngctatcatctgtctggaggttagttggattagtcgtggctgggtggtgactggcnggncgttgangagatatttggaggtggggatcaatagagggggaaatagaatgatcagtactgcggcgggtaggcctaatttctctcggaccaatg

SEQ ID NO: 503222 - DNA, 153 bp, Homo sapiens
ttccatctccgtcccaccgtcccacaaaggagagctagcagcagggagggcttctgccatttcctgagatcaaaacggttttactgcagctatgttagttgtcagctgaacctgggtaactagggaagactaatattaacggaacgacaatgt

SEQ ID NO: 503223 - DNA, 225 bp, Homo sapiens
ctctacaggatcctgtgcacgcgcgagtactgtattcgcagatgcacacgcgagcatcaaaccgtgtgtcaccaagaggtccgtatggacgaagttgttgcagatcggtgtggacgaagtcaacaacttcgtccatactgatctgtgtggtcattcggcgtgtgcaacacgccgaagccccatacgtccgagagagtcaacatgtcattgtggacgaagttgttg

SEQ ID NO: 503224 - DNA, 340 bp, Homo sapiens
  misc_feature (220)..(220): n is a, c, g, or t
caaggatcctgtgggcaggattactctgattttgaaagaaggtctagtgtgggaataaatgctatcaaatagtatcacatactacagacgaaatcttttatgaaaggaagagtcaatcaatgtggaaaacttgattttttcttatgtgaagaaattgccacagctgccccagcattcaatgacttcttccctaaacagcaacagtcttcagtgtgaaggncaaaccctccaccagcaaaaagatgactcgctgaaggctcaggggattgttggcattttgtagcaatatagtatttttaagttaagaatatatacgttggttttagatataatgctgttg

SEQ ID NO: 503225 - DNA, 368 bp, Homo sapiens
atccatcaaagtgagcgagtaaaccaaggaggaaaaaaagttagatccagccaggcgcagtggctcacacctgtagtaccaacactttgggaggccgaggagggtggatcacctgaggtcaggagttcgagaccagcgtggccaacatggtgaagccctgtccctactaaaaatacaaaaaaaattagccaggcgtggtagtgtgcgcctataatcccagctacttgagaggctgaggcaggagaatcacttgaacctgggaggcgggggttgcagtgagccaagatcattccactgcactccagcctgggcgacagagcaagactccatctcaaaacaaaacaaaccaaaacaaacaaaaagtctga

SEQ ID NO: 503226 - DNA, 141 bp, Homo sapiens
tgaaccgtatccagactcaggtacctctgatagtggtctgtccttcccttggagaagagttcattggaaggtgttgggaggtagcagttcttgtcggcagatttccttcaagtaattatggagctaagtctagtagagaga

SEQ ID NO: 503227 - DNA, 613 bp, Homo sapiens
tccctggagaggaatacctattatacactccacacagattcgcccagtggatctggtaaacgtaacttccccctgaatatgagaagatatgctttcaagtcccacctggcgaagtctgaaatggagaggaatatcttaattataacacctccaagcaccagaattcccttggatctgggcccttaataatgagcccccctataatggagatttcccttgtccgacacgaggggtggaccacaacattttgcagatgtagctggtggagctcagcaccagaccctggggccacccgagagtaccattacattttctttgaagacactccagagattttgtcaagagcccacatagagccagaccagatgctgaaagacccatagatttccatggccaggctttggccccggatggaaccaaatcctaccatctgaagctagacatagtgctttgtaaatgattatcatccttataatcactggggggaaaaatacccgattttaattatatagttttgggctttcatttattatcatttttttttgtaccaatttattatttttagatttttgtaaaacatgatagacataaaattggtgttatttcctcccca

SEQ ID NO: 503228 - DNA, 451 bp, Homo sapiens
tgacctagagttacccctggtacgggagtggtgttagatagtgggtgcagaggtggatcacagcacgggccttaggactttgcggcgaggccctgccaccatccacagataaccactctcctttggagagacagggcttggctgctgccgtgccttagtagaaactgaatgtttgaccatgggccaccaagttaccctgtgatctgagctgcccaccatgaactggggaattatctgacccacgtagccataaagttgggcatgcacagcagtgctccgtcatccaacagagaggtatatacatgatccggcctgagcacatcctgaagacacaagtaagttacatgaagaagtggcccaaatgcccgtggtccccattcctgctatgaagacacaagtaagttacatgaagaagtggcccaagtgcccgtggtccccactcccgtaccag

SEQ ID NO: 503229 - DNA, 481 bp, Homo sapiens
aaagaaccattatgcagacaccagcagtaaccaccataagaatctaacatttgatctcctgcattttccatagctgcggatgtaaaagatgtcgtaggcggctcaggcatatgacaatctcagcgactctcaacaagagccatctaagaagtgaagtctcggaagggcccgtatagccctctcattgggaccagaatgtgcaaggtatggagattcaaatcgacaaggcccatgctgttggtcagcctgtaccccttgcgaataagcctgtacctgctcaatctacttttccttcaaaaacaggggggatggagggaggaacagcagtagcaacatcctcattaacagcaagataatgattgtaaacctgtggctatcggtctaccccattcaaaaaacaaccaagataaaggcctgcctcggccagataatagagatcatagatcagaaggcaatagaggcaacagctcatcttacagag

SEQ ID NO: 503230 - DNA, 1113 bp, Homo sapiens
tagtggggtgatgaggaatagtgtgaagggagtatggggggtaattcatgggtgggcaccaaaatggaacgaaatatctggttcgcttcattctagggcgccccacaatcctaaggcctaacccgccgcagtactggatcattctatttccccctcttattggatccccacctcccaatatatattctcatcaacaaccggagctaatatcaccacccaaaaatggatctaatcaaatctaaacctcaaaacaatatggataaacctatacacaacatctaagggacgagaacctggattcttcttatataactaagtaaatccccttaatccatttttatatgggccaaaaattaaactctctcttgggatatccctggggctacattctctatttacaaaccaacacacccaattatattttataaaactctaagccatggggcgcataccctcttaatggaggcggggcggcacggaataatataagggctttccggcttctaaagattacaaattgggccctaaagccacatttttcttaaccacaaagggggcacacccttaaaacccctttaatccccctataaataagttttatttattcggaaacccatcaagccttaactctattcaaccgaataagccctgtgggctgtaaagcttaaaccggtgtaaattttcactggggggggccacttataatctaggcgacctaaatggggacagggccaacctcttaggatatatccaacccataaaccttaccctctaaaattttaatctttcccaatcctaattgccacgggtatcctagaaaatcgggggggctaaatccaagcctaagtttcaccttttaggaaaagcctcttaacctggcggaaacctttaaacagataacaaacaacttcgggggctatatgcaggggggaaacaacggtaaaaacgggcacgggcatcattgttctctgccccctttttggaaagggggaatcccgcgccccaagaggggaaatccgacgtacgattattctaacaaacacaacggaggagtgacattggctctcgccacgcaaccccgactaattacaacatcactacataatcgcaccg

SEQ ID NO: 503231 - DNA, 206 bp, Homo sapiens
  misc_feature (1)..(1): n is a, c, g, or t
  misc_feature (3)..(3): n is a, c, g, or t
  misc_feature (19)..(19): n is a, c, g, or t
  misc_feature (35)..(35): n is a, c, g, or t
  misc_feature (92)..(92): n is a, c, g, or t
  misc_feature (111)..(111): n is a, c, g, or t
  misc_feature (120)..(123): n is a, c, g, or t
  misc_feature (162)..(162): n is a, c, g, or t
  misc_feature (166)..(166): n is a, c, g, or t
  misc_feature (185)..(185): n is a, c, g, or t
nangaaatatcaatctagntcaattgagtaccttnaagaattattaacctgagccgggcacagtggctcacacctgtaatcccagcactttnggaggccaaggtgggcggntcacctgcnnnncgggatttcaggaccggcctgggcaacatggtgaaaccntgtntctactaaaaatacaaaantttttttggtgtggtggtgcg

SEQ ID NO: 503232 - DNA, 221 bp, Homo sapiens
acttggacactgaggactatatgtacactatgtctaaaggataaaagaaaatttaaaaataagcatcattcaatcatgataggctacaagaagaaacctcattgagtacacacatagtggacatgtagccaggcatggtggtgcatgcctagtagtcctcagttacttggcgagctcgaagcaagcaggatcacgttcaaccccagctataacctgcacca

SEQ ID NO: 503233 - DNA, 161 bp, Homo sapiens
cgaagaagaaggcaagaagctgcactgtggcaatgtctccatactgcttatgtcatgccttgggatgatgagacggacattgccagctgatggctgtgtgtgctctatccagctgacgggctgtctggggggcttccaagctgttgcccgtgcgctacgcg

SEQ ID NO: 503234 - DNA, 816 bp, Homo sapiens
aattcggccgcgggcgggcccagtatgataatcgagggacgctggcgtacatcttatgaagaaattggcttggagggtggtcacagatggctgataagcattacatgcccacttcttccacttagtagaaccagagcagtgtacagacatgtcgacactcaaagtacattatccaagagagaatgctggaactcaacagagaagtgacagggaacaccaaaagtggggaaggaggaggagaggcagcctctctgagactgggttcgcgctgggcatcaggagtgaattcccaattatagggaagaggtgagtagagatgtagtgggccagccctacagggtctgctgagttattactccccatgtgtggacgcacagcgagattgtagacactaaagacagcaacgacgagaaaatgatctaaagacacgctgggcccgggtgacaagtaccaccaagacgtagagaccagtagcatccctgaatgccagactgtagctgttatctcatcggatacaagacaagggggcagggtaaggagtgtgagccatctccaatgatagcgtaaggtcacatgggtcacattgtccacgtggacggggggccccttcccctgtttggcagccgatctggcgcagagagatgggcgatcacagcttgcgccttttttctgcatttcggagacttgcactcctgccggagctccggactggatctcgaggggcccggtgtccgggtgtgcactgatggcccggcgggccctagggtccgtcctggggcggtcctccgaccgcggggcctcccgaggtccagggtg

SEQ ID NO: 503235 - DNA, 427 bp, Homo sapiens
gggatgaaagattttgaggagatgaggaaggctgatatctttcagagcgtcccgtaatcttggaatctaaggaattgctttaggctggattacctagaactttgccactgacttgagttcctgaactatggcacatgaatatgggggctaagaaattactcctctggattaataatcaattaacaggtctgaaagctcatccttcagaggattatacggcgcctctgctcaatgaaaaaccatgataattactaggctctaaaataaacattctgatatacgccgatgaccccaaccatttttaaactctctcggctgtcgctttcggccagtcttctgctagactttggcacatttacccatgcgggacgctttttcaccttaattggcctctgtttagggagtcttattaccattgggccccctt

SEQ ID NO: 503236 - DNA, 515 bp, Homo sapiens
tgctggggtcacaggtgtaagccactgtgcctgccccctccatctctaaaaaaaagaaattttaacaatcctttaaaaaattgggttagtggtttgagctcatgccccatgagagtctaagaatccccagcctgtctagcatctgcttgttgggccataatgctagggtaagctgagtcccattgctgcacaggttatagcccacctaactctagcccatcactgactcattttggttcttgttctaaggctgttctgtcctgtgtacagatctgcatggagcttgtactacttttctgttgccactgtagcaaactatcacaaggttagtggcttaaaacaatacaaatgtattatcttagcgttctgcaggttgtaagtccaatacagtcctcactttgacaccttaaaatcaaggtgtgagcagggctgggtactttactggagactcttgtaaagaatctgctcctggcttttgcagctctagaggcaactgttgtgtcccttctcacttt

SEQ ID NO: 503237 - DNA, 1447 bp, Homo sapiens
  misc_feature (135)..(136): n is a, c, g, or t
  misc_feature (150)..(151): n is a, c, g, or t
  misc_feature (167)..(168): n is a, c, g, or t
  misc_feature (180)..(181): n is a, c, g, or t
  misc_feature (189)..(189): n is a, c, g, or t
  misc_feature (229)..(229): n is a, c, g, or t
  misc_feature (279)..(279): n is a, c, g, or t
  misc_feature (283)..(284): n is a, c, g, or t
  misc_feature (291)..(291): n is a, c, g, or t
  misc_feature (313)..(313): n is a, c, g, or t
  misc_feature (404)..(405): n is a, c, g, or t
  misc_feature (436)..(436): n is a, c, g, or t
  misc_feature (983)..(983): n is a, c, g, or t
  misc_feature (1099)..(1099): n is a, c, g, or t
  misc_feature (1152)..(1152): n is a, c, g, or t
  misc_feature (1170)..(1170): n is a, c, g, or t
  misc_feature (1178)..(1178): n is a, c, g, or t
  misc_feature (1193)..(1193): n is a, c, g, or t
gccgaccagttccgcccgggcgcgaggaccggccgcaggaagttgctgcaaaacttttttggggggtgcagccctgtgccccccgcgcgccggggcctgaatgcgcgccgcgtagggtccccctgtggccgagannggtgtgccctggannggaagatgcgcggtgnngtggctgccccnngcccctgntgccctgtggtgctatggccatggtgacctgtgctgtgcntgtgtgtgcgtgcccctggctggctgacactgaactggctgtggacaatngcgnngctggcntaccctgcgctgctggccgagngacgactcggcctcgccccccggtgccgccagcgacgccgagcctgggctgacgaggagcggcctggggctgcaggtggacttgcgtggtnntgcggggacaagtcgagcggcaagcattacnggtgtcttcacctgcgatgggctgcaagagctttttcaagcgaagcatccgccgcaacctcagctacacctgccggtccaaccgtgactgccagatcgaccagcaccaccggaaccagtgccagtactgccgtctcaagaagtgcttccgggtgggcatgaggaaggaggcggtgcagcgcgggcgcatcccgcactcgctgcctggtgccgtggccgcctcctcgggcagccccccgggctcggcgctggcggcagtggcgagcggcggagacctcttcccggggcagccggtgtccgaactgatcgcgcagctgctgcgcgctgagccctaccctgcggcggccggacgcttcggcgcagggggcggcgcggcgggcgcggttgctgggcatcgacaacgtgtgcgagctggcggcgcggctgctcttcagcaccgtggagtgggcgcgccacgcccttcttccccgagctgccggtggcgaccaggtggcgctgttgcgctgagctggagcgagctcttcgtgctgaacgcggcgcaggcggcntgacccctgcacacggcgccgctactggccgccgccggcttccacgccgcgcctatggccgccgagcgcgccgtggctttcatggaccaggtgcgcgccttccaggagcacggtgnacaagctgggccgcctgcaggtcgactccggcgagtatgggtgctcaaggcancgcgctcttcacgccgangctgtggnctctcaagaccggcncacgttgagagctgcaggagacggcgcaggtggccatcacgataagggcggggcagaaccgccaagccagcgcacggggcatgcaggtggagccccggcctgacgggccgcgtccaattgccaggtactcagggcgggggagagcctgggaataagacagggataagagaacaggcaggtggaggaccaaggcggtagggagggcaaccagcgagggaggaggaagcacgcaccaaagaagacggtggagaaaa

SEQ ID NO: 503238 - DNA, 500 bp, Homo sapiens
aaggggtaatgttggcagcaatcttttttttttgccaactcgcttgtaaggctcaggcgcgggcctcgtttgctttacgaaagacgaaccccgactcccaaaaaaaaaaaacagagctttgggccccgggccccacctcagctacaaaatttgaatgagagctacaccaagaatttggggcaaacgtacgactgcttcggcaactcgttcttggaacggacccgtgccctagcccacgccgagggcttaataaaacttaagacaacgaaaatcggaccttcccaccccataaaaacccctatattaattcctgaaagcctccctcacccccgatgcacaaattaaaccactccaaaggccgtggcttctttaaatctggacgcctcgttggaagggcaaaatgcccgggtaacaatgctctttaaaaccacacggttggggcgtttaaattctacaattgttacctaacgggacctgggaacccggccaaaattgttaag

SEQ ID NO: 503239 - DNA, 199 bp, Homo sapiens
tgctggggtcacaggtgtaagccactgtgcctgccccctccatctctaaaaaaattagacgtggtggcatacacctgtagtcccagataccagggagactgaggtgggaggatcgcttgagcctgggaggttgaggcttcagtgagcagaggtggcacctctgtactccaaactgggcgacagattgagaccctgtgtc

SEQ ID NO: 503240 - DNA, 526 bp, Homo sapiens
agagtcacactgatgaactcatttagggccaaaggaagaaggggaggcagatttcccctctagatgagtgaagggataggaggctggtgaacccaacggctgaaatgtgaagggtgagagggtagggtgagtccccccagccctgagggatgaagggtctgaagatggcactgcacggtgacagctgcagtgactcaggagctccgtttacaaaggaacatgagtgaggaacataacttaatttttttttatatctgacctgaatttctgttttcctcccccattccccacatggtagaagtgtaatctcacatcaatttggggaccctttctttccccagggatgtgtagaacttttggggatggcacatttgaagaccttagggagctttgcattttaaaggctgaatcccacactctatcatacatattaatatttacctgcattccacattaaagggttcagtttatgacttgtgtcctgtcttgtagatacttaattaaacggtattaattttgaaaaaaa

SEQ ID NO: 503241 - DNA, 896 bp, Homo sapiens
tttaatcggccgaggcacctcccgtgtggctgtgtggggaaatgtctctccgaaatgcgtgaatggggattggattgagtgtttttatttccccttttgttgctgggtgtgcttggtgtgcctgtgatctgatgtgctgtgctgtgtggtgcctgctgtggacttgggtgtgctcaccctgctgatgcctgatgatgtgatgctgctgacaaatgtgattgctgtccctgccggtggtcacatgtctcctgctgtgcccacactttgctgctgctgtgctgccctgctgccacctgtgtgtgatgccctgccctgctgctgcttgagaacccatgtgctgtcctgtgtgcttggtgatgatgtgtgtgcctggtgatgctgtcctgcagtgtgtgctgctgggccctgtgatctccctgaccccaggtgaatggggatccctggatgcttccttgtgatgtgctggctgtgtgctgtgcctgtgtctgctccatgtggaacctgctgcttgccctgctggaaactcctgctgctgcctcctgctgtgagttggcccctctgccgctatgccccccatggctgctgctggggttcttgtgggcccttgcgatgtgtcccccccttccccctgcgggtgcttcccaagctgggctaagtgcgggcttctcttcctccctcctctgtcgcctccttttcctccccctcgttcaccttttccttccctctatccatccagagccccgccaaagggcgcactgatctttctcatccttccctgctcttccttctctcactcctcctcctccttgtggaaatgggcccgagagggcatgtgggggccctctgacgttgcccggattgtgtgctgcgcccaattggcagtggtacggactacg

SEQ ID NO: 503242 - DNA, 202 bp, Homo sapiens
aaccccccccgggggtttagatttttttaaacccccggggggggggtggggggggggacccccttttttgtttccccctccttttttcccccccccgggggcccccgttttggggtttttttttttccccccccttgtttgggtcccccttttttttgggtttttttttgggggggtttttaaaccctggggaatttgggga

SEQ ID NO: 503243 - DNA, 284 bp, Homo sapiens
  misc_feature (17)..(17): n is a, c, g, or t
  misc_feature (41)..(41): n is a, c, g, or t
  misc_feature (44)..(44): n is a, c, g, or t
  misc_feature (89)..(89): n is a, c, g, or t
  misc_feature (112)..(112): n is a, c, g, or t
  misc_feature (121)..(121): n is a, c, g, or t
  misc_feature (142)..(142): n is a, c, g, or t
gagaggggttgaagtanattagtgaaggatgtgtgtttatntantgttaagtaggagaaaagttttattggaaagatttaaataatgantttagaaaaaatttgaaagtaanagtagtgtntatattatttaagtatggaanattttaaaaattggtagaatttgagtgtttttaggttaatttggtggaaatgttgttttttgaagattaagattttaggatggtaattatgttttgatgttttgatttgttttagtattaataaattgtatatttgttttga

SEQ ID NO: 503244 - DNA, 128 bp, Homo sapiens
tctgaaccaaaatacttacattcatttatgttctcattgcagcaacaagataaacaagcataattccatggccaaggagttacaaatagcaccaagcccaggaaccttgagcatatctataaggcaaa

SEQ ID NO: 503245 - DNA, 784 bp, Homo sapiens
  misc_feature (306)..(306): n is a, c, g, or t
taggtttgagggggaatgctggaaattgtaatgggttatggagacttgtcatataagtaatgctagggtgagtggtaggaagtttttccataggagggtgtatgagtttggctcgtagcggaactcgggggatatgcgtgttctcgaatcttcattaagaaacagggaggtttaaaagtttagggctcttgggtgacaaaattatgttgtgtgctagagtcttcaggggaaaaggtgcgtctcactattgttgtgttctcctatgagaaagaaatttgtgtagtgtgagtgtgaaagggtgtgttntatatttatctacatatacatgtgttgtgtgggtgtatatctctcgcgctatattgtaagaaaaatagcgggcagaaaggggtcgccgtggcgggcagataatctcagagtggtttggagagcccgtggagaaacatagtctctcggagactctcccccctttgtgcgggccaagtgtctccgcacaaggggggggttctcggcggtgtgggctcctcgtgacaataagtgtgggtggggagatatataaatctccattatttttattgggcccccacaggggttctccacgtgtaagtgggcccacgggaaaggataaactccagaaaggggtgggtcacctgtgggtgcttcgggcccacctccagggggggtgcggaccagcagcgttctttcagagggggagcccccacctttttattttaggtaagtggctctggactaggttaggaaacatgtactgggcccaaaggggggg

SEQ ID NO: 503246 - DNA, 102 bp, Homo sapiens
ccccagagcacgagaatgtgcagtatgctgccttgattttgaagcaatcctggtgcagcctggcagccctccagataagacccaagtgcccatggtggtcat

SEQ ID NO: 503247 - DNA, 1121 bp, Homo sapiens
  misc_feature (619)..(619): n is a, c, g, or t
agaaactcaagtcatcttaaaaaaaaaaaaatacaaaaaaaatttacaaaaaaacaaacacaaaaaaaatatcttttttaggccagagtttttctacagggtattaagtgaattatttttcttaattccttataagttttatgtgtttaatatttcttaataccggtagcattaatttatactttggtagcaacacaatatttttataaacagccggtgctgggctcaagtcttcacgaggggtttaggcagggccatctgggggaccctgtgtaccatgtactgtattttaaaaaaaaaaaaaagttaccttttgtccccctttgctggtgttaatttaacaaaaagattggttggtggtggcgggctccggtatcgggggtgggttccaacaggctctccaggggaggtcccatttgcgcatggggggttagaagtttgcagcgggtctctgggtgaatttgttaaacccccggagaaccaacattgtgaaggggttaattgagggggtttccgggttggcccttggggattattgggttcccctgtgggtttggggtgccagtttcctccatttatacaggccaaatatcagttctcagtgattgtttcaaaaacntttttcgcggattgctcacacgtgggaggaaaggggaccggaaaaaaaacagattttttacccaaggttaaattaacatttttaaaacctggaagcgtggataacatggtcagacatgtgtaataacccttggttcctggtccctgggtcccacaaagttggaacctattccccagggaaagaaacagggaaaggtgtcccctccggttcctttaaagttcgccaatggcccagagcggggtatattcagaaacctccccgtagaccccccggaaattttttgggacatatttttcccccgagtggtgttgtgagcccccagggccaaaagaattatcttttaccaggtcaagaagaaggcagcatggcttaaagaagcacctactaccgagaggtgaaatcggggtgttcaccacaaaaacaaccctgtttggaaagaaccacacgtaacaagaaatcacaaaaaagtacagcacaaaaaaaggacggcgggcgaacatag

SEQ ID NO: 503248 - DNA, 343 bp, Homo sapiens
cagggtctcactttgtaccccaagctggagtacagtggtgtgattatagctcactgtaccctcaaactcctgggctcaaacaatcctcacacctcagcctactgagtactaggacaccaagtgtgcactaccatacccagttattttcgtgtgtgtgtttgttttggtacagctggggtctcgctatatagtccaggctggcctcaaactgttcgcctcaagcagtcctcccacctcagcttcccaaagccctgggattacaggtgtgagccactgcacctggcctgtcactattagttttatttttaattttccccccccacagattgtaaccaaaaaaaca

SEQ ID NO: 503249 - DNA, 407 bp, Homo sapiens
catagtatgaatggcatatggactcaagtgaatacttggatgacacctatgtccctctgcttctcatcttcagctaatgtactatctcatgcttcctagtgcaccataacgttcaatgtactacctatgcacaaactggacctatgtacattatgtgatagtaatctatgtactcttttcccgtacacatgacacacagcagagacatatgatgtataccattggcatcaatgtcaaaagtgacttcaaactagagtgaacacctcggggtgcaggaggtatgccttgtgagtacaaattgccaagcagtgtatgaaatcctttgtcatggcatgctcgcctaacataaaccctgaataagcacaccaggctggatgtcagaaaaggtagtgaaggtctgtgtactg

SEQ ID NO: 503250 - DNA, 289 bp, Homo sapiens
  misc_feature (199)..(199): n is a, c, g, or t
  misc_feature (215)..(215): n is a, c, g, or t
  misc_feature (231)..(231): n is a, c, g, or t
ggatcctatttatacatgatgctgggtatgcgctagcatatgcagaagattgaaacttgagccctccctttcaccatatacaaaaatcaactcaagatggattaaagacctaaatgtaatacctaaaactataaaaccctagcaagaaaacctagtgaaataccactccatgacataggccctggcgaaagatttcatngagtgaagactccaanaagcaacgtgcaacanaaaacaaaaagttgacaatgtgatgacctaattaaactaaatgagctctgcacagcag

SEQ ID NO: 503251 - DNA, 485 bp, Homo sapiens
cgtacttcagatcggctaacggctgtgggatgcatctcggcatccttctgtttgaagtcctctacagggcaacggctgtggccgcatagccgctgcattcaagtagttatgtacatcgcagagagtcccaggccatgtggccaggtgggggaggggcgtcatctcaccaggcgccgagtggtatcatcgtcaccgcgtcgggtgacgctttgtacttttccacttcggccatgtactaggtccacgcgtcacctttactcgtgaatacctcatcctgcgtcttcagcgtctaggtatactataccggtcttggaggggtagttcgtactccgcctctgcgtcagcccacgaagctaagtgtggaggccggaccgcgcttcctcttcggatccccggggccagcggctgggggcgactgggtcggggtcgctgcggacccgggggcggctcctccgtgccgtttggccgatctgaggggatcctct

SEQ ID NO: 503252 - DNA, 171 bp, Homo sapiens
atatactactgagcttagtttggaatcactcgtgatatttaaccatctatgctcagcaataccttctatctatagaccacagaatgtcatgtgtgctccactatcagcatcatttgcatactactaaaatgcaacatgtttcaccaaggacgatgagtctcaccgcaattt

SEQ ID NO: 503253 - DNA, 119 bp, Homo sapiens
acatgtatgaggtccagttgccacacatttcatggtggcatctgtgtgcgaggcagtgtgtcctgggcctcctgatcgcagagtgggcctggtccagcatggtgccatcgggacggggt

SEQ ID NO: 503254 - DNA, 154 bp, Homo sapiens
ctgacccctagttagaagttcaatagcattatttaactcaaataagcaagatagcatcagcgaagcaatattaacttgcattaatgtatttaaaatttctctgaatatatctacctttgcataaacggctcacactagaaatacaaacatcaat

SEQ ID NO: 503255 - DNA, 192 bp, Homo sapiens
tggaacaggctgaaatgcagggaaacgagagacacagactaggactagaatacacaagctcctctagtggcattcctgttcaaacaacctcataggtcagagatgccactgatcactcctagatcacagtaaatctataataacattaatacataaatgtactgaacttgggtagtaagaaaaataacatca

SEQ ID NO: 503256 - DNA, 145 bp, Homo sapiens
  misc_feature (1)..(1): n is a, c, g, or t
  misc_feature (5)..(5): n is a, c, g, or t
  misc_feature (142)..(142): n is a, c, g, or t
ngaantattgccaggcacctcgccaggtcggggacagcatggaccgtagcatcctccggcctggtgaacggcctggcctgcagctcaggaacaccagccggtcggaggaggacggaacagggacctggccactgcctggaanagc

SEQ ID NO: 503257 - DNA, 338 bp, Homo sapiens
  misc_feature (28)..(28): n is a, c, g, or t
gtctttcctaagatggagtcttgctctntcgcccaggctggagtgcagtggcgcgatcttggctcactacaacctccacctcctgggttcaagcgattctcctgcctcagcctcccgagtagctgggactacaggtgcccacgagcacacccagctaatttttaaaagggttctaacttatttgctgctgtgactgagtctcatggaatgtcttcattggataaacttcaattggcatttggttttttaaatcatccatcctactgagtttcacaggtaactcaagactccatgttcatataaaaatggagagtttctacccaaataagcccatcttt

SEQ ID NO: 503258 - DNA, 933 bp, Homo sapiens
ggccaacatggtgaaaccccatctctactaaaaatacaaagagaaatacaaaaattagctgggtgtagtggcgggcgccctgtaatcctagctactcgcggaggctgaggcagagaactgcttgaacccgggaggcggagggtgcagtgagctgagctgacattgcaccactgcattccagcctgggcaacagagcgagactccgtctcaataaacaataaaaaaaaaagatttcccactcacagccctctgatatagggggagtctctcattttacagattgtacaaaactgttcatttcacaaagattatttctcatgccttccaaggtggctggtcacttggttaccaactaggactcagtccctatttgcctatatttattttcccacctcctgaaaagcacttcaggccaccaccatcttgcccacacagcaaccaaggggagacttacaaggggcaattgacgccatacagggccaccaacacagggaggcgcctagcacaagactttgcttatctctcaacacgtcactctcatggtcctccacgcctggctttgggggccaacagaatcctggattggtcaacgcgaaacacagccttgcgggtttatgactccccaatttgcgcaacggcagcgattgcccaacactcacggcctgcaacccaaggttggctatcctatcaccctgtcttgaaccttcgtatctcgacaaacccttacttcccttgcgcactgtacaccccaaaaatatctgacctctcagctgtttcaccagttgccctttacaaccgcgatttaaaaccggttgtaagcatttttcccaaatctacctccattcttctgaatccatcacgcctcacaatttccaactcttttccccacccaattactcgcattaaccttgggaacaattcactttaccttcc

SEQ ID NO: 503259 - DNA, 269 bp, Homo sapiens
acattcgtgtcggacagtatatagtcagaggatagctattcaaaagattatggatgcggttgcttgcgtacgaacttcttatggcggcttctgtggaaacgacggttcatctctctggttttgaactggaataagagctaacatgtttatttctacgcctactccggttcaaaatcagtgcgagcttcccgctgtgatgagatgtgcctgccaagattgtacactacatgacgggttggtccatgtcattacgtgtacacgaattttca

SEQ ID NO: 503260 - DNA, 607 bp, Homo sapiens
  misc_feature (1)..(1): n is a, c, g, or t
  misc_feature (88)..(88): n is a, c, g, or t
  misc_feature (182)..(182): n is a, c, g, or t
  misc_feature (196)..(196): n is a, c, g, or t
  misc_feature (199)..(199): n is a, c, g, or t
  misc_feature (216)..(216): n is a, c, g, or t
  misc_feature (220)..(220): n is a, c, g, or t
  misc_feature (231)..(231): n is a, c, g, or t
  misc_feature (234)..(234): n is a, c, g, or t
  misc_feature (242)..(242): n is a, c, g, or t
  misc_feature (257)..(257): n is a, c, g, or t
  misc_feature (293)..(293): n is a, c, g, or t
  misc_feature (305)..(305): n is a, c, g, or t
  misc_feature (321)..(321): n is a, c, g, or t
  misc_feature (335)..(335): n is a, c, g, or t
  misc_feature (380)..(380): n is a, c, g, or t
  misc_feature (496)..(496): n is a, c, g, or t
  misc_feature (520)..(520): n is a, c, g, or t
  misc_feature (593)..(593): n is a, c, g, or t
ngcctgagaaacttaacaaatctgcaagctggaaaccgcgtcttttccccactctctgccagacagaatcacccagtccactttcagnggcccagcagggaagctgatttaagagaagtcaacagcttttctgactaccctgtggattccatcagtgcaccggcacctgcagggctgcagtnagcatctctgatgnggnggtcccgggccctcacncgcngtctccctccnggnttccttgngggggggggcttcgnggtttcgggctcagttcccctcccactcccgggggnggggcgcgtggncatagggggggcgggnggccagggggctgngggctgggtctgcttcttctgggttcgcgccacagtcacgtgtgntggctgctgtggcctgcggccaggtgccattcttcctcatgccctctgtgggtggcttccttccactctggggtctggcatggccctccccatcgttatcctctctgcattcatgncagggtgttggccactcgcttgcncccttcaggtctgccgtcttggttcctaggttgctaggaaaggaccacgtgggggcccgctgccgagaacggnaagtgcagccagga

SEQ ID NO: 503261 - DNA, 900 bp, Homo sapiens
gacagcccgcgcgctcgctctccgcccgggtccagtcgccagtcgccaagcgtccgcggcgcctcgcaagggtttcaagggaccacaccaaaaatgccatctcaaatgaacaggccatggaaaccatgatgtttacaatttcacaaattcgtgggggataaaggctatttaaccaagagggaggacctgagagtactctattgaaaaggagtcctgtgaattttggggaaaaatcaaaaaagacccctctgcttgtggacccaaaatacttgaagggaccttggaccaatgtgtagaggattgggccacacaggtggggcctttccaaggaaagcttttcttttttccccctaaattgtggcgggccctccaccaatgtgcattgcattgggctttaattgtgtacgttaccaccatttgaaggcagccacgggggcacacgacacgtaacggggcaagaacattgacgccgggttacgttccctcccctggaataaggcaagttgggtccccaaaaggggtccgcttaacggaacattcgggccccaaaaaaggtttttcccccccaataaggaaggggattttcagtgaggccaggatcaggggacacatttacggccaatttgttaacaatttaaaaatttctaaggttctaaattttgggacaacgtgcaggaagaacgggaacaacggttaacgttcccaggataaaggcttagggacttggtggattggtatgggatttctccgtgtgcctttaaattaaaataaagggtccttagtgaaggtttcccagacagaagaacagacatgatataagaagaaaaaactttttggcgcagatcgtgtgccctggagaaaaagtttttataaccaagtgtgtgggggcgggccgcatga

SEQ ID NO: 503262 - DNA, 128 bp, Homo sapiens
gtcgtgctgattcaaacatgcagatctttgtgaacgaccctcactggtcaaaaccatcacccttgaggtcgagcccagatgagaccatcgaggcttccaagcgcggtaccgaagctcgcaattcagta

SEQ ID NO: 503263 - DNA, 241 bp, Homo sapiens
ctgcagacaagctgccatccgaaaggagctcaatgaattcaaaagcactgagatggaagttcatgaactagagtagacacttaagcaaggttagtattaagggtttaatttttcctgtgtttttccctcaagtggcaatatttatctccaaataaagctctcccactggtgggacatgcagggggtgggagggtgccatgagcagggcaagcatcagtaggaaggcaggcatgcggttcca

SEQ ID NO: 503264 - DNA, 308 bp, Homo sapiens
gtaatacgtatgtagaagcatgagtatgtagtatagaaaggcagagattgaggtttgcattaatggtcataagtgagtggctaagaatcaggaaggacattgataaattactggtgagagttctgtaatccagagaacaggcagtgcattagtggaaaaatagaattcattatttggggttaaaatgaagtgaaatatggcgggtctgaatacagtggtgcttacaactaattgatcacaaccagttacggatttctttgttccttttccactcctattgcttcacttgactagtcataaaaaaatga

SEQ ID NO: 503265 - DNA, 378 bp, Homo sapiens
caccggcgtgtaaacatgacgagctgatcgagatcgtatgcttgggaaataagttgggccaagagtagcaccttggagacctaagatctttggatcactttgagaagagccactgagcctgaagttgaaatatttttagcttagtcatctgtgttagctataggagaaatagtaacacaagaaataactcctttttcacatgatcatttatatctatatacatatatatacttgcatacactatcactgcattaaaaaatgagtatgggctgggcatggtggctcacacctataatcccaacactatcggcaggcaaggaggaacaaacgaacccttgaggccaggagttccagactaacttgggccacacagggcga

SEQ ID NO: 503266 - DNA, 427 bp, Homo sapiens
aatgaccaagaccatcagtttgctgtattctactgatcacacagaccaaccatggtataatgcgtgattacacaagggtgtaccagggagacagggatcctccttaggcccatctaagaggcgggctatcacatctgatatctctgagtatctttggcaggaataaaacagaagtgatgctgtgtacttctcattgtatcctatcaggttaacataagatttcaatttgttttattactgatgatgttcactttaatcccttgattaaggagtgcctaccagacttcgccactgtgaggttttttttttttttttttttttgggggaaaaaagttgtgggctgggcccccagcgggggggggggagggggaggcccaccaggcacgggggccctcgcgcccgggggcaaaagagatccccggggcaa

SEQ ID NO: 503267 - DNA, 402 bp, Homo sapiens
tgaccatgagtgcgagatcattgttcatgatggagcagaccgtgccgtgcatgtacaacgaatctagaggcatgtatagcaggtcaggtggatgacagacagaagatacatgcagaagaactgggagaataacagcctatcgaagttatgaatgcttttcgtggggggtgtccagctgaatttcaagccttccccagtcagaaatattcctcctttggaaggctgcatatggaatcttgttattaactctgtccccatggactttgcaaggcctgtgtccttcaaagatgctgacattggtcgctgtgcccatcagaacctcggtgaagatgacgatggagcatgctccagctgaaatagttatccagcctgagcccagttcgcccccagcgaggggtaccg

SEQ ID NO: 503268 - DNA, 131 bp, Homo sapiens
ttagttttgcactgaatcacagcctggggactcagctaatcccattgttgtcaggaccttctgcgattcttgtgggtctactgttccactcctgtcagtgtcaaaactggtaaagtgttgtctccggccta

SEQ ID NO: 503269 - DNA, 283 bp, Homo sapiens
  misc_feature (12)..(12): n is a, c, g, or t
  misc_feature (40)..(40): n is a, c, g, or t
  misc_feature (42)..(42): n is a, c, g, or t
  misc_feature (236)..(236): n is a, c, g, or t
cccgggtaagantgaggctgggcacgtttgctcacatctntnatcccagcactttgggagggcaaggtaggtggatgctggagcccaggagttcaagactagtctggtggcgaaacctcgtctctacaaaaaatacaagttcagctgggtgtggtggcacacacctgacagtcaacggctggttgggtggctgaggtgggaggatcacatgagcctgggaggtggaggttgcagtnagccaatattgcgccactgcgtttcagcctgggtgacaggagttaga

SEQ ID NO: 503270 - DNA, 344 bp, Homo sapiens
  misc_feature (344)..(344): n is a, c, g, or t
cgcacactatatatgctcttacatgagggaatatggggttatataaaactcgcgtacatactattatatatacaggtaaattacatgcatataatagcattttatgtgcattagcttgacacaagtttaaaggatttccttatttctttcaaacattttctgggttactctcttttaattcagaaggttctatcctagctcttaaccacaggatccctgtgctttttatggcacttcattatctaaatctaggatgagcttcctagggttctgtccagattctttctgtgtattctgtgtaccacatcatcttctttcgttcttgtgactctcttcttgctttn

SEQ ID NO: 503271 - DNA, 989 bp, Homo sapiens
atgggctctcctcggcggaaggtgtttttgtcccgagttgtaatccacaggtttcaggtgtgcccgcccgccactctcgtggggagccctgtgctccgcgcccctcccattggtagggcgcttggcgcgacacaaggcggtttgttggcaccttccctggagggggctattgttcccccctacagccccgaggtggtgtataggtgtttcttcccagacgcgacttctcgtgtgggcctggcaatagtctcgccgcggctgggtgtgctgggatcttctccccagggcgcgctttaattattagtgctgagccttgggggccaacaccctctgtggcgcgcacacacacccctcccttggggctcccccaaggagcttcatggttgcggtgccgcggctaaggtagtctcctccctcagagggcgtcccttgttgtgcggccacacgccgaacacaccttgtcgaaccatgtggttctcccgcctttggggccgcccccctctcaccacagtgttgttcgcagaacatttttctactccccccttcttgtgagtcatcctcagtgcccgccgctggaggcaactttattgcggcacccaggtgccactgggccccgcgcgctgggcgccgcggcctgtttttctcccagcgggtgtgttgtcctcatagtgtgttttttataccaccggagcgccctctcgaggacgccctccttttcctccatagaagtggagcccctagaaggctccctccccccacggtcctttttttctccgcggggccccccgcttcttcgccccccgcggtgttcccgttctcccgcccccactggaggccccctgctgcttgtacaaccaaaagagggaaaagaggtgttgggggccccagacgagggtggtgcccaaggggccccaaattttcaactgcaagttttttttttttttttttccctttttaaattaaacccggaagttttgtcccccccccca

SEQ ID NO: 503272 - DNA, 639 bp, Homo sapiens
ctcatccctccccccccccccccccccccggggggggggggggggggggggggggggcggggggcgcgccccccccctcctccctccccccccccccccacgaaggggggggggggcgccccacaacaaaaaaatatttaaagggccgccccccccccccccccccccccccccccggggggtggcggcgccccgcggggggggggttcccttttttttttttttttttttttttttttttttttggggggggggagattttttttttaaacccccccctccccccccccccaaaaaaaaaaatgggccccgccaccccaaaaaaaaaaaaaaaccccccccccaaaaaaaaaattttttttttttggggggaaaaaaaagttttgtttacaaaattttttttttaaaaaaaaaaggggggaagttttttttaccccggggagaaaaaaaatttttttttttcgcaaattaaaaagctttttttttaaaaaaaaaaccccccggtatttttaaaaaaacccccgaaaaaaaattcttgttttttccaaaaattgggcccccccttaaattaacccaaagtttgggggactttccacctaaaaaattggccaaacattccaaacatgccatctggtgccg

SEQ ID NO: 503273 - DNA, 775 bp, Homo sapiens
  misc_feature (9)..(9): n is a, c, g, or t
  misc_feature (22)..(22): n is a, c, g, or t
  misc_feature (25)..(25): n is a, c, g, or t
  misc_feature (219)..(221): n is a, c, g, or t
ccttaggtnaccaccaacacanaanactgacacccgccactcaagtggggccagggctggtgtctgcccatgtttcatcctgacgggctgcttgccacaatgagggatcttcttcaatacatagctagcttctttgactttttctctgctgggtttttgattgtggtcacctgaactgactgtaaaatggtgaatgatgatgtactatatggaggatgnnntattaaatcattctttaaatgaaaatcctacaactacacccaaaaaacaaagaaatcaattagagtcaccaacactctcacctccctccaattttccgtgctctctcttctttgttactatcgtctctctctactttataccaatttatattttctatttattcccatacctttctcatatcacactctacttatcctattctctaacatcttagttacttttgtccgtcgtacttcgtgaatcctatagtaaacctccttctaccccctccctggtaatttacattggttattacgaacaccagagtaacttctaaatacacctctcccgccccaccttaactagccacctcaccccttttttcccaccccatccttccccccacccccccgcccaccctcctcccccacccccgcatatccatccaccgcacctcccccccttcttctaactaccgtacttctccttccttgtcttcatcactgatttcccccccctccctactccaccctactatcccacccacctcccatcccgccccctcccgtctccg

SEQ ID NO: 503274 - DNA, 152 bp, Homo sapiens
gtattagatgggaccagagcacgagagggtctgtaggccatggcctgagtgagaatttactcaatacacagtggaagtctggggatgagtgagaagcacaagagtggcacacgtgatttctacacacagtcagtctagcttgctgggagcag

SEQ ID NO: 503275 - DNA, 690 bp, Homo sapiens
ttctgtagcaactgggacccttaaattgggtttaggcttaagtccgtttccataccgtcgtaaggctacatccgggcgtatgccttccgtcattgaccgccggtgaccaagtcctttagtgtataggccaccgtcaagctatatttatgtcgtcaagggcatccagttactatcaagggtcggcacgtcttactgcatgtggaagctagcactgtctcaacatgaccagcatcgttctgcgatatgctgctcctagcgctttatccggcgaacagtatcctcatcagcggcaagctagtacttaacaggaactaaggtgatttcgagcacgtgcagagcacttactaagcaagtctcgatagtctatcacggcacgctacgagtcgcagtagccttgtctgcgcaatagctgtgactggcattcctgcctgctccagcgatgcccagtgcacatctgtacgtggtaacagtgagtcgtctgaatttcatgtctatggtacttgactacatcatatataagagtcacgctgaaagtcgctccaataagtaccaagcatcaaagcatgaagtagaaatgtttttataacctaatcttctgatcggtactgattagaaactgcatatcagagtatgtccccagagacagtgccggtacttatagttaagactgattaattcgtcccagccttg

SEQ ID NO: 503276 - DNA, 181 bp, Homo sapiens
  misc_feature (42)..(42): n is a, c, g, or t
  misc_feature (80)..(80): n is a, c, g, or t
  misc_feature (94)..(94): n is a, c, g, or t
  misc_feature (164)..(164): n is a, c, g, or t
  misc_feature (172)..(172): n is a, c, g, or t
gcagggcctgatgttgatcagccagttacccatgatggtcgntgtggagttcgagctgcgcttgaagatccccgggcctnagggtgaggtgcangcggtagacctcacggccacctgcctgtggtgtcatgaggatataaacccccagcattacgattccgggncctccatnccatgtggg

SEQ ID NO: 503277 - DNA, 1008 bp, Homo sapiens
  misc_feature (829)..(829): n is a, c, g, or t
gcagcgcatgcactgtcctcctctcgctgtccggctgggttcccaggccacctctccaaggtgaagacatggaacgggcacagaagtggtgacacccacccaggaggatgatggcgagaagtcggattagcaggggggccgggacggggaggttgggaggggggacagaggggaagaacagaggcacggagagagaaaggaatgtgtagcacaatgacacacgtggacgctcgggattggctagtagctcgccatacgtatttatggtgagctcgacggtgggggccccagccgagattgcatgccaactctagctattcttccattaacccattcccggttccctcctgctcccctgtcagacgtggttacagtgtgatacctgccctgacatgtgatggcaacgctaaggcctgggagggtcaggatggggaagaccagggtccctacaggggaggcgaagtaaccctcgacgtaaggcgccacgctggacctcacggttcgcatttctccctcgttctatgagaaacattgtgttagaccagagcatgcttctgagctggaggccacattgaccgtcctcacccctgggtacgtgccatgcaacgtggagatgcttaggcctgctcccttatccgcgtgccctgggacacacccgacgtctccccccgagccccggtgtcccgaggctatgctgcccagctcgacctgccccattcatcaccgtctggctggtttccagaacatcttccacgtcacaaggtggtccgtctcccatcgaccaacgagtaggggtgggacgaggggacgaggctaggtgagctgtganggacccggttgaggtggggtgacccagggtttcccctgcctttccccggctaaggacgggcgtcctcaagtggcttgggggaattaatatccctttgcttttccagactactacctgtgcttaacaacgggttttaaaactaaaaccggcgttaccggcgggaaaggataatggcgttg

SEQ ID NO: 503278 - DNA, 135 bp, Homo sapiens
tacatctcatggtcaaatcctgtaagtgacttgcagaataccggtgcaatgtggaaaaccttccgacgatcgcagtgaagccaggctctcctacttgtaaatgtgcctggagtcagctgtacacagagggcgaca

SEQ ID NO: 503279 - DNA, 414 bp, Homo sapiens
ttcactgattggacatgtaacagacagtaaaccctcgtgtggacattcatacgagtccttattctggagaacaaggtgatgatgctgccttcgcacggtcagaataccgcggccgttaatctggtgtcactgggcaggcattgcctctaatactagtaatgctagaggtgactgtttatggtataacaggcggggtaagggtgagccgagttcactttacttcttttaattctttccttggtgcactcctgtgttgggttaacaatgtaattaataaacgtgttagtgttgttttggtttattggttgttaattatcagtatattattagttactgatgtaagcgtgtgcgaggagaaaggcttcttgttactcatattaacattattgcttctatgtttcaatagattagtcc

SEQ ID NO: 503280 - DNA, 795 bp, Homo sapiens
  misc_feature (4)..(4): n is a, c, g, or t
ctangtcctacacagtgttcaggtctccctttttaaccatgaggatcagcaatcatttgcttggtttcccttatgggttatgaagcctcttggatctggaaattggtgagtttcatcaaatttggtaaattttcagcctttttttttttcaaaatttttattgttctattttttctttgttttcttctgaaacttcggttacacatatgctagactacttattattatcctataggtgggggcaagtctgatatttatcttcagtcttttctctctttctttttcaaattaagtaaattcattaatctaatttcaagtacatttattccttatttgtcatttccaatctacttttaatgtcatacaattaatttgatattttagctatgatattttccactgtggaatttctatttgattctttttttggaggttcaaccaatttctatggttgggatttttcattttttctctcatcatttacacataattcttaaagcttttagcctttttataacagatgatttaatggcatcctctgctaatttaacctctgggggatcttgggagcaatttatttggagacttttttttcctaaaataaggcacattttttattttccttactgcctagggttttttgggaagttatggggggtggtggggtttggttaatttttcttttgggaatctggccataatccaaagcttgaatttctaattttccttgaaaaagattttggggtgaaaaaaaataaactttgggttaaaccccaaaaaaaaagggctcgtggg

SEQ ID NO: 503281 - DNA, 857 bp, Homo sapiens
tatcctggctcagcttgaaacagaccctcgtaccaggggaggctcaggcctgtggattttaatgtcagggatggaaaaatctcaaaatgcttcctggatctaccagagaaactacaagatccattccaaaaacacctgaacagcaccgaggagtatctggcctttcctctgcggacctcggcgcagccacttcttcctccccgtgtctgtggtgtatgtgccaattatggtggggggggtcatgggcaatgtcctggtgtgcctggtgatcctgcagcaccaggctatgaagacgcccaccaatactacctcttcagcctggccggtctctgacctcctgggttcttgctcctttggaaggccccgtggaggtctaatgacatgtggcgcaactacccctttttgggtcgggcccgttggggctgtacattcaagagggccctttttgagaccgtgtgcttcgcctccatcctcagaatcacaccgtcaggtgagcgcctacgtggcaatcctacacccgttcgcgccaaattgaggagcacccgggtgccgggcctcaggaatctcggaattctctggggctactccgagcacttctccctgcaaaaccagcatcatgggcttcagttcactaattccaatggtccgtgtccgaggtgggcactttaggtaacagccatgtgttcaattcacatcggtccctctctaattacctctccagagtaaggcctatcctggccgatagaaaaatcttgcgaagtatatcagctgaaaatacagtgttgttatgaatggcgcaagactcttggaggacggaccgggttatagcatcttgcttctttctttttttttcctgc

SEQ ID NO: 503282 - DNA, 281 bp, Homo sapiens
aagcctgaccaatattgacaaaccctgtctctactaagaatacaaaattagctgggcatggtggtgcatgcctgtaatcccagctacttgggaggccgaggcaggagaattgcttgaaccctggaggcaaaggttgcagggaggtgagatagcgccattgcactccagcctgggcaacaagagcaaaactttggctcaaaaaagaaaaaaaaatgatggagctccgattgcgctaatttggaaagatttcctatgaaataagggggctttttaaaacacca

SEQ ID NO: 503283 - DNA, 1023 bp, Homo sapiens
attctagagggccgaggcgggccgacatgtttactttgtcttttaggttattatgtttttacccagacaactctagaacagtgcggaccaaactacttcattttctcaacagggcataccttgtgcatggctggcattatgatgagccatcattaattcgcctgttacaatatccactagctgtgcaacttagatgttcacatgtcattattaccagcattggtcctttaggtgaaatcagtcatcagaatacttgccctctttaaccacattctttcataacactgtataacattatgcagaactatttaacacatcaagaggagtgtactggcacgtgcctgataacccatttgcgagtatgcgacctcaggagatacataaagcaaactggtgtcagatctagcctaaactgcccttggcacgtcaccaacacacaacaaacagcgacacggagaaaacgcagaaggaacggacccgcgcagaatcgagcacacgcaacgactaactcagagaccgatccaacaccgcgcccactgcacagggggaacctccggacccacccgcggcacacccaaacagccacacacaccaccgaccgacacaataaaaccagtgaacaaagcgcgacacaccacaacacgactccgcaacacaccccaccgcagccacgcggacacgagccccgaacccgggcgcggcaaacccgaaaacgaccagccggctccagacggccccgacaccccaacaccgaagccccacacgcggcgacagctaccaccaccccaacagggcgacacgcaacacctcagccacgaccaatgggccagacgggacgaacaggacacgggaaccaagggtgaaaacccgcgacacgcgccggagcagcccccgacaagcgagcagagggagcacccaccgaagcgccagagaccaagacgcgccacaacacaacacacccgcacgcagtagcccgcaccacgagtagcaggaaacagacgcacaacgagccacgccgtcaca

SEQ ID NO: 503284 - DNA, 333 bp, Homo sapiens
ggctctgtcgttcctgatgaacacacttctcagcatgtgtctgggaacactagttttgtattttggggtttcttggtggttggtttgtttgtttttgttttgagatggagcctctctctgtcgcccagactggagagcagaggcgcgatatcggctcactgcaaccccgctcctgggttcaagcgattctcctgcctcagcctcccaagtagctgggattacaggcgtatgctaccacgcctggctaatttttgtatttttagtagagacagagtttcaccatgttggccaggatggtctcgatctcctgaacttgcaactccaacagcctct

SEQ ID NO: 503285 - DNA, 238 bp, Homo sapiens
  misc_feature (179)..(179): n is a, c, g, or t
  misc_feature (219)..(219): n is a, c, g, or t
  misc_feature (221)..(221): n is a, c, g, or t
tgcgtttcacgggtaaattccacgccggtactgacatcatgaccgatagaaccggtatagaacgtcgaggtcaggttggtctggttggtgagaattttattactcacatctttggtattcgccgtgcgtgaccaggtccagctattcacatcgctggtgggctgagtaatattcgacgncccgcccataatcgccgtcatcaggtaatcctgctttaangngcgaccaacgggtagta

SEQ ID NO: 503286 - DNA, 440 bp, Homo sapiens
tggctactagtcagttggctactagtccacggtggctactagtccacggtggctactagtccacggttggctaggcggtggtctcaaactcctgacctcagtgatctgcctgccttggcttcccaaaatgttgggatacaggcatgagccaccgtgcccagccttattttttttttcttttttcttgagacagggtctcactttgtcacccaggctgcagtgcagtggagtggtcgtggctgactgcagcctccacctccccggctcaagcgatcttcctgcctcagcctcccaagtagctgggactgcaggcacatgcaaccacacctggctaactttggtatttttttgtggagacagggtttcaccatgtggcccatgctggtcttgaactcctgaactcacgtgatccacatgcctaagcttcccaaaatgctggg

SEQ ID NO: 503287 - DNA, 90 bp, Homo sapiens
cataatttgttgacggaatatatattcttgggcatgcaaattacatgaactgctgataagattcgagaaactcccttctgtcgtcttctc

SEQ ID NO: 503288 - DNA, 140 bp, Homo sapiens
cttggttgccagaatcagctggccattcggtggactggagacaaggaccaacttatgtccttgatggccaaaaatgcacctactcttttcctctaactctggggagggcatcctggagtgcaagatggactccgcacaga

SEQ ID NO: 503289 - DNA, 257 bp, Homo sapiens
agaggatccccatgtgaatgatacattcagattgatttaggaacggcagattactgatttcatcaagttcgacactggtaacctgtgtatggtgactggaggtgctacctaggaagaattggtgtgatcaccaacatgagagaggcacccttggatcttttgacgtggttcaggtaaacagatgccaatgtgaacatgctttgccactctgactttccacacattttgtgttatttggcaatgggcaacacaaccag

SEQ ID NO: 503290 - DNA, 110 bp, Homo sapiens
tctcgctgctccctcttcatacaaaccatcttctcttgcaacacacaggcatatctctgtgttcatttctattgggagcctgtatggcagggtggagagagccacaattt

SEQ ID NO: 503291 - DNA, 158 bp, Homo sapiens
ggcagaagtgcagcacaaaagaaaaaaaaaaacacacaagcaaacccgtacagaaggggggcggggtggattcatttaaggggaacgaaacacccttacagtatcaacatgaaggtgcaaagaatctaatgaacatatggggggtactacaaaaatag

SEQ ID NO: 503292 - DNA, 199 bp, Homo sapiens
  misc_feature (21)..(21): n is a, c, g, or t
  misc_feature (59)..(59): n is a, c, g, or t
  misc_feature (118)..(118): n is a, c, g, or t
  misc_feature (125)..(125): n is a, c, g, or t
  misc_feature (182)..(182): n is a, c, g, or t
ccgggggacggcgacacggtntcggcgggccgcagagggggtcatgggtaaagattacnaccagacgttgggcctggcccgcggcgcgtcggacgaggagatcaagcgggcctaccgncgccagnctagcgctaccacccggacaagaacaaggagcccgtgcgccgaggagaagttcaagnagatcgctgaggcctac

SEQ ID NO: 503293 - DNA, 153 bp, Homo sapiens
cccccccccccccccccccccctttggcccgggttggggaaaaaaaaacccccccttgtttttaaaaaagtttttttaaaaaggggttggggttggggggggttgtttttttttttaaaaccaattaaaaaaaaaaaaaaatggtttttttta

SEQ ID NO: 503294 - DNA, 870 bp, Homo sapiens
  misc_feature (464)..(465): n is a, c, g, or t
  misc_feature (476)..(476): n is a, c, g, or t
  misc_feature (479)..(479): n is a, c, g, or t
  misc_feature (505)..(505): n is a, c, g, or t
  misc_feature (561)..(561): n is a, c, g, or t
  misc_feature (579)..(579): n is a, c, g, or t
  misc_feature (585)..(585): n is a, c, g, or t
  misc_feature (772)..(772): n is a, c, g, or t
  misc_feature (817)..(817): n is a, c, g, or t
  misc_feature (848)..(848): n is a, c, g, or t
  misc_feature (861)..(861): n is a, c, g, or t
  misc_feature (865)..(865): n is a, c, g, or t
ggagaggagagatggtataggtatgtaagtattgtttgtgtttttttgttgcatgtcttttcttattgttggttgttttgatgttttgttgtgtgtgatgggcgagacagagagcccatacgacgagacacacaacgatgggcccatgactcgaggccacagtgtccaaaccgctgtaacgtcgcccgtacattacgtcctaggtacagcccttggtgggaatttcgcccaggtcacttcacatttcaggactctcctctttggtctggctgaaattgaggatctcttgactctttagtcccccggaattacccgagccggcatggaggcctctgctctcacctcatcagccgtgacccctggtggcccaaatggtccgggtggcctctggctctcgcccgtagttttgcccctggcccaggattgctaccaattgtgaatggaggaattgtggctgtgccccnnggtgctccagngcncatgggcttcacttcggcgggaatcngcctctgtcctcccatagccagcccagatgatgtccccggcggcccattgcccaangggggtggaattgcctcngggcanaccttgtggctactctgcagtcactgggagccactggactctcccggattgacccagttctatcctgggctcccatgggtctgcccttgcggctgtccattgcgaggttttactagctccctgcccctctgccctgcagagaagagaaccctgcccggggagaaggcacccagccctcctgaccccncgaggagcccactatccccaatatacctggggtgaaatatacccnattttgcatctcccgaggaaaataagaaatnaagatgaattgtngccnactct

SEQ ID NO: 503295 - DNA, 483 bp, Homo sapiens
  misc_feature (127)..(127): n is a, c, g, or t
  misc_feature (186)..(186): n is a, c, g, or t
  misc_feature (193)..(193): n is a, c, g, or t
  misc_feature (234)..(234): n is a, c, g, or t
  misc_feature (304)..(304): n is a, c, g, or t
  misc_feature (355)..(355): n is a, c, g, or t
  misc_feature (384)..(384): n is a, c, g, or t
  misc_feature (388)..(388): n is a, c, g, or t
  misc_feature (411)..(411): n is a, c, g, or t
  misc_feature (436)..(436): n is a, c, g, or t
  misc_feature (467)..(467): n is a, c, g, or t
cattcacctgtgatgcataagactagattattttcggcatatctactgtttgcaaagtgttactactgaaaaatatccctgaaactgagctctttgggtggataagcaaaggaaaaatagaaaatanttaaggtaagggaaaggctaaaggataagcctgtgtataaatgggaaatggataagctnaaatgcnttatctggtttcaatggaacacccaagaattaacaaacttngtgctagaagacttgaaaataagtgtaatttaccccatctattgagcagctattatgagccaggcactgngctagggctggggatcataagtgaataatgccaggtccagaacttagaatnattgggtttggtttacccaatccaatgcngtanctgcattctctttttccaactgngaaggctatcaaacatgtctttcanaaagtgtttgcagttaataagaatcccccanggtgaaaggaaagttt

SEQ ID NO: 503296 - DNA, 496 bp, Homo sapiens
  misc_feature (90)..(91): n is a, c, g, or t
  misc_feature (102)..(102): n is a, c, g, or t
  misc_feature (105)..(105): n is a, c, g, or t
  misc_feature (131)..(131): n is a, c, g, or t
  misc_feature (187)..(187): n is a, c, g, or t
  misc_feature (205)..(205): n is a, c, g, or t
  misc_feature (211)..(211): n is a, c, g, or t
  misc_feature (398)..(398): n is a, c, g, or t
  misc_feature (443)..(443): n is a, c, g, or t
  misc_feature (474)..(474): n is a, c, g, or t
  misc_feature (487)..(487): n is a, c, g, or t
  misc_feature (491)..(491): n is a, c, g, or t
caccatttccggaactctccttctttgggcccaggattgctcaccacgttgtgattggaggagattgtggccctggccggctgtgccccnnggtgctccagngcncatgggcttcacttcggcgggaatcngcctctgtcctcccatagccagcccagatgatgtccccggcggcccattgcccaangggggtggaattgcctcngggcanaccttgtggctactctgcagtcactgggagccactggactctcccggattgacccagttctatcctgggctcccatgggtctgcccttgcggctgtccattgcgaggttttactagctccctgcccctctgccctgcagagaagagaaccctgcccggggagaaggcacccagccctcctgaccccncgaggagcccactatccccaatatacctggggtgaaatatacccnattttgcatctcccgaggaaaataagaaatnaagatgaattgtngccnactct

SEQ ID NO: 503297 - DNA, 700 bp, Homo sapiens
gagggggcctcagggtccgcccccagttatggactaaacggctactggggacggcctctccaagcggtgggccgggggggggctgggattggtgattggggagcctgtggggcctgtgcgaggcctcccggtgggggatagctgcggtgtggggctaccggggtgggtcctcgtggaggcctgtgggaagcaagactatcggggactttcatgccgttagattaatgaccatcacacgatgcgagtagcctggtgaagaggcccagtgccgaagaaacaccgccactaaaagggtgccaaccgagattgtaggccgtgacatcctcgtttactggtcctgctgtgatcaatcacacggacgaaacaaatggcacttcagctacttcaggagcctccacagagtacagcagggatgtccggtgggacccaatctatgcttgtatgacgcttggactaatcatgcttcatggtgagcagagggtgatggcttggtgaccgagcaaaggggggccggtgtcagtgctcgtcgtccgctgtgcaggcgcatgcagcccatatggtgcctggatgagctacctgtgtcagaaatccggtcttaacatgttgtgcatattctcaggattgacacaattgtcaccgaatgccttatggatattaccggatcgtggactgggcgattgtatgagtcacagccctgtag

SEQ ID NO: 503298 - DNA, 879 bp, Homo sapiens
gagggcggaagcgctatccgagcaggatgcggttcggggttgccttggtcctcctgaatcgatcgcagcggggggatgccgtgaccgcatcttaggccaccgaataggcgtcagagcaagaagaatgcatggagtacggccttctggcatggaaatcgtctccacccaacccagcttgatgccagaggtgtggaggactctatcaagtcgcatccggagccgtagactcctagatagatatgcctctagctaagtcggagtgcggatggaagcagacaccacagatatggacagccccagcatgttgggtgcggagggtagacgacccatatatagagatcaagctcctaatgagttccggtgcggtgggtaacgaaccccatagataggcaagcaactaagactaagtactggagttcaggaggcgctgaaccagataggagacagcatctacgtacatgtgctgccatcctggagtctgcaggagctccaaaattgacagcgcatggacgaaaatcagggtggggaaggatgtcatgtaccccaagtagagaaatagatgcataaacagaggtctgagtgatgctgcgaatggagataatgatggcacgggataaaggacatgctcctagcatatcccggtatcggaagcatcacgaccaactaataaggattgtctcttaaataaagttcgagtgtcgcggaccgagatgaacccagaatatgaacggttcccaaagcaatgttcgaggtccgcggaagggattcatgcactcccctagtatgaccgtccataaacgacagtcaggagtcgcgggaaaacagcaagatctccaacaaaatgagcgggctcttaattgaggtccggtgcagatggag

SEQ ID NO: 503299 - DNA, 1379 bp, Homo sapiens
attaaatgtgacaaacacggtcaagaagcttaggggacaggttttagtggttgctagtgtaataaagcatgtccttcgtatgtcacacgtttgagggctacagagtaatctctttgcagatgactaggctagtaggcgctctgggccagcagtcccttcatgatatattctagtacaatcctaactatccagttgcagtattgatctagtgatatacgtaggaaacacttgggacatgctggtcatggcttaaaagagactcattatgtaatacccacgtgcatcccgcgcttctcttgtatgcctacccttgtcactatgcatgtgagatctagtttctccggaaggaaggcaaagacacaccctgacaagggtcaaaactactcgtctgtaccctttggactcccatctctaaaacatggagttatttcttagtagcagaatacagcattgtaggccttggcatatcctcaagtcgctatagattcctcgaggcatcatgtaatatcttttgatcattccattgatgcctactattaattttaggtgtttgactgtcaaaatttatggtgtgtttcaaggattgacatatggtatttcatattatacaagaatgcgctaaagatgattattacatgatatgtttgagattttcgatgttatatctaataagtccatctggtgagaagtatttgtcgctctttataaacgaaatgtattttggtaatctgcgtgaacatctctaaaatactcataatagcagatatattcacttgacctggactaccgtgggatccccttgagttgtattaacaggcccttgcattcttttcgagacagtgcttgcgagggaagccaatttcttgccagatccagagagatcctagggaggatggatacaggttgctaattccaaggcaaccttttattggttgaaccttttcaataaccttccgcggggcggggagacactgcagcgcgcgattgggcggctcatgaagagacatccaaaacataggcctcagcatagaaacaaagactctgagaaaggaatcctcatccgacaggttgaatcccctccctgagggcgcgcttaaacttaccaacctgctctcacaaaaccccctttatgtcatcagtgtgtgtcaacttatcaaaaggacacgggggacccatcggtggttgacccccatgtttgggtcgcctttaaccccatggtcaccactactagtgggtgtccccaagacatgtatgcagaaaccaaaactccggcggagtataacaaacaccaccaacgaatgaatcacgcgcagagaaaggtccatacacaaatataagaacttttggatgataaaagacccaccatatcaaacacctta

SEQ ID NO: 503300 - DNA, 151 bp, Homo sapiens
gatcccccttcatgtagcggagcagcacccgccggcgaagttaatattcttcagccaatatgaacaggtatcaataattgccgagtcgtaccgcatcggagtaaaggggtacgttacaaaagaccagtcaatgaatatgctcgcttactga

SEQ ID NO: 503301 - DNA, 912 bp, Homo sapiens
  misc_feature (488)..(488): n is a, c, g, or t
  misc_feature (613)..(613): n is a, c, g, or t
  misc_feature (615)..(615): n is a, c, g, or t
  misc_feature (621)..(621): n is a, c, g, or t
  misc_feature (804)..(804): n is a, c, g, or t
  misc_feature (806)..(806): n is a, c, g, or t
  misc_feature (813)..(813): n is a, c, g, or t
  misc_feature (824)..(824): n is a, c, g, or t
  misc_feature (858)..(858): n is a, c, g, or t
  misc_feature (893)..(893): n is a, c, g, or t
agtgcgctgcctcagtcctactgagctccccagatggctcagtctgtcatcaatgcccgacaatcagaacaactaccactgaccattgccgatattgtcctccgcattctatgatgcctgtgatacattaagtgccccgtgatgtgaccttcgaccctgagctcgtggtccctgtggtagctgcaggagctgtagtctaccgagttcctggcattgtcttcattctccaatcccagcacatccagagattctcgagatgaaccctgaccctgcgatggagcttcagaaaatgttacctcatggcggaatagtagtactagtccagactagtggccaggaccccagtggtctattcatccctggtaaccctggagggcagtcatggatggagaggagcaggcccctccagtctctactgtcctgtatgagaaaggccggaatcactacacatgaagagcatctccgtggcctacatcagtgtctatggnacactctgagctgtgccactgccacaggggtattctgccttcaggactctgccttcaggaacacgggtctgtagagggtctgctggagacgcctgaaagacagttccatcttcctttagactccngncttggnaaaatcaccttccctttaccaggaaatcacttcctttaggactgaaagctaggcgtcctctcccacaaaaaagtctgccctcatctgagaatactgtctttccatatggctaagtgtggccccaccaccctctctgcctccgggacattgattgggtccctgttcttggggcaagtctaattnanctgtttnaaaattgaatnccatgttaaactccagggaaactgggaaaggctnacctcctcctttggtgtttgcggttaaaataaccnacaggctggtgaaatcccc

SEQ ID NO: 503302 - DNA, 1657 bp, Homo sapiens
tggggctgaccgggaagtcggggtctccattcgccttctgtcttatctgcgtcctactaggcaggttcgtgcaggggaaactcagatggagaggaagatatatatccccttaaataaaacagctaccctgctgttctgacctgatcaacgccactccatccagcatcggctagcccagtctatccaattcagtggcagcacaccaggggtttcatcccacagtcagtcagcagcacacagcaggaggcaccatcaccagtgcggtcatcgactagcatgagcaccaaaccccacttcacatcggttctagctggcagcagcaagcattttcaacagggattttaataggcagaagctagaaagggcagacaactagccgaatcagctaggtcttgcagtagtcctatgaccgaagccccagtcctcgcctcaggcttactctacctaagtagtcacagtgcccaaatgatgggtaaaggtagtatgacatccaaatacctatgggaccagcagatagctcaccgcagagaaatacagcggaatccgcagggcaacggataaggctcatgacagactcacagtaaccccatcataactacatgaagatgcaaccgcaaccaaccgtcacccagcagggcaaacaagatcacaaccctggcgaccagcacgggcatcaaaaacaacatcgccataagtgccacggccgaacactggcccacaagcctgccggcacagcacgtggcagccggcaggggcgcacaaccaccacagcaccacagccacaccgcacccggtggaccccgccagtccaagaggcagacccaccaacacacgggcacacacccgacagcggagccgccaccagcaaaatcaccaacgaaaagacaggcaaacagagcaatccagacaaaagaacaatacaccccaaatccaaaacaaatacccaaaccaggaatcgaccactgtgccttatcagaaaacaaccgaaaacgaaagagtaacacacagcacacagaaaacagcgaacgaagcaaaaaacgaacaaaggaagacaaaacaaagaacgcaacagaagaggcagacgcgccggggaaacgacagaaagacgcagacaggagagaaacagacggcaaaaacacaaagagcaaaacgacaacaggaacacagagagagaagacaagaccagcaacaagcacaaacgagaaacagaagaagagaaagacaaacaaacgaacaccgaaaaggagaccacaagacaaatgcgaagagcacgaagaggacgacacgagcagacgagagaccagcacagaaaagaacgacaaagacaaaaagagaacgacaaccaagccaagaacgagcgaacaaaacacagacagacacagaagaccgaagcaggagaacgaagaaagagggcaaggagaacccagcagagaaggccaggacaggaacaacgcagcgacgagcacgcaacgacaggaaggacgaaacgagcagaaagcagcagaaacgagaggccacgagaacggacgagcggagcaacaagaaggcgaacaggagagaaggccgcaaaacagagcagagaaggcaaaagaaagagaaggcgcaaggacaacggcagcagagaggagagagagcaactcacggcgaagcagcagaa

SEQ ID NO: 503303 - DNA, 135 bp, Homo sapiens
gtgatctactgccatcatacggtgttacataagctagtgcctggcacaatcttagtggtttcgccatatagagcgtggatccttgtctatgtagtctctaagtagtactctaatgagctgctagtctgatattac

SEQ ID NO: 503304 - DNA, 527 bp, Homo sapiens
  misc_feature (9)..(9): n is a, c, g, or t
  misc_feature (21)..(21): n is a, c, g, or t
  misc_feature (47)..(47): n is a, c, g, or t
  misc_feature (52)..(52): n is a, c, g, or t
  misc_feature (87)..(87): n is a, c, g, or t
  misc_feature (102)..(102): n is a, c, g, or t
  misc_feature (105)..(105): n is a, c, g, or t
ccccacgcnccccagatcacncccacataaaaagtgagggccacctnccccnaactgaatgacccccctaagggccccatccaaaantgtgtactgtgatanggncctttgctagttgtctttttttctcaaatcaatttcgaagaaagcgtttttgccctgaaagcggctgcagctcagtggaagctggaactgaaataaagttaggaacttgcattccttgctcagagttctctctttactttctctagatagaatacaaagtgggtggtaaatttgaatattttatatgcactggggtctgtgctaaggtataattttagttacttctcatagcctttttattgaactttatcatttcataatatagatgatgaaattaagtaatttaggccaggtgcattggttcatgcctgtcatcccagcacttttgagaggccgaggcaggaggattacttgaggccatgagtttgtggctagcctaggcaacaaagcaagacctggtctcaatacttaaaaaacaaaaa

SEQ ID NO: 503305 - DNA, 157 bp, Homo sapiens
  misc_feature (149)..(149): n is a, c, g, or t
actaagggatgaaagcggcacagtgactcatgcctgtaatcccagctggaggcaagatctatagttatgttttgctgttttagttggaagtacttccaggccaggcttagtggttcacatctgtaatcccagcactttggaggccaacngtgggcgg

SEQ ID NO: 503306 - DNA, 940 bp, Homo sapiens
taatttattaatttatttattttggaaatggagtctgtgctctgtggcccaggctggattgcgtggcgcgatcttggctctcgtgctccccgcaaaaaaaaaaaaatatctccaacaaagcaaagcaattatagcctttgtgttggagttgaattagtatagcaaaggggtggtggattggacgtggcccacattttccctgggcctcttaaaagaatgaatttccctaaataatttaagggactagagtaatttgggggtgctgtgataaggaaaggtcaagtttaaggtgttcctaaataaggtgttttccccttcttgttcccctcaactttggggtctcctatacggcaaatatgtcctcagggaagtttatagcgcgggaatccatcctttgtgaacccaccttcggtgaggaaagacttgaaattgttcacactcctggggtttccccttatcctgtaaaaattttcctccctcctacattgggggtccctccaacattttgcaaaaattgatggttttgaaagcccctccgtttggcagggtccaggggggccccgtgagcccgagataattgcccccattttgcccccccagccgtgggttgacaaagaagcccctttctcaaaatttcacacatttaacattttggccggggtatttgtgggctcaaccgccttgttatccccaggccctttggagaagctcgaagcggaacggctaaaaggctcgggtttcgaaccggctgtcccatgtgttaacccccggtctttactatagaatctacaattgcggctgtgtggggctgcgccgtaaacccccatatttgtggctggcacgaagatgtctctaacccgcgggacagtgtttatacccgatcctcgtcccccgttgccaagtactctcaatctatacgttacaaacctgcgtctactag

SEQ ID NO: 503307 - DNA, 257 bp, Homo sapiens
caggtctgacactgggctcatcagggattggcggagagggagtataatgccccagcgttggtaagggagggcccagaccgaagaagggtttggtggatagcagaacctttccgtctccctctgattgctccttagcctcacgctcccttgccccgcgtgttctgttgcttccctgatcttctccgtgacctgtacctcaatcttccaccagcgcttgagaacttcctttgaaccggatccctccccaggcttcagag

SEQ ID NO: 503308 - DNA, 354 bp, Homo sapiens
agaaggctagataacataaatgttcttattaatccaaagatagatcatatatgaaacccttacctcaatactcctttcaaatcagatgcatataaactatgatcccacttccccgtgtaagacgtatttctgtgggatatttcctccgtagtaaccacagaggaagggaaaaagcagaaaagctgcccacctaaacaaaggctaacataagggctaggcaaatatatggacatgctatcatcttaatgatgtatagaatctaactaagcagacatacagtcaacttcctgttgaccatgtgcatctaaatcggcatttcttaattatacaaatcatttttaggcaatcaagctg

SEQ ID NO: 503309 - DNA, 416 bp, Homo sapiens
tagcgcttcaaaaagttcagaagagactagatcccttcggccaaatcacatattatctctctactcacaaggatacaatagtacaaagggtgtaaaacggctaattgggtattaaagggtgaccccaagataatctccaaagcataacactcctcataagggatagctcgctcaccagacaacctagggtggagaaagagtgaccgcgtaaaacatggcagataaaaaggggcaccttcaaaggtctccttcaaaaagtcaggtgccacgctagagcgtcttttttttttttttttttttttttttttttttgtggctccccaagggagagccccccccctaacaccaccgcggaaataccgcgcgcgacgaggggagtagataacaccccacacgcccccaaagtcataacaaac

SEQ ID NO: 503310 - DNA, 276 bp, Homo sapiens
gggggggtttttttttttgccccgggggggttccgggccctggggccaaaagggcccccccccccccctttccaaggggccgggccaggtgggggtttttcccccccccccctgcccccccaaggggtttttccccttttaagaaatggcctttttaaattgggtttgttgggggggcggtttttttaaccgggaaatgggaattcccccccaaaggtttttttttcccggtccccccaccttttttcccccaaaagggggggtttggggggccca

SEQ ID NO: 503311 - DNA, 975 bp, Homo sapiens
  misc_feature (520)..(520): n is a, c, g, or t
  misc_feature (545)..(545): n is a, c, g, or t
  misc_feature (585)..(585): n is a, c, g, or t
  misc_feature (637)..(637): n is a, c, g, or t
ttttagcaaagaccttataaagaagtgtactatatttaagtagctaaaaaggcaagaagaaaatgccaaggtgtcttggaggtagcaactgctaagcagctgccaccccaggactgggggagctagaatagagtctccccatgtttgacgtttgtctgctaatagcattcaagctctccccctcagtttgcctggatctggacaagctgataagaaagcccagccacttcctctttgcgtcagaggggaagttcaaactgtgcaaaccctgactgtcaaatgcactgagctctcataaccacaacaaaaaccagagccacttgttcgtcctttcactgaagcccaacagactggcgtgggtgcccgctttgctttccctagaaggcctcatgtgagtagtaaactttttcataacctctggtgtctgcagtgtcatcagtttcaacatccgaaccagttttgagtgatggtagtttattgatcccacctcatgtggagcaaagtgcaaagcaggaacaangagacgtggctagaattgttgaaangtgggagattggaagagggaccttgtggagctgaactcanacctatggtggaggagtggactgctgggctgacatagtgtctgtgctcaggnaggggccctgtggcctttggatctgtgcttctgtggagaggtcccagctactaatgctggggcagggagcagaagggagggtcacaatgagactttgagtgttagttaaccaccttttgcctgaagaacatgtaatggccttccctgaggtatatgtcttccaaaagtccgctgacgttgctcatgacctatggtcaccactgctttttgcgtatggcttattatattttttttggaaacgggttctcaccttgtaacccaggttgacttgcatgggcgcaatctcggctcagtgcaacctccatttcccaaggctcaagcaattctccagcctcggc

SEQ ID NO: 503312 - DNA, 338 bp, Homo sapiens
gaataattgcaaaaactggccagttttttggttaactaagaagaggggcattttaaaacgcccatggcttggtagaaaccctagggaactaggcttaacgtagaaaggagatttgggaagctccaggtcccttggacacctggcagtgagcatcagaaagaaaagtaagagttcttaagaaaaacccaatctactttgcatttgccctgtggctgcctgccagtgctgctatcagaattcagattctggccctgccttgctctagggcctgcagtttggctcttgcctcttcatttcagtccctttacctgccatccattctagatccccggagtgct

SEQ ID NO: 503313 - DNA, 106 bp, Homo sapiens
gcggccgcctactactactactactgctcgaattcaagcttctaacgatgtacggggacatgttaaatcccattcataactttcattaaagcatttacttcaaaaa

SEQ ID NO: 503314 - DNA, 273 bp, Homo sapiens
tgaggatcgctgacgtaatatgtaacgataagactcccaaactatatcatggagactctcccacagtaatacacgctcgttgtggtcagatatcaggctcctcagactccatgtaggctgtgcccgtggatgtgtctgtggtcaaggtgactctgtccttggaatttctgtgcatactctgtgtgaccattgtaagggctgatccatcccatccactcaagcccttgtccaggggactgtcgcacccaactgataccatacgtggtaaaggtg

SEQ ID NO: 503315 - DNA, 164 bp, Homo sapiens
actcgctccagatattataacacatatccaactgctgcaaaatgcatctacaatatgctattacagatccacttttaaaaagttacctgtgacattaacagcaagcctcttttattacaaacagaggaataatcccaaaattacttacctcaaataaactccat

SEQ ID NO: 503316 - DNA, 845 bp, Homo sapiens
  misc_feature (324)..(324): n is a, c, g, or t
atcgtggccacacttgaacaggttgtatatgcattctacagtgcgatgcgtggaagagccgagaattccaaccgcaggcaattgccatagaactatatagatcagaaatttgtattacaggcttctggagctatttgacagcgaagaccctcgcggaacgggacttacttgaaatagacagtctttacacagaatgtggtggcaagtctgtctctggtccttaggagctagtttgactccgagaatacagatgtaacatgtgattgtttctaagggtttgtgtattgcaaacagagacactctccaatggtgtagctgaactgnctgggaaatattagtggaagtattcatcaagtggcctctcgcgtgtataccctctgtaaggcaagaacaaccaagatcgagtcttctgggtgaaacgtagttggatccctgttacagcactgtactaggaggcgttaatcgactcttgccatgcgaccagctggcgatattgtactacgtacagctttctggcacgaaagatccgttcactcacagaaccagtctatgagggggttcatgcaacttttggcggttaaacatgtagtctaacaagaggtccatgtcccttggggaacgtggaatgaaatacttggagtgtgattgaaccttcaccgatttgttaagaatccaagaacctttgtttaaacaaaatcggcaagtgtgtatctaggccccatttcaggtggcagcaaaggcctctattattgggatcactgaatcctcatggggttgataccaagaaaaccttacgggtgtcccttccctcattgttccagcgctttagggttccacggacttgg

SEQ ID NO: 503317 - DNA, 387 bp, Homo sapiens
ccgtagtgtcataccaaatccacagaatctgactcagtgagttcatgaaaggttattgaatcaataagcagtaacatgatagtggactgcttcagacctggtgatattgttcatgacttcccaaattagaggtacctaagaaccaactgagaggcatttggcacatatacaggcacgttgttaaaacgtgtatgtctgttgcaaaccagaggggttttcaattaataaattaaaacagcacaattgtttcatcaatgagagaagctattgtttgagatctttccccaggtgtctttatctaccttgatgatggatagcttgtgctgtaggtgagattcttctagaacaaggcaaattttcttgcctgagactagaaaacattctctt

SEQ ID NO: 503318 - DNA, 856 bp, Homo sapiens
  misc_feature (22)..(22): n is a, c, g, or t
  misc_feature (62)..(62): n is a, c, g, or t
  misc_feature (71)..(72): n is a, c, g, or t
  misc_feature (115)..(115): n is a, c, g, or t
  misc_feature (153)..(153): n is a, c, g, or t
  misc_feature (167)..(167): n is a, c, g, or t
  misc_feature (182)..(182): n is a, c, g, or t
  misc_feature (232)..(232): n is a, c, g, or t
  misc_feature (245)..(246): n is a, c, g, or t
  misc_feature (253)..(253): n is a, c, g, or t
  misc_feature (257)..(257): n is a, c, g, or t
  misc_feature (265)..(265): n is a, c, g, or t
  misc_feature (292)..(292): n is a, c, g, or t
  misc_feature (343)..(343): n is a, c, g, or t
  misc_feature (364)..(364): n is a, c, g, or t
  misc_feature (366)..(366): n is a, c, g, or t
  misc_feature (372)..(372): n is a, c, g, or t
  misc_feature (417)..(418): n is a, c, g, or t
  misc_feature (421)..(421): n is a, c, g, or t
  misc_feature (430)..(430): n is a, c, g, or t
  misc_feature (439)..(439): n is a, c, g, or t
  misc_feature (474)..(474): n is a, c, g, or t
  misc_feature (494)..(494): n is a, c, g, or t
  misc_feature (540)..(541): n is a, c, g, or t
  misc_feature (577)..(577): n is a, c, g, or t
  misc_feature (668)..(668): n is a, c, g, or t
  misc_feature (821)..(821): n is a, c, g, or t
ggcgtggggggggcgcatgggntggccacccccagcagggtagttgagggagggcctggggnggcagcggnnacaggttaggcgtcgagaataggtcaagtgcgtaccgtggagngatcagtctgagggggaggctcccggctgggtacagtnaccaagaactgtgncacagtagatggggnagggggagggctttcgctgtcacgaaagattaaataacccccaaaatgcntttgaacaacatnntacacantaangaatttanaccttgctcctctgtcccactgggtanaccctggcccatcccccatccctggtcccatcccaggggcccagcctccgntgacgtcctcagagacacggngntagtgntggggggctgctgtgtgcctgccacccccaggagagggtgctggnnagnataccatantgaggttgnatctggtgccaccaggttgaactgaggcccagggncccagagagatgacagatanctggtgacagacagcccagggcggctggctgacagagtgagggggnncatgggcaggacctgcccggccccccaatgccacantgcgcatagctgcagaagtccttaacatttccctacgtgaatcggattgttctgagggctgaggccacacccggagaacaaactggatganatatattaaaacccgcagtatagttttcttccctaccccgctgcgggggagggtgctgcccacagcacaaaaacgtctttccatctgggctcgagaggacagcgtggcttctctcaaatgcacccgagaaataaaaaccattaaatacagatnatggcacgaggccgcctctccatccctccaagcta

SEQ ID NO: 503319 - DNA, 250 bp, Homo sapiens
ggtcgacccaagggcgatgagctggccagagatcagggttacgtactggaagctggagtagaagccacgacgttccttggtcgccatctcgctgaggtaagtggcggaggtgccgtattcgcccccgaccgacagcccctgcagtaggcgggcgaataccagcaggatcggcgcaccgataccaatggcttcataacccgggctcagggcaatcagcagcgagccgaagcagtcgacgcggcgtcgacgc

SEQ ID NO: 503320 - DNA, 1149 bp, Homo sapiens
  misc_feature (11)..(11): n is a, c, g, or t
  misc_feature (14)..(14): n is a, c, g, or t
ccgtaggctangtncgaggcctggcttctgataatcatggcgcccctcggaacaactgtattgctgtggagcctcttgaggagttctccgggcgtggaacgggtctgtttccgggctcgaatccagccctggcacggtggcctgctccaaccgctaccttgctctttcgagatggggctgccacgccgccggttcagctccgaggccgcagaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccgggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttaggactatgtatagccaggacaggcatgttgatgtcctcaatctctgctttgcccagtttgagccagattccacagagtatatcaaggttcatcacaagacctatgaagatatagataaacgtggaaaatatgaccttttacgttcaacaagatactttggtggaatggtgtggtattttgtaaataataaaaagattgatggtttgctgattgaccagattcagagagatttaatcgatgatgcaaccaacttggtccagctgtatcacgtgctccatccagatggccagtcggctcaaggggccaaggatcaggctgctgagggaataaatttaatcaaggtctttgcaaaaacagaagcacagaagggagcctatatagaactaacactgcagacttatcaagaagcactcagtcgccattctgcagcttcctaaaaatattttaaaaatacatttattttacta

SEQ ID NO: 503321 - DNA, 1435 bp, Homo sapiens
tggaaaaagtcagggaggccagggggtgggcttgaaaccagcttgggggggttcgatcccttcctttttggtctaaattttaagtgttatatacgggtttcctctcgaatgtggtggtggtaggggtggggggcatctccattattagtctcccctccgaggtgtttagtgggagggttctctctactattataggacttttctcgcttctcgaaagcgaaaggctctcctcaaatctcagtaaaaattatatttaatatattatagcgtggcgtgtgtatagaagaaagagtagaagtgagccccataacgagaagtgaaatagggagtggttcacagtggtggggtggcttgtggcattgcgggggatagctccccggaagataccacgtgctcggagcgcgcattctcccggagaaatagagccgcgacgaaagaacagtgtgtgtgtgtgtgcgcggaacagaaactgtgtttaagattttatacccgccccagaaatgagaaattatttagatatacaggtgagacacacttgggggactctcgcgggggggggtgtaagagtggtgtggagtgctctatagagggggtgtgtgacgcccttgagaagaaaaacatagggggggggacaaaactccagtgagagacacttatgaccacgcccccttcccatattggggagtggggcgcacaacattaacaaggggcctcccattatgttgtggatgtgacggggcacccataatacgtcgtgcggaacagtgtgcacgcccttacacacgacgccgtatagcaatacgcgtggtgttcttgcggggggaaataagaaataacgccgagaagttggtttacaataagagtgaaacagtgcaacgatatgtgggggccttacaatttcccacaatggggccccaagggctccacgggggccccacccccataagcggggggtggaaaacacgagagaacacacgggatgtggaaaatctccaataaggggggccctccaaagaaggccacctgggcgcacgcccgaggaaacttcccactatctcccaatatatgtgggggcatcacccggggggcgccagacggctgtggcacggcgagcccaattccataaagatgctcgcggagggagctaggccggggagcacaaaacacgccacaggggctacattgtgcaccaattgtggggccccaagtgggggctccaaaataacgcctgggggtatcctcctttggataccccccaagcgactttcctcttgtgtgattcaccacaaacggcggggggggaaagacattcagcgggcgccgagagaccacaccccccaaataatagggggaggcaggcacccgaaatcaatcaacacatctcctgcggaaataaaagcgccccaggggatttaaccccgttgctatgaaagac

SEQ ID NO: 503322 - DNA, 1789 bp, Homo sapiens
  misc_feature (11)..(11): n is a, c, g, or t
  misc_feature (14)..(14): n is a, c, g, or t
  misc_feature (1739)..(1740): n is a, c, g, or t
  misc_feature (1754)..(1754): n is a, c, g, or t
  misc_feature (1756)..(1756): n is a, c, g, or t
  misc_feature (1760)..(1760): n is a, c, g, or t
  misc_feature (1763)..(1763): n is a, c, g, or t
  misc_feature (1772)..(1772): n is a, c, g, or t
  misc_feature (1779)..(1779): n is a, c, g, or t
  misc_feature (1785)..(1785): n is a, c, g, or t
ccgtaggctangtncgaggcctggcttctgataatcatggcgcccctcggaacaactgtattgctgtggagcctcttgaggagttctccgggcgtggaacgggtctgtttccgggctcgaatccagccctggcacggtggcctgctccaaccgctaccttgctctttcgagatggggctgccacgccgccggttcagctccgaggccgcagaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccggtgttgatggaagtttcatctatgttatcttcagaacacatttagagactcctacacctctgaaaacttgagagtcagtactgtttggttaatttatacattaatcaggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttaggactatgtatagccaggacaggcatgttgatgtcctcaatctctgctttgcccagtttgagccagattccacagagtatatcaaggttcatcacaagacctatgaagatatagataaacgtggaaaatatgaccttttacgttcaacaagatactttggtggaatggtgtggtattttgtaaataataaaaagattgatggtttgctgattgaccagattcagagagatttaatcgatgatgcaaccaacttggtccagctgtatcacgtgctccatccagatggccagtcggctcaaggggccaaggatcaggctgctgagggaataaatttaatcaaggtctttgcaaaaacagaagcacagaagggagcctatatagaactaacactgcagacttatcaagaagcactcagtcgccattctgcagcttcctaaaaatattttaaaaatacatttattttactaaatactgactacatttctctgttaatattgagctaaatgttaaaaaatggctagattaaaagatatcaatttgtagttctccctacaaagcaaaaattattaccctactcacttttcgtaggctacaaggatatttgagtgcctggttatgaatttctcaaatcatgttagatgagcgtacggttaaaaagtctggtgtgtttttgtgttaccaaatagggcaaacgttaacttagacagacccccagcttaatgaggtcagaggaacagaggtttcacatcctgactccagaaatgggtagctgctagacaaaatcggggcaagacctgtggaatgatgcaatgaggtcaagaaaaagggtttagagaattacagcctggatattcagctctaagaaaaatgtgattgacaacattgaaaatgcagactgtagttatacacaacgaaaagacagtggggctgatccctaggcaggtgtagtnncggctcagcttctnanactngangcctatttncatattnagaaanggaa

SEQ ID NO: 503323 - DNA, 717 bp, Homo sapiens
  misc_feature (345)..(345): n is a, c, g, or t
gagaaagctggcttcctaagagttcacttatcgaacacaaactagcgagtccggcgttgagaagttacaagattggggctggaggctcgggcccggcaggctccggtggggcacacggtctggaggtctggcgggcctctggcttcccggccgggccgcgtccgcaggggatccgagcgctagagcccgcgcgccggcgccatccctcgacgctcgtcgtccaaggaagtccgaggtaatctcgtctgaggcctcccgcagctccacatcgtccagcaaccacggtaccccgccatgcccctgcttgccaaaagaactagcctccaccaaagtcgcgtggaggtnccccaggatgatcgaccccgggcgaaaacttccgaactcttcccagcctaccaaaggttacctcgaggaaagaggccgggggaacctttggggatgcatataagcattatgaactgtggctgagttctctgaggtcggactagcgactggtccaagtcaaaaagcttctcctttcttcgggttaccggtgcgcgccccgccgtggcgggaacacgtaccatccgtggattctctgtacttccccgttccctccggcgtcactcattgacgagcaaattgaccaatagggcctgagaggaggcttcacaggaaggctggtcattgagcagctggagggaacaaggctgcgagagggacaagccatggcgttcg

SEQ ID NO: 503324 - DNA, 135 bp, Homo sapiens
gcacgtgatcaccacacccattttaagccatttatatacccatatggtttggttaacatagtaactatatgccttccattaaagttatttaacatttcaaaaaattattttatgtcaaccaggtttccaagcaag

SEQ ID NO: 503325 - DNA, 2157 bp, Homo sapiens
gggagcacagagtggccagtatgtgggtgggcaggcctgtcatgacatcaggacaggtgctgaacttcagtgttctcatgtgatgctaactctgctgtgtggttttagactatgtatagccaggacaggcatgttgatgtcctcaatctctgctttgcccagtttgagccagattccacagagtatatcagggtgagtagattttagtttctaaaatataggcttaagtatggttatgagtaagatttttaatctagctcaatgaatttcgttgtaagttttgatacaggggaaagggaagagaaatacctgaaaatctattgagtacagttgtgtgccagatatatattttataatcacaacaacccttgattaaagatgagggaatttaagcttgtagagttaagtagcttgctgaaagttgcatagctactaagtggtagggttaggacccaagtttgatgacaaagcctattctcttttcagtttaccgtataggaatcaaattatttactaaaattttgctgaagtacagtgtgtttgtcttacagctcagtaagtattcattagtaccttctatgtgtaaggtattatcttgggtagtataggtgatgccacgaactaggatagagtatgctgtgccaaagccagcagtccggatatggctgtggggaaaggtgctagtaagtatacaaataattatctcctcaggcctaaaatgctagacactaagagaagattacaaattctttgaagaaagccttcataggggtgtaaaggagggttctagaagtgcaggaaatgttgtggcaggtggagctgggtgaggtgtttcaggtagagagaacagtataagcaacaggcaggaaaaaaggaggcttgagaaacggccagtgatctggtttgcttatatatgccatgcatatgtaggggagtgattaaagattaagttaggaaggtggatgtagccacatcataggtgacctcagatgctaggctgaggaatctggaattcagtcagcagacctttgaaagccttttgaacagaggaatgcccccatcagaaccttcatttaggaagatcaatctggaaggaggactgaaggacctttagttaataagatggaatgggctagctggtagaatagggtagttgatggggggagggataggggaaagggagagtagtgaaaaaatacttgatttcttttctgccatagtgaccaagaagtgggtgctacattatttccagtggtctctatatgcataatcggtgcttaataaattgtagttggcctgccaaaaagtacttaatatggctataaatgtttggtattttgcttcaggctgccacatacttctacagtggagaaggcacagacttgctgtcatttagacaaattcttctcttttaatttttttaaagacagggtcttattctgtggcctgccatgcccagctaattttttaaaaaattttcctagagatgaggactgctcaagcagtcctcccacctcagcttcccaaagtgttgggattataggcatgagccactgtgcctggccaaaattctttcttaatagaatcctccttcccacctaaggtgggttgtactaggaatggtttaaatcataccaattggttaatgatatggaggcaactgtaagtagacctggttttacttgcttgggcagcactcatgctaatcagtgtacgttgaataatgctgcatacttcttattttcatgtttctgaagagttgcattttatatcaaggttcatcacaagacctatgaagatatagataaacgtggaaaatatgaccttttacgttcaacaagatactttggtggaatggtgtggtattttgtaaataataaaaagattgatggtttgctgattgaccagattcagagagatttaatcgatgatgcaaccaacttggtccagctgtatcacgtgctccatccagatggccagtcggctcaaggggccaaggatcaggctgctgagggaataaatttaatcaaggtctttgcaaaaacagaagcacagaagggagcctatatagaactaacactgcagacttatcaagaagcactcagtcgccattctgcagcttcctaaaaatattttaaaaatacatttattttacta

SEQ ID NO: 503326 - DNA, 724 bp, Homo sapiens
  misc_feature (337)..(337): n is a, c, g, or t
  misc_feature (343)..(343): n is a, c, g, or t
  misc_feature (354)..(354): n is a, c, g, or t
  misc_feature (370)..(370): n is a, c, g, or t
  misc_feature (386)..(386): n is a, c, g, or t
  misc_feature (395)..(395): n is a, c, g, or t
  misc_feature (399)..(399): n is a, c, g, or t
  misc_feature (404)..(404): n is a, c, g, or t
  misc_feature (412)..(412): n is a, c, g, or t
  misc_feature (422)..(422): n is a, c, g, or t
  misc_feature (427)..(427): n is a, c, g, or t
  misc_feature (432)..(432): n is a, c, g, or t
  misc_feature (439)..(439): n is a, c, g, or t
  misc_feature (485)..(485): n is a, c, g, or t
  misc_feature (652)..(652): n is a, c, g, or t
  misc_feature (657)..(657): n is a, c, g, or t
  misc_feature (659)..(659): n is a, c, g, or t
atcccagcacttgggaggccgaggcgggtggatcacgaggtcaggagatcgagaccatcccggctaaaacggtgaaaccccgtctctactaaaaatacaaaaaattagccgggcgtagtggcgggcgcctgtagtcccagtcacttgggaggctgaggcaggagaatcgctagaacccaggaggtggaggttgctgtgagccgagatcgcaccattgcactccaggctgggcaacaagagcaaaactgcaaaaaaaataaaataaaataaaaaaagaaagtacatctcaaaaaaaagaaagaaagacaagaaaaagaaaaaaaaaagaaacaccttngtcttngtacagtcagngggctcccaggaaaangttccttctcttttgntggcatggncacngtggnatctggtncattccggtngacantctcntttattnggactgtaagtctgacctctatgaataattacttcagcccctgatngctcccgtgccaagctccttggccaaactttcaccttagcttctggtaagtcttgggccaagctaagcagcatctatcaatcatcccttcagctcctgattggtcctgggccaaaggcctgggccaagctgagccacacgtttttcaagacagcctgtgaactaggnacatntncttccttcccagtccttaaaaaccctggacccagcctccgtagagggcaccacttttcagacacc

SEQ ID NO: 503327 - DNA, 111 bp, Homo sapiens
ctgtgaaaagttccgacattgtggtcttgccaaccaaattaatcaatgtcgcgccaggtgcagtctctataattttttcggcaagagcggcctccccttgcgagccgatca

SEQ ID NO: 503328 - DNA, 814 bp, Homo sapiens
  misc_feature (11)..(11): n is a, c, g, or t
  misc_feature (14)..(14): n is a, c, g, or t
ccgtaggctangtncgaggcctggcttctgataatcatggcgcccctcggaacaactgtattgctgtggagcctcttgaggagttctccgggcgtggaacgggtctgtttccgggctcgaatccagccctggcacggtggcctgctccaaccgctaccttgctctttcgagatggggctgccacgccgccggttcagctccgaggccgcagaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccgggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttaggtttgggccaatttcaccagggatatcaaggttcatcacaagacctatgaagatatagataacctgggtttgcccttatccgtaacacgatccttgtgggaatgtgtggactctggaatttactggggtcg

SEQ ID NO: 503329 - DNA, 512 bp, Homo sapiens
agcatcagaggcatgcgggcaggcgccaggcaccaggggagaggcagcatcgagtataaggaaaaagcgggtgaactcaggaagaacaagagatacgggactgagcaaagaacaagaaagagaaatatatggaacacagacagagctatgggaacacacgggaacctcttttagaaaacctgacaaggcgagtatgactaggatcttttccgaagagcacaagcccgggcttcagaggatttggagaagttaaggctgcaaggccaaatcacagagggaagcaacatgattaaaacaattgctttgggccgctatgagcttgatacctggtatcattctccatatcctgaagaatatgcacggctgggacgtctctatatgtgtgaattctgtttaaaatatatgaagagccaaacgatactccgccggcacatggccaaatgtgtgtggaaacacccacctggtgatgagatatatcgcaaaggttcaatctctgtgtttgaagtggatgg

SEQ ID NO: 503330 - DNA, 196 bp, Homo sapiens
ggattcagcagcaccgttaatggagtgactggcatccaaaatgggatgggattttgcataactctgccatagcagtttacagctgcatccatgggctacacaacaggaaccagcattacacttgggaattccggccttttgcctggcgtttccagggcccggatttaggataaggggaaaattaccatatttggaa

SEQ ID NO: 503331 - DNA, 890 bp, Homo sapiens
  misc_feature (22)..(23): n is a, c, g, or t
  misc_feature (28)..(29): n is a, c, g, or t
  misc_feature (32)..(32): n is a, c, g, or t
  misc_feature (742)..(742): n is a, c, g, or t
  misc_feature (746)..(746): n is a, c, g, or t
  misc_feature (757)..(757): n is a, c, g, or t
  misc_feature (769)..(770): n is a, c, g, or t
  misc_feature (780)..(781): n is a, c, g, or t
  misc_feature (784)..(784): n is a, c, g, or t
  misc_feature (787)..(787): n is a, c, g, or t
aaacttcggctaggtcgaggcnnggtgnncgnaacactgtattgctgtggagcctcttgaggagttctccgggcgtggaacgggtctgtttccgggctcgaatccagccctggcacggtggcctgctccaaccgctaccttgctctttcgagatggggctgccacgccgccggttcagctccgaggccgcagaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccgggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttaggactatgtatagccaggacaggcatgttgatgtcctcaatctctgctttgcccagtttgagccagattccacagagtnttcncggtcctcccngacttgagattnntaacgggganntgnccnttcgtccccgtcttggggccggggggtttgccctcccccagtggtggcgtgcccccgagttctgtgccctggcgggttgccccggggtcgggcgcggggggta

SEQ ID NO: 503332 - DNA, 312 bp, Homo sapiens
ctctggggacagcttcccttggcaataatgtgcagcaggatcatggtgccaggactgttcttacacacattcattcatgggatcctcacaacccagtgctatgaatggatacagctgttaccccatttttactgatgggcaacatcacaaggcagggagcagcagtagaatggctccagagcctgtgttcttgccaccaccatgactgcatctcaaaagagaagtccaggtcaggcacagtggctcatgcctgccttctcagcctcccgagtagctgggactacaggcgtgaaccactatgcctgggaccca

SEQ ID NO: 503333 - DNA, 1560 bp, Homo sapiens
  misc_feature (1510)..(1511): n is a, c, g, or t
  misc_feature (1525)..(1525): n is a, c, g, or t
  misc_feature (1527)..(1527): n is a, c, g, or t
  misc_feature (1531)..(1531): n is a, c, g, or t
  misc_feature (1534)..(1534): n is a, c, g, or t
  misc_feature (1543)..(1543): n is a, c, g, or t
  misc_feature (1550)..(1550): n is a, c, g, or t
  misc_feature (1556)..(1556): n is a, c, g, or t
cagctggagtccagagaagttctgacagtgcagggagcagcccctttgttctgtggagcactggaagggctgagctgcatctgaggtgttcaagccaccaacaggacagggtagaggactaagtagcacatgtcccccagagcagcttcctgtctttgtgtggtcacatcacatcgggggaaatgggcatgtgtcaagaagtggagagtgtgatgcttgcatatcatcaagccttagctgtattgtcattttggagctgcatacctctcaaaaccatgggcttatgtacatttatctgtaagtgctgagagttgagatgatattttcaggaagggaaggggaggagattgtataattaatttcatctcttctaatgctcagaatatacatggttttgtggaactggcttctatcctagtaatactgtttcatgctgcaaagctaaggaaacaatgacctgtgatgacatcctaggaagagtagagagaaactacagtactgattttctttatgaacctgataaagcgcaatgtttttggagaaaatattctttaaagtcaaaagttagtttggtaactcttagcctccagatttctctctaacctaatggtttttgttttgatctcgaaggaagtattaatattaatacaatgtcagggtcttaattggatacttctggtgtttagaattagtattgcttgaaatgtgttgggtattgtttttctgtccatgtgtgtttattaattattgtataatcgcggagaaaaattgtgaaatctgaaagacctttttaagtaggactctttgctactacagaaatgctaatgatgtcttaaaactgaaaaactttataaatagcatatgtcctattgttttaaaattttctttttaatttaaacaggtctttgcaaaaacagaagcacagaagggagcctatatagaactaacactgcagacttatcaagaagcactcagtcgccattctgcagcttcctaaaaatattttaaaaatacatttattttactaaatactgactacatttctctgttaatattgagctaaatgttaaaaaatggctagattaaaagatatcaatttgtagttctccctacaaagcaaaaattattaccctactcacttttcgtaggctacaaggatatttgagtgcctggttatgaatttctcaaatcatgttagatgagcgtacggttaaaaagtctggtgtgtttttgtgttaccaaatagggcaaacgttaacttagacagacccccagcttaatgaggtcagaggaacagaggtttcacatcctgactccagaaatgggtagctgctagacaaaatcggggcaagacctgtggaatgatgcaatgaggtcaagaaaaagggtttagagaattacagcctggatattcagctctaagaaaaatgtgattgacaacattgaaaatgcagactgtagttatacacaacgaaaagacagtggggctgatccctaggcaggtgtagtnncggctcagcttctnanactngangcctatttncatattnagaaanggaa

SEQ ID NO: 503334 - DNA, 206 bp, Homo sapiens
  misc_feature (64)..(64): n is a, c, g, or t
  misc_feature (82)..(82): n is a, c, g, or t
caaaaattcatttatcataatattatcccattctataattacattctctcatattttaaccatntaaatagtatttatttcntatctaaaactcaactatataatacattaaaataaatcttattctttccaattaaccaccacttcttccttatataatattactataattaaatcaaataaattttttcttaacttcaaaaaaa

SEQ ID NO: 503335 - DNA, 1027 bp, Homo sapiens
cagctggagtccagagaagttctgacagtgcagggagcagcccctttgttctgtggagcactggaagggctgagctgcatctgaggtgttcaagccaccaacaggacagggtagaggactaagtagcacatgtcccccagagcagcttcctgtctttgtgtggtcacatcacatcgggggaaatgggcatgtgtcaagaagtggagagtgtgatgcttgcatatcatcaagccttagctgtattgtcattttggagctgcatacctctcaaaaccatgggcttatgtacatttatctgtaagtgctgagagttgagatgatattttcaggaagggaaggggaggagattgtataattaatttcatctcttctaatgctcagaatatacatggttttgtggaactggcttctatcctagtaatactgtttcatgctgcaaagctaaggaaacaatgacctgtgatgacatcctaggaagagtagagagaaactacagtactgattttctttatgaacctgataaagcgcaatgtttttggagaaaatattctttaaagtcaaaagttagtttggtaactcttagcctccagatttctctctaacctaatggtttttgttttgatctcgaaggaagtattaatattaatacaatgtcagggtcttaattggatacttctggtgtttagaattagtattgcttgaaatgtgttgggtattgtttttctgtccatgtgtgtttattaattattgtataatcgcggagaaaaattgtgaaatctgaaagacctttttaagtaggactctttgctactacagaaatgctaatgatgtcttaaaactgaaaaactttataaatagcatatgtcctattgttttaaaattttctttttaatttaaacaggtctttgcaaaaacagaagcacagaagggagcctatatagaactaacactgcagacttatcaagaagcactcagtcgccattctgcagcttcctaaaaatattttaaaaatacatttattttacta

SEQ ID NO: 503336 - DNA, 267 bp, Homo sapiens
  misc_feature (27)..(27): n is a, c, g, or t
  misc_feature (29)..(29): n is a, c, g, or t
  misc_feature (34)..(34): n is a, c, g, or t
cggtacccgcggtatgtcttacgacantncaccncattaattcctttccgtcttccccaacattccaccacattaattcctttcctgtcttccccaacattccaccacattaattcctttcctgtcttccccaacattccaccacattaattcctttcctgtcttccccgacattccaccacattaattccttgacagcatccccctctcattttcccccttgttatgcatttaacacttccaattgtccgtaagacataaccgcgg

SEQ ID NO: 503337 - DNA, 1682 bp, Homo sapiens
  misc_feature (11)..(11): n is a, c, g, or t
  misc_feature (14)..(14): n is a, c, g, or t
  misc_feature (1632)..(1633): n is a, c, g, or t
  misc_feature (1647)..(1647): n is a, c, g, or t
  misc_feature (1649)..(1649): n is a, c, g, or t
  misc_feature (1653)..(1653): n is a, c, g, or t
  misc_feature (1656)..(1656): n is a, c, g, or t
  misc_feature (1665)..(1665): n is a, c, g, or t
  misc_feature (1672)..(1672): n is a, c, g, or t
  misc_feature (1678)..(1678): n is a, c, g, or t
ccgtaggctangtncgaggcctggcttctgataatcatggcgcccctcggaacaactgtattgctgtggagcctcttgaggagttctccgggcgtggaacgggtctgtttccgggctcgaatccagccctggcacggtggcctgctccaaccgctaccttgctctttcgagatggggctgccacgccgccggttcagctccgaggccgcagaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccgggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttaggactatgtatagccaggacaggcatgttgatgtcctcaatctctgctttgcccagtttgagccagattccacagagtatatcaaggttcatcacaagacctatgaagatatagataaacgtggaaaatatgaccttttacgttcaacaagatactttggtggaatggtgtggtattttgtaaataataaaaagattgatggtttgctgattgaccagattcagagagatttaatcgatgatgcaaccaacttggtccagctgtatcacgtgctccatccagatggccagtcggctcaaggggccaaggatcaggctgctgagggaataaatttaatcaaggtctttgcaaaaacagaagcacagaagggagcctatatagaactaacactgcagacttatcaagaagcactcagtcgccattctgcagcttcctaaaaatattttaaaaatacatttattttactaaatactgactacatttctctgttaatattgagctaaatgttaaaaaatggctagattaaaagatatcaatttgtagttctccctacaaagcaaaaattattaccctactcacttttcgtaggctacaaggatatttgagtgcctggttatgaatttctcaaatcatgttagatgagcgtacggttaaaaagtctggtgtgtttttgtgttaccaaatagggcaaacgttaacttagacagacccccagcttaatgaggtcagaggaacagaggtttcacatcctgactccagaaatgggtagctgctagacaaaatcggggcaagacctgtggaatgatgcaatgaggtcaagaaaaagggtttagagaattacagcctggatattcagctctaagaaaaatgtgattgacaacattgaaaatgcagactgtagttatacacaacgaaaagacagtggggctgatccctaggcaggtgtagtnncggctcagcttctnanactngangcctatttncatattnagaaanggaa

SEQ ID NO: 503338 - DNA, 1209 bp, Homo sapiens
  misc_feature (11)..(11): n is a, c, g, or t
  misc_feature (14)..(14): n is a, c, g, or t
ccgtaggctangtncgaggcctggcttctgataatcatggcgcccctcggaacaactgtattgctgtggagcctcttgaggagttctccgggcgtggaacgggtctgtttccgggctcgaatccagccctggcacggtggcctgctccaaccgctaccttgctctttcgagatggggctgccacgccgccggttcagctccgaggccgcagaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccgggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttaggactatgtatagccaggacaggcatgttgatgtcctcaatctctgctttgcccagtttgagccagattccacagagtatatcaaggttcatcacaagacctatgaagatatagataaacgtggaaaatatgaccttttacgttcaacaagatactttggtggaatggtgtggtattttgtaaataataaaaagattgatggtttgctgattgaccagattcagagagatttaatcgatgatgcaaccaacttggtccagctgtatcacgtgctccatccagatggccagtcggctcaaggggccaaggatcaggctgctgagggaataaatttaatcaaggtctttgcaaaaacagaagcacagaagggagcctatatagaactaacactgcagacttatcaagaagcactcagtcgccattctgcagcttcctaaaaatattttaaaaatacatttattttactacagtctactcgctaatgtattataatcattgtctagcactcatttaattttataatatct

SEQ ID NO: 503339 - DNA, 111 bp, Homo sapiens
aagcacaagaaaatcccaactatgtgaaaaaatcaccaagaaaaacacatggacacaaggaacttcacgtaaacagctcaaagcataacaggtaacgaccaaacaaccacg

SEQ ID NO: 503340 - DNA, 1663 bp, Homo sapiens
  misc_feature (22)..(23): n is a, c, g, or t
  misc_feature (28)..(29): n is a, c, g, or t
  misc_feature (32)..(32): n is a, c, g, or t
  misc_feature (1613)..(1614): n is a, c, g, or t
  misc_feature (1628)..(1628): n is a, c, g, or t
  misc_feature (1630)..(1630): n is a, c, g, or t
  misc_feature (1634)..(1634): n is a, c, g, or t
  misc_feature (1637)..(1637): n is a, c, g, or t
  misc_feature (1646)..(1646): n is a, c, g, or t
  misc_feature (1653)..(1653): n is a, c, g, or t
  misc_feature (1659)..(1659): n is a, c, g, or t
aaacttcggctaggtcgaggcnnggtgnncgnaacactgtattgctgtggagcctcttgaggagttctccgggcgtggaacgggtctgtttccgggctcgaatccagccctggcacggtggcctgctccaaccgctaccttgctctttcgagatggggctgccacgccgccggttcagctccgaggccgcagaatctggtagcccagagaccaagaaacctacatttatggatgaggaagttcaaagcatactcacgaaaatgacaggcttgaacttgcagaagacttttaagccagctatacaagaactgaagccaccaacctataagctaatgactcaggcacagttggaagaggctacaagacaggcagttgaggcagctaaagtacgattaaaaatgccaccagttctggaagagcgagtaccaataaatgatgtgttagctgaagataagattttggaaggaacagaaacaaccaaatatgtgtttactgatatatcatatagcataccacaccgggagcgttttattgtcgtcagagaaccaagtggcacactacgcaaagcctcttgggaagaacgggaccgaatgatacaagtttatttcccaaaagaaggtcgtaaaattttgacaccaataattttcaaggaagaaaatcttaggactatgtatagccaggacaggcatgttgatgtcctcaatctctgctttgcccagtttgagccagattccacagagtatatcaaggttcatcacaagacctatgaagatatagataaacgtggaaaatatgaccttttacgttcaacaagatactttggtggaatggtgtggtattttgtaaataataaaaagattgatggtttgctgattgaccagattcagagagatttaatcgatgatgcaaccaacttggtccagctgtatcacgtgctccatccagatggccagtcggctcaaggggccaaggatcaggctgctgagggaataaatttaatcaaggtctttgcaaaaacagaagcacagaagggagcctatatagaactaacactgcagacttatcaagaagcactcagtcgccattctgcagcttcctaaaaatattttaaaaatacatttattttactaaatactgactacatttctctgttaatattgagctaaatgttaaaaaatggctagattaaaagatatcaatttgtagttctccctacaaagcaaaaattattaccctactcacttttcgtaggctacaaggatatttgagtgcctggttatgaatttctcaaatcatgttagatgagcgtacggttaaaaagtctggtgtgtttttgtgttaccaaatagggcaaacgttaacttagacagacccccagcttaatgaggtcagaggaacagaggtttcacatcctgactccagaaatgggtagctgctagacaaaatcggggcaagacctgtggaatgatgcaatgaggtcaagaaaaagggtttagagaattacagcctggatattcagctctaagaaaaatgtgattgacaacattgaaaatgcagactgtagttatacacaacgaaaagacagtggggctgatccctaggcaggtgtagtnncggctcagcttctnanactngangcctatttncatattnagaaanggaa

SEQ ID NO: 503341 - DNA, 263 bp, Homo sapiens
agacagaggcacggagagaaaggaatgtttagcacaagacacagcggcgtccgggatttgctaacctccatagtatttatggtggcccccccggggccccacccaagtttgaggcacttaggtttttctacccattcccggttcctctctccctagagcttgtaggggtactccctaatataggaagtaagctcgaggtaaattggacacgtcccaagagaagctttgagagagcccctcttttcctttaaatttaaccaatt

SEQ ID NO: 503342 - DNA, 288 bp, Homo sapiens
tatgcacgagaaagataacatgcccgcagactgtctccttcgtatgagcgcagcttccactttcctgtaggctatactgtacttcacggcatatatctcaatctcacatttattagcaagatgacactggctttgagcactctaagaacaggcatattatagaccctcttcagacacatcacatggcctggcttacctgatacaatttggtaatttctctgaagtatactcaaatttcaaacatctatctacaggattatctaaatgaaacacagcagcttactccag

SEQ ID NO: 503343 - DNA, 809 bp, Homo sapiens
gaaaagaagaaagagaaaaccacaaaacaatcagaaaacaaaataacaaaatggtaggagtatgcccttacttatcaataataaattgcatgtaagtggactaaattgccaatcaaaaggtgtaaagtggctgaatgaataaacaaacaaggtccattgatctgttttctgcaagaaacacacctcacctatagagacaaacagactgaaaataaaggaatggaaaaaattactccatgtcaatggaaaccaaaagcgagctggagtcgctattcttagacaaaatagattttaagacaaaaactttaagaaaagacaaagaaggtcactatagaaagataaaggggtcaattcagcgagaggatataacaattgtaaatatatttgcacccaacagtggaacaccaagatatataaagcaaatattatcacagttaaagagggagacagaccccaattcagtactagctggagacttcaacaccccagtttcagcattggaaagatatttcagacagaaaagcaatagagaaaaaacagacttaacctgcaacagaccaagtggatataatagatatttacagaacatttcctcaaatggctgcaggatacacactcttttcctcagcatatagatcattctcaaggaaagatcatatgtcagttatgtattacgataagtattagaacattccaaaaaatcgaaataatgcgtcttctctgatcacaatgaaataaaactagcaatcaaaaccagaggaatttcggaactgtacaaacactggacaattaaccatatgctctgaatg

SEQ ID NO: 503344 - DNA, 587 bp, Homo sapiens
gacgtcaccatacgacggaacggaatgaaataccaatagtatagagaactggtgctactgtgagttcgtactgacgtctttctcattctgagcttgtcatgtgttaacccatgaagtgtgacatcaggggagctttcgtgaggcagtcattcttagcttttcccggaattaaaatgttacaggacacacatacacacacagagagcatttcaaggccacacctccacacctgccatgggatgttaatgtggcagggggtggggctcattctgttgggaggtcaaattaccaatgccaaggactgttgattttgtttttatttttattttttcttctagcttttcagaagatggaaatgagacagttgagtccaaaccccaatgctgacagccatatgcatttgaaaatctatctagattacagatgggcatttattactggcagtggaaacaccagatagaagatcttaggagaggcccagaaatgcatcaccttgtcatgacaaaagagagggcagtagagtagggatagttacaaatgcatccatcttaattattctcaataggcttgtaaatcttatcgatgga

SEQ ID NO: 503345 - DNA, 168 bp, Homo sapiens
aaattcaatcacgcatcattacattaaactcgggtctctatgttagcctcctactagcctcagagtacatcgagtctcccttcatcatttccgacggcatctacgcgctcaacattttttgtagccacaggcttccacggacttcacgttcattattgggttatcgag

SEQ ID NO: 503346 - DNA, 153 bp, Homo sapiens
gtatgtatgaccacgaatgacgacgacggacggtgactggactactgactggtggttactggacggtttatgactgacactactaggtggactactaataacttaccggatactgggacatgactggactttgactagaccagacactgacga

SEQ ID NO: 503347 - DNA, 302 bp, Homo sapiens
aacatgtcgtaggttgaaaaaggtaataaacatcagtacaatcactatctttccttggtacatattatggtggcagtatacatgaatatcactaatcagtatgattattctcagagggtgctgctctataatgaaaatgaacattatagctaatgtttatacctcaaactctgctttcggtaaccaatcagtgtataaatgttggtgtgttctatcataaaatttaaatacaattcgttattctgtttccaacgtgttagtatgtatgtacaacatgatagtacaggcacgatatgtacggt

SEQ ID NO: 503348 - DNA, 108 bp, Homo sapiens
gaccaccctctctttcacctcgttctaaaattcacaccagtggacagcaggcctgcagcatgtctgtggaaatttatttaaacttatgtatgattcatagaagactga

SEQ ID NO: 503349 - DNA, 485 bp, Homo sapiens
  misc_feature (7)..(8): n is a, c, g, or t
  misc_feature (10)..(10): n is a, c, g, or t
  misc_feature (12)..(12): n is a, c, g, or t
  misc_feature (18)..(18): n is a, c, g, or t
  misc_feature (227)..(227): n is a, c, g, or t
  misc_feature (266)..(266): n is a, c, g, or t
  misc_feature (270)..(270): n is a, c, g, or t
  misc_feature (324)..(324): n is a, c, g, or t
  misc_feature (344)..(344): n is a, c, g, or t
  misc_feature (368)..(368): n is a, c, g, or t
  misc_feature (402)..(402): n is a, c, g, or t
  misc_feature (438)..(438): n is a, c, g, or t
  misc_feature (469)..(469): n is a, c, g, or t
gacgganngntntctgtngcccaggctggagtgcagtggcgccatctcggctcaccgcaagctccgcctcccaggttcatgccattctcctgcctcagcctccccagtagctaggactacagatgcccgccaccacgcccagctaattttttgtatttttagtagagacagggtttcaccgtgttagccaggatggtctcgatctcctgacctcgtgatccacccgnttcagcctcccaaagtgctgggattacaggcgtgacacncgtngcccagtcttttccttatttctttaaagattcctcatttctggccctttccttnaaattttttgatgtaaactnaaggaaataaggattattcacttnaaaacatttaaggaatttatcacaattatggttngatggggatagaatattttacgttgaccacacaggntattcttttgttacgggcaaaatctacacantcaaggcaaactggtt

SEQ ID NO: 503350 - DNA, 324 bp, Homo sapiens
tgggaggatccctaatcacagtgtcgtctacggaatgagagcgttgtctgatgcatgatgcattacaaggttccttgatactcactctcactctgatttcccaagctggcagtgacagtcatgcaatcatagctcaccgtgaccttgaactcctgagctcaagggatcctcctgcctctagcctcctgtagtacctgggaccacaggcagatgtcaccacacctggctaatttttaaatttttttgtagagttagagtcttgctatgttgaccagactggtcttgaactcctggcctcaagcaatcctcccactttaacctccc

SEQ ID NO: 503351 - DNA, 2780 bp, Homo sapiens
gaggggccggaggcgtccccgctcccgctcgctactagcccgcgggccagcgccgcgtcccgagccccggcgggagccatggctctaaaaggacaagaagattatatttatcttttcaaggattcaacacatccagtggattttctggatgcattcagaacattttacttggatggattatttactgatattactcttcagtgtccttcaggcataattttccattgtcaccgagccgttttagctgcttgcagcaattattttaaggcaatgttcacagctgacatgaaagaaaaatttaaaaataaaataaaactctctggcatccaccatgatattctggaaggccttgtaaattatgcatacacttcccaaattgaaataactaaaagaaatgttcaaagcctgcttgaggcagcggatctgctacagttcctttcagtaaagaaggcttgtgagcggtttttggtaaggcacttggatattgataattgtattggaatgcactcctttgcagaatttcatgtgtgtccagaactagagaaggaatctcgaagaattctatgttcaaagtttaaggaagtgtggcaacaagaagaatttctggaaatcagccttgaaaagtttctctttatcttgtccagaaagaatctcagtgtttggaaagaagaagctatcatagagccagttattaagtggactgctcatgatgtagaaaatcgaattgaatgcctctataatctactgagctatatcaacattgatatagatccagtgtacttaaaaacagccttaggccttcaaagaagctgcctgctcaccgaaaataagatccgctccctaatatacaatgccttgaatcccatgcataaagagatttcccagaggtccacagccacaatgtatataattggaggctattactggcatcctttatcagaggttcacatatgggatcctttgacaaatgtttggattcagggagcagaaataccagattataccagggagagctatggtgttacatgtttaggacccaacatttatgtaactgggggctacaggacggataacatagaagctcttgacacagtgtggatctataacagtgaaagtgatgaatggacagaaggtttgccaatgctcaatgccaggtattaccactgtgcagtcaccttgggtggctgtgtctatgctttaggtggttacagaaaaggggctccagcagaagaggctgagttctatgatcctttaaaagagaaatggattcctattgcaaacatgattaaaggtgtgggaaatgctactgcctgtgtcttacatgatgttatctacgtcattggtggccactgtggctacagaggaagctgcacctatgacaaagttcagagctacaattccgatatcaacgaatggagcctcatcacctccagtccacatccagaatatggattgtgctcagttccgtttgaaaataagctctatctagtcggtggacaaactacaatcacagaatgctatgaccctgaacaaaatgaatggagagagatagctcccatgatggaaaggaggatggagtgcggtgccgtcatcatgaatggatgtatttatgtcactggaggatactcctactcaaagggaacgtatcttcagagcattgagaaatatgatccagatcttaataagtgggaaatagtgggtaatcttcccagtgccatgcggtctcatgggtgtgtttgtgtgtataatgtctaattgaatctgcagaaatgaccaagcaatcacttttttggagtatagttttataaaaaaagaatgcagggtttgaagttccttacctgataattgtgtctggcacatgataggggatcagtaaattgtaattcctaaccctactgtactcccaaacatggtgattcatggtcaagaaaaatcttatatatatatatacacacacatatatatgtgttcatatatatgtatacatatatgtgtatatatacgcatgtatgtatacatatatgtgtatatatacgcatgtatgtatgcatatgtgtgtatatatacgtatgtatgtatacatatgtgtatatatacgtatgtatgtatacatatatgtgtatatatgcgtatgtatgtatacatatatgtgtatatatacgtatgtatgtatacatatatgtgtatatatacgtatgtatgtatacatatatgtgtatatatacgtatgtatgtatacatatatgtgtgtatatacgtgtgtatgtatacatatatgtgtatatatacgtgtgtatgtatacatatatgtgtatatatgcgtgtgtatgtatacatatatgtgtatatatacgtgtgtatgtatacatatatgtgtatatatacgtgtgtatgtatacatatatgtgtatatatgcgtgtgtatatatatacacatatatacgtatatatgtatatatatatacacagttgaatcagtgggattaatacctataatctctggttttcaaaggtaatatggaatatttgacacttggtaaaaggtgaactacctttgtagtgaatcttttcctcttggtagcatcaacactggggataaatcagaaccattctgtggaatgaaatgtttctcaagagcctataatatagtagatagtgcatattaagatgtctggctgggcatggtggctcatgcctgtaatcccagcactttgggaggctgaggcgggaggatcacttgagcctagaagttggagactaacctggcgagaccctgtctc

SEQ ID NO: 503352 - DNA, 407 bp, Homo sapiens
agagttctggaagtgcggaatcagggagacatgccactagctgagcttcccagaagtccaccaagagctgagggatggtatcttcatccttaccacaaagcaccttaaagaaagaatctgcttcttcaatcccaattttgctgttcttctgcaatcccaggactgaagccaccagcaatcctggctgagtctccttcaagtgagtcgcaagctcagttggaacaatctgtcccttcctgtgttgaatcaacaggcgtggttccaaaatgaagccacacaccaacttcatctctggatggcttttcatttcatttctgtacacgtcaagatctcccattttcagtgccactgctgccttgctcagtgtcactaagatggatgaaaacccagaagtatccatcttcttt

SEQ ID NO: 503353 - DNA, 887 bp, Homo sapiens
ggagttataaatctttgcctcttttttaaaaaagttaaatgttgaagacccccagattaagcaagtgcacagatagttttgcttggggcagattcacctaatcctagtagttctgaatcttgtttcctaagagtggaggtttggtgaagttactgatgctttaataatgctggcttcaaaggagttgaatgtggctgtactgtgagtttgtggctcataaaatatgtctttacttaatatcccaaataatagcagaagaacgaaggtcaaaacgacattttaaaaagtgctgtaacagagaaaatgtagagaaatgtgcaattgtataattagaattataagagataattcattcataatcgggtggcattttctagagagattttcctgcctgtgtaccggagctccatctttgtgtcagagtaacaaaccatctgaaaagtccagatgaaagaaagacaaggccgagtgcatagcagttcccatctcacatgtttaaggcttgtttgcccttccaggttcagggttcttctggggtatatgacagtcagatggtcaaggtcattgtagggcacactgcctcctcctaacagaaatattgcttacccttgtgtgattaatgggtaccactcataatagatttgatgaatccaacgtgggagggggggacttatatctagacaaaactttcaggtgattctggagctatgatctgatgtggtttgtcaatgcggaacaacaattggtgggtttcacagagtggtgattaatggtctacacaattgcgtatcagtgggacggcgcttaaaatattacatttcttctttaaagtgagaacgtaattttgaaaaaaaaagggggggcgaacatgggggaaatacggttta

SEQ ID NO: 503354 - DNA, 118 bp, Homo sapiens
ccacacgccacgggagaggtatattactgaatcacatgcaatcttatatacttacataataggttgaaccatatgagactgccttctccggggcgtggtccttctccggtggcgtggt

SEQ ID NO: 503355 - DNA, 292 bp, Homo sapiens
tccgatgtagtggctttaaacccacagaagtaacctgcaggaacacacttatatacctgagggccttgctcttcatctataccaatgaaaatcatacctaaaaggagaaaagaccctaattaaaggttttagcttaatacagtgacatatcctgtttcttgggggtgccacatagctgctgctaagcatgactttggccatcaattttaggatatgtatttccctttaggaaaactgataaaatacaggttatcaccacaggcaaattaggtaacaggtaaattcccatttc

SEQ ID NO: 503356 - DNA, 184 bp, Homo sapiens
caacggccactgtttattttgccaatatatgacactgctcagtgtcgcgttagcgcataacatcagactggttccgcctgggtgttatgcgtgcgtctcagttctccagcctgtgaatgtgcccggttgaatggaatagcggaataccgcgtggtattgcactggatcctgcccgaagcattag

SEQ ID NO: 503357 - DNA, 2082 bp, Homo sapiens
attattgttttctctgtattattgttgtgttgttttgagttatcgttattattttatgtttattgattttattgttttaggttattgtgtgtgtagttgtgttttatttagtagttatttgtgtttgtttgttgttgtttactagtgtgttgtttttaggttatgtttgtgtttagttatatagtattgttgtttattgttttttttaagttgtgttgttatagtatggtgtcttctattctgtttgtttgttgtttctctagagtgttctttagttatttggtcagtattgttttatctatttatattttatatctagtgtagtgtattgttttagtatagttgtctatgatttagtaagtatgttgatggttgttatgtgttatgatgtgtagttgcagacgcatgagattgggcgttaagagtcgaatgtatggtttagcgcggtagtttgttctcatagtgatatttctcgtgttaggattgagttagttttagtgtcgatctatcatagatatactttctttttctagtcttattgtgatcttgatttatgcataacgatgaggctatggttgatattgatgatcatgcgtggtgatagtttgttgatgagtattatttgattatttttattgttttttatttatttttttatgtttgttcttatatttttcgtttttgtgttgctttatgtatagggctgtttttgtcttgtcttgatggttgtattgctatgtgtttttgatagtcttaatcagtgattggtatatttattgtcttatttatatcggtgatttctatgcttgttgagtgttgttcatgatagttcaggtatgatttttgttgtttagtgtttattttattttcatagttcgttgtgtgtgtgtgtgtgatgagtgttgttagaggttgctatgttgttagtatagttctagttttgtgatcttttttttgtatattttagtatctgttgtgcttttgtttgtgtcgaattgtttagtaagtttatcatgttgagtggatgatgtgttgttgttattgagtatatggatgttgtttgttatagtggttgtttagtgtttgtagtagtatgtgtatattttttatcgtgtgtagagttaatttttttctgttttgtatgtgtgtttgtttttgtgtgttgttgttctctcccacttgtttgtttattgttctacacttcctggtgcgcgtgttgaacaacaacagtagtggagtgaggacgacctagatagtagtggaccgctatggtgtgtgatgggtgtgtgtgagttgcttcaatagaacgacaacgtcagtgtgaccagggatgactggtttgtatgaggttggttctaacgcaccctgtgattataggtgtgaatcgttgctgctagtaagaggtaattccacccacacataaatgtgtgtgtgcaccctaaatatataaacgcccacgagccgtttgtgtgtaggagacaccgcaccgggcccctacgtgtgtacgtgtgatggatacagggtgctgctctagaagaggtgtagtctcgaaggcgctcttcgggtgttgtgtgtcgctggatattttgcttcgcgcttcactacgaaggttcatttagaggtggtgtgtataatctacgttgtggcttgattgatatagaggttctcattgtggtctctgtctcctcaatagaggctctccatggctggctcgctctttcttgtctcgcgcaaatgcacttctgggagataatgtttgtatgtgaattattgcacaaggacgttgtctcagtgctgtccaccagcacaccgagctgataatggatgtgctccaagtcttgtctatgaagtctaagaataaaagtataggacaaacaggtgaaggtgttataaggttctgatgcgagccagagtaccgtttacaccactggtctagtcatctgtacctaagaagaaggaagaagaaacttgtaacccagtccctgtgcacccccggtttggccagtgaaggtaactgtataatgatacccagacaccctgattggaacgtgtattatattataaatacgtgaaaatccttaa

SEQ ID NO: 503358 - DNA, 454 bp, Homo sapiens
cacactgaaacaaaaacggcggcattgttgtacgcagtgtgtacgaatggaggctgagccacatatagttctagcagctgccgaggaaactggctgagtctaatgttacagtatttctgctcagtaagggtatccagtggtgataactctcatgatgacggtagtcatcctggtaaccatcctggtatcctgggtggtaactatgggtcactcatagcctgcagactcatcttcggggcagcgcatccccagtgactgctgaatcgccatttcctgtctccgaagttgcatcgaatcaattaaatcgtacacaatcaccatggaacacattggggaaggataccaggatttgacatatccgtcttttccaactagaagcatggagaagtactccgggctcacttgaaaatagttacgaatgtctttcaccaaatgggctggtacgtctacctcg

SEQ ID NO: 503359 - DNA, 131 bp, Homo sapiens
tcagactgggccgtaagtgccgcatagcacatcaatatgatttcgctaacttagttttctagccatactatctgtacatttattttccttgaaatgcaccgcaaggcttacaagaagctcaagggcatcga

SEQ ID NO: 503360 - DNA, 701 bp, Homo sapiens
tgggttgttggtttggaaaaagagtcttgctctgtctccctggctagggtgtggtggtgtgatcttggctcaggagccttgccctccctggtcaagcagcttcatctcacctccaaagtactgggactacggcatgtgatatgatgccggtgattttggtttactttttagagagatggggtcttgccatatttggccaggcgtgtttgaactcctacaactcaagcattcctcccacctgggtctcccaaattgtggggaccacggttgtgagccaccgcgcccagttaactcctgtgtttggtttggtttggtaacttgggttgatgtaaggccctccatttgggaaagcaggaaaacaggattttttttttaatcttgtcccctggaggatccaggatgaggattaaagtggctgagagcagtgctgggatccagcctccggggggctccttcggctggatacgggccccaaaaggggggggttgtgcgcaggagctgcgccttccgggggtgcccgggtggttgtttcagcagaaaacgctggtggttacccctaaaggtcaaggtttgggtgcctgttgtttcggttcgacacaattcccggaatcaagggcgggggagaacctcccctcatgttgttgccaccgtgtgcatgtatgctagaggcgtgcctgaaacataagggtcatgttctccgc

SEQ ID NO: 503361 - DNA, 319 bp, Homo sapiens
gtggctgttctagaggatcccatttcagcactttgggagtctgaggcaggtggattacttgaggtcaggagttcgagattagcctggccggaatggtgaaaccccgtctctactaaaaatacaaaaaaaaaaaaattagccaggtgtagtgccacgcacctgtagtcccagctacttgggaggctgaggcaggagaatcacttgaccccaagtgagccaagatcgtgccatcgcactccagccggggttgacaagagtgaaactccattctcaaaaaaaaaaacgagaaaaagaaaaccattccacgggccggacacag

SEQ ID NO: 503362 - DNA, 1575 bp, Homo sapiens
  misc_feature (805)..(805): n is a, c, g, or t
  misc_feature (1072)..(1072): n is a, c, g, or t
  misc_feature (1094)..(1094): n is a, c, g, or t
gggccagtgaggtgccggcggcacgccggggaaggcgcgggccgagcagattcggggcgttggagccctgcgcgcgcattgaggcgttgccggggatgtccccttgaatgggcagagtgggagatcaatgagaccggcggagctcgcgcatccctcagttgccatccactgctgctctctgcgtagcaggagcgtgggactgcggcctgcaggtagtcagcgcgtggcattgcgtgacaggcgctggccaagctagacacggagaactagtgctgcattacaagtctcattgcggtccggcaggtttgtgtggagagcactaggtttggccgcttaattttgtgcatctcttggtctcaccataccaacatgttcacttatacgatacaccgggttcgacagatactattcgatggatttcatgcttgcttccggggactaggaccataacttacttccctccaggggtttctatccgtaggggtgacccaatttgaggctagagacgccttgggagaatggggcttgatggaacccaaaacgagatttcccggttgaaattgacgcccttgggaacctttcttcaatatcaggtggatatctctcggaacgggttcccgaaatcctttgcagacagaaaccacacgcagggagggcaccctcgataggaggtttcagaaccgttgtattctctataggacaagcgcgattgtgaggcgatacgcgataacaaatatgttgcggatactcgtgaagggctttggcaccaacgacaaattacaataggcgaggcattggctttacnttaacctctttaagggcatgattgggtcaatcttcccccgaagaaaaggctctccacaaacgtgaagcccgagaattgttaaagacttttgtggcagcaactgactcaaccggggtggtggccccagttaaaggaccgaggcacgacagttgactattggcattgtcaccacttaagtttatttgtgcctgtccgaagtggcgcttggcgggtcatatacttgggatcaacgagcttttctttctacaattctaaccggatagtagnttttcccgccttatgttgaagntttgcaagcaatttcctccgttgatgttacggtgggcgccacgttttgggctgattaatacaaatgcccacgcgggagacacttgtgcccagggactttcaggtgacacctcttgagccaacacacagcttggtaacgtgtgggagggactattcatttacagagagccagagatatttgaaagatttaatcagtcttttcccagagttgtgtttggacatacggggtataacaggattattaaacgcacaaggaaacgcgggaaagagggtgcatatctaccggattgggggctattctgtaattagggaaggggaatttaatagcgttggacatgtttcgagataatttgtcgttaaggaaaagatttatccagaaaagaaggttaattatattcagtgcgcttattggattagttattatagttgaacaggggttttataaaaagagaaaggggtagtcagtggagaaacggaaatag

SEQ ID NO: 503363 - DNA, 546 bp, Homo sapiens
gcagcgcactccagcctggcgacagagactccatctcaaaaaaaaaaaaaaaaaatcacaaaataacaatggaagaggaaaacaaaactgggccgggggaaggcgcgtctgaagctgccacatctgggtgggtgtgggcggcagctacctaggtgctgaggcaagagactgagggcacgagcggtcccagtataataaaatacattaaaaatagttatactatattatagatcatagatatgattatatatgaatatcattaatcattagtgggtagcaactactctttttcccaatattataataatcctcgctctacaatcatagcctaggaaaaaccaggccgtacagagatttgaggggacttagtgaggagtacccagaagacaagagtgcgagccttctgttatgcccagacagggccaccagagggctcctgggtctagcggtaatgccagcatctgggaagatgcctatggccaggccaaccatggtctagcggtagcatcagtgtcaaggaaaaacacctgccacttagcagacggg

SEQ ID NO: 503364 - DNA, 188 bp, Homo sapiens
cgtcatttagacccttatcagtagaacagataggatcctgagctacttcatactgtatctttgtgcgctacatctttgtaattagcctggggccatcgtccattatcctgttcatcttctgcattctcctacatggctttcacaatatctcccagcataatttagtcttccactattccacaccccat

SEQ ID NO: 503365 - DNA, 104 bp, Homo sapiens
tgcctcctatctgaatcagatctatctgaatccagtcctcctatctgaatccagataaaagtacaaggccatccgcctcatttttgtcatcatggcgatctgga

SEQ ID NO: 503366 - DNA, 107 bp, Homo sapiens
tagtataaccacactgcttttggctacatttgtatctgctgctcctctgctggaaaaccctttccactgtttttttttatttaacaggatctcgcatctgtacaccc

SEQ ID NO: 503367 - DNA, 291 bp, Homo sapiens
ggcgtgcgtggtgcgtgtgtgttgtggaggaggcgcggacccttagatcacattcttgagctcgtcgtacaggcacagcacgaaggcgccccccatgccccgcaggacgtaggaccacgcacccttgaagaaggccttgcccccctcatctctgaaaatcttcctccaacagtcgacggtgcccgtgtacatgatgtcagctcctttgcgcccggagtgcatcatcatgcgccgacgcaccgtgtcgaagtgggtaggacaccacgccgatcacggacaaccccctgggga

SEQ ID NO: 503368 - DNA, 199 bp, Homo sapiens
gctctccgtgaactggtgctatgtgtgtgtctctcctgccaggtgctgtgtgtgtgtcctctcctgcctgggtgccgtgtgtgtgccctctcatcctgcgtgggtctgtgtgtgtcctctcctgcctgggtgctgtgtgtgtagtcctctcctgcccgggtgctgtgtgtgtgtcctctcatcctgcctgggtgctatg

SEQ ID NO: 503369 - DNA, 405 bp, Homo sapiens
  misc_feature (404)..(404): n is a, c, g, or t
tgcttcttcttcttgttcttgttcttcttcctcttccctcccctctttttcttcttttccttctcttttttctttctctcctcttcctccttttccttctttttcttcccagtgagtaagtgctaagtgtttttatgtgcattatctcacctaatcttcctcataaatctgagaagaatttttatccctgaaggagaaaaatgaagctcaagaaggttaattttcccagggctccatggctagtaattagtaaaaggatttttttttttaattagctgggagtgttgctcatgcctgtaatctcagcactttgggatgctgaggtggaaggattgcttgagcccaggagttcaagaccagcttgggcaacatagggagaactccctgctccagcgcccctctana

SEQ ID NO: 503370 - DNA, 330 bp, Homo sapiens
ctggccacccgcagcctggagcgcggcagcaggtccccgcccccgagcgatctatgcacttattggtcgggggcacgtctctcacgctcgctccaccccgcccaccttcatttgcaaagcagcagtgcgcagactccgcctcacgctcggccccgcccgtctgttgagcgccagttcggccgccacggcgcaggcgcggccttcaggctcgcgacagctacgccagccccggggtgctgcagtccccgtgtccccgtcggacgcatacagccctgacgacctccgctcccagacgccggggacgcgggctcggcgcggcgttgcggccgc

SEQ ID NO: 503371 - DNA, 708 bp, Homo sapiens
tacgggcggcgcgaccgcgcgtcggtctggcggcgcgtgtggaccccttcggtgtgctggcctcctccatcgtcctgcccgtggccttgggccgcagccacggtgtggcttctggccttggcgctggcggctgcggccgcgcccgctgccgggggcccgcggcccgagccagcccagagctgccggaagggccgcccttcccggccctggcggggtgctggacactggccattttcactagagtttgcctggcagggaccgatctctgccccctcctctccccaggcctctggctgcaagtgatgccgcagaatcctgagaccaggtgcctcctgagcagcccgtgcgcctctccacagcggcgtttgccacccaatgcggctcgcttcagatgctctgatgcagagggcatgcccatagtccctctgacagagcctcgcactggggccagggcaggcaccaagcccaggcggaccagtcggacacggacctgtcctcttcctcgatagcgtctgctcctcacatttgtgtcgatggtgacttaggagaattgttccgattttccctgatctaagcaggccacgtttaaaataacatcaaggcgagcgtacgtgtcacccatctgtactgacattctcctcccctgaaatgctttcaagtttgaccagcccgtgatcctagacaagtgcacctggggtttccagggac

SEQ ID NO: 503372 - DNA, 807 bp, Homo sapiens
ggagagaactagtcttgagttttctttgtgtgttttaagtcttagcatttactttccccaccccaaattctgggaacagcctttagtttctacgggaaagggccctgatggacagaagactagcatttaccttcattgaaaggggctgttaagagctgccgtgggaaagagggcgtgcctgggggaacgtgggaagatgccgtcagtgtgggtgggcaggaggacagccagtcgtccgtgctgccagcccaatagcttccaggggcagggtgcccagggtgctacgggagccccttcataggggttaggggcagggacgtggaccttccttccgagggcactcatgcgaaagccctccgtggtacctcctcagtggggctttgagcctttactcaccacaggtggggccgcttgtggacgccgtggggcttgcgaccacaggctccggtctataagaggggaatattagaccataggggcacaatttcgggtccttcacacagtgactgtgggaaagtggcgagatataacctcaagtgggcagagtggtgtcctccgtggccaaaaccagtgatccccttatgtgctcccttgggtgcgcacaaattctcgtgaacctcttttacaccccgggccgcgaaatcgtgctaccggggattcaaccggatattcttgggagcgcatctgggaagaggctccccggggtagaggccggcagaaaagccaaggggcttgcgcagaggggggatcacggggtggaccagcaaggctccgcgggataggggggccccccgggaacagcgcctc

SEQ ID NO: 503373 - DNA, 181 bp, Homo sapiens
aatcctctgggtgcatgctggttagctcttgtgtatactgatatcgttggcactcagcgactcatcaatctcataaaattatgagtaattatatggactaatcatcgagtaattagagtgacatgtctctaagaaaaaaaattcactttggagggatttctcatctaaatgtaaatgttta

SEQ ID NO: 503374 - DNA, 860 bp, Homo sapiens
cccaagcgtcggtttcgaggaaggagtacttacgcgcccaatgatgatgaatggaaaaatacttttcaggtagaatcgaaggggttaaagtgttaccatatgtgcctagacaagggttctttactagaaagacagcgcaacttgaagtgcttttctgtactgtttgtgacctaatttatgtggaagatggttatagcattaggatgttagtaaagatttgtgttcctgattctaaacttatggtgaagaatagagctgtacagatgaatttctttgatgtcgaatagggaacataaggaagagcaagcagtcttacttgccttgtacaatatagagacatatgaatagtcgataacagttttcaacgtgtgtactagttctctgttaaactagtattcctagaaacatagctttgaacaacctggtctttgtcaggcttgtccagagtgccgttcatggaaagacataagtctacaagaagtattggtgtaatccgacttgtcttacatgagtaagttttccctggtaacaattttagctacagggatataatcttatcttatcctaggagttgcgttaccatactgtggaaaatctgctgctggacgacaataatgggaacgttgtcacccattgggcaataatattgtgctttcctctgtcttcaattgcatagtactgcgtcaagaattacaacaggccattggttgtcctaggcgtaaagaatgactcgttactattattccaccttttacacctcattaaaatttgtacattggctttgcaatggacaggttggtcaatattcacttgaaagaattatatggaaatcattacaacgccccttctcagtcccatta

SEQ ID NO: 503375 - DNA, 888 bp, Homo sapiens
actgctcggcactggtgatgcttgctgccacgatcgacgcacatgtctgcaagtgatccatctgagcgtagactcgtcgacaccgtcagaccatcagctcatattccttgccaggtgcaccagcagcatgtatgtgatcataggacgccggagtgggtccctaggggaggagggaggttgctcatggagtgtaggatcctattgccaggtgctgatgatgtggaagcactaatcgcatctctgaggatgcagactactctggcgcgactacgtcgaatcgttcgtacatcagaagacctgggtaacactcgaacgtgcgcgtaggttgggagagacaactcttctactcgatcaaactcgcgaagcacatttgcgccctcgaatcgcgaaaaccctctattgcgtcgtcgcgactaaatcagccgttgtagcaaggcgccccgggcaagtgcattcccattctgctcccatgggtctgggagctgatccctccaatgcggggaacgttctagccgcaactgtcccacgctagagcgctagttggtggaccttggggtatgttgagccatgtggctgaggggctgatgctactgtagggaccaggcctttctggggacatgcctacagtctgatggacgtccacgggtcatccgacgaactgcggcggagaggttctctccggtgaaaccagggcgctagtaggtgtactcatgtaactcaggtcgtgctggcctgctcgcagttggcctagtaatgaaggttgatgcttacgcgtggcttgaacccctggagtctgaagcaggaatcagcccttttaccagctggatttggtttcctgggaaaaaggatggattcaaacggtgtgaatcacaaattcagtgccctcct

SEQ ID NO: 503376 - DNA, 983 bp, Homo sapiens
ggctcagcatgtggagacgctctcagactctcggtgcacggccagtttccttcacgaatgtctactggttcatgaaatcctgtgtgagttgcagattggatggtgatcactctagacaccccaagtgcttttgggtctgtctgaggctgtaataattttgatgctggagcgggatgcttggaatgatgtgaataccagcataaagtaccaaaggtgtggatgaggtcaggcattgttcaactatttgtgaacctagctcggctaggctaatggcgacagaagacgggtatatctgcttcgctctaccaggaaagaggaccaaaaaggaactaggcctcagccgactgaagtcagacttatctggcctaccctgggatgatcgggagaattgtggtggcctatgtgatagactccgtggcttcgagtattgatcgccttcatgaggcttgaacagcttccagtgaaaagggggctgggaagcctgacgaggatcttctctcatttgatgatcatctggctccataagccagagtcagtgaggctgctggaccttttgaccgacgttcgtcccggcggatgtaccgcgactggtctggcgagggccttatttctggaacttctctgggtgacttccgcaagctgggtgggtgcccctggcagggggtaaacaggcagaggatggctccgtccgggatatgaacctggtgaccaagaagcgcgggaatccctactgacgcggtggtgagcaggaatggactggggttccccaagggctaattagaaccgggcggggaggcgccgccggaggatggaggtaaagaccgcataaggtgaagactggacaagtggaccggaggttacagggtgtacaaccctgttgtggggtttcccaggggggcaagataaaatccggggagagaaaaggactaatcaggacaggtgggccacagctaggcgcttactttcttacgtgtggggggatg

SEQ ID NO: 503377 - DNA, 468 bp, Homo sapiens
aagaagtacatagcacgattaaaaagatcatcatactcaagtgggattcatcccagggatgcaagggatggttcaacatatgtaaatcaatcagtgtgatacatggtatcaacagaatgaaggacgacaagagggtattgtcatttcaatagatgccaaaaaaatctttttggataaaattcaatatcccttcataaaaactctcagcaaactggggacagaaggatcatccctcaacatgataaagccatacacaacaaacccacagttagtatcagactgaatgggggaaaaactgaaagcctttattctaggatctagaagaaggatgggcactttcaccactattactcaagttagtaacagaagtcctagccagagtaaacagacaagagaatgaaaaagggcatttaaatgggaaaggagtaagtaaaattatcattggctattgaaacttctaaaactagg

SEQ ID NO: 503378 - DNA, 678 bp, Homo sapiens
agcggagttctcccgggcgcctagcgggatcgacagcgcggcagtgggggcttccgcggctgcaagccagcgggtcctgtgagggcgagcggaggcggagaaagggcgcgggagtgagacgagggtgagtcagcgcgactgtctatgcgaataacacggggaggcctctgcgcgggatagggctgaattcagaaggtgcggtccgtgccggagtcctgttccaggacgcggcttgtcttagcgtcagcgagggaaggttgaggaggagccagagcctggtcctgctagcctttctctgccgtgcagagcaccgtcgcctatctcacagcagtgcagtcccgggaagacgtccgggctctcgccgactcgccagtccccgtggtgggaggcggtccaagaggatgtcgagagccctcggtttctgggcttattcacgggtccaggaggagttaaaggagcacggtccattctgtagccctgctggacacagctcaagtccttctacgacgcgcgggtgctgtgtgatgtgaccatcgaggtggtgagcgcctgggagcgggcctggcacgggtcgcctcttttcctgcaatcgcgacggtgctaggcagctgcgtgtccctacttcaagagcatgttcagcaggtggcatgtacgagagccagcaggccagcgtgagca

SEQ ID NO: 503379 - DNA, 123 bp, Homo sapiens
gggcctcgacttttgagcgatgagatccccgaccattgagcagccttttgctccttccccagaggaggcgtgagggtgggctatatagaaacattccaaataaaattgtctttctcaaagcca

SEQ ID NO: 503380 - DNA, 162 bp, Homo sapiens
ccttttttaagggggaaaattttggggccccccctggtggctttatgctggctttattttttggtttggtaattttttcccaccaggtggttcccattttggtttttgccccttaaccaatttggggaattaatgccttccgaaaccaacttaaaccatgga

SEQ ID NO: 503381 - DNA, 990 bp, Homo sapiens
  misc_feature (763)..(763): n is a, c, g, or t
gccggcgggcgatttttgtcgtttacaggtgagagggagcggttgagtcgcaaactactctgattattttttttatttggctctaaatgaacattctacaaaaattgaaatagaaacactaaatacagggattggacatagcccatctttgttaaatgccctattcttttcattggataaaggggatctacacacctggagggacttgagggggtctagaataattactaaacaatatataaaaacaatcacttctgtttctttggcagattatagctacacccagctggtttagcagcccattcccgtgctaggagtacttagcaatgcaaatatcggcaacctattgtgtgtatttgaccgcctgttcgtattacgcattgatcgcacagatgtcgaaatgtgtctttttctcggtggcagacccttcaactccggccgtgatcgatccttgtgaagcccgtttgcaacagaaccacccctcccattacaactatttacagtaagcacgttctcccgcctgtcccgcgtcgtatattactatgtgggtggcaggtaagaatacctatcgttcttgatgtattcaaaacagataaatctgatataagctcacttatgaagtgcatggaaagaaacaggggtggacacaggggtctctggagacatgaaaactcaaagtggcgtccagtacaaactgcggagcaggcttattggccggttgataatatgagtctcttcgtccgcggtcagttattatattggngtggatgcgcgaactgggcacaggagaaaaatgagggggcaatactgataattgattgatggtagaaatcggcaggatgttatacgtggggagataaaggcatacgcttgtcgcaatctatcctgggtgtatgagtgggttcggaagtgttactgcgaatgtggttaagatgcctttctacttccataccatatacgtgagaccaatttcgtgctgcgcagagaaga

SEQ ID NO: 503382 - DNA, 737 bp, Homo sapiens
ggggctcctgtggggcaggccagtgtcttacacagcttcgtcaccacatccccacatgtcccatcctgagcagtgcagtatggcattacctcggggtgccactcttagctgtcatatcacgaatcaccagtagctacttagctaatttcagtgcttttcgttttggcttaagttttcagaacttgcagtaaaatcagcatagtacaacaaggtgacagtgcggtttttcttccagacttcacgttctcatttccttatgtctcatgagcataaattccctgccatatctgcaatgcatatatattttccttccaacttcgtcatcgtttggtcttaatacatatggccaaacatgcatattacaccagtcgggtaatactcacttaccaatatgatctgccagatcattccgtattcagcacatacgtctgtttctcgtccagtgtcatctacacctcacaacaactctgtactcccctgttactcccccatttacagaggagactggaggtctggagatattcactgcactggctggagggtcaccaccaatgactaagagcgacagtccacctttgcctcagcagtcctgcaaagctcctggacaatagactcttcacatggtccatgtggcctcactcttccaaccgtggtgtcatgagtaccctgtacgatctctaggaggactccctcaatctgcacactggtagtacaaggtgtatgcattacacaattgt

SEQ ID NO: 503383 - DNA, 239 bp, Homo sapiens
tcacactactccccatatctccacaaaaaaataaacaaggttggccaggtgtggtggcgtgcgcctgtggtcccggctactcgggaggctgaggtgggaagagcacttgagctctggaggtcgaggcttcagtgagccatgatctcgcccctgtactctagcctgggcaacagagtaagaccctgtctcaaacaaaaatgggtgaatagagaatgttctaagtcattactttccttgtg

SEQ ID NO: 503384 - DNA, 146 bp, Homo sapiens
tgctgtgtgcagcagtggtggagtggtggggggcttgtggctacatgctgggaagtgccatgagcaggcccatcatacatttcggcagtactataggaccgttactatcgtgaaaacatgcaccgttaccccaagcaagagtgtcg

SEQ ID NO: 503385 - DNA, 776 bp, Homo sapiens
gctgcagaccagcctgggcaacatggtgaaattccatctctacaaaaaaatttaaaaattagccaggcatggtggcctgtgtctgtgattccagctactcaagcaatcctcctgagtgatcccatttcttaatcagtgtagccccaagaaggctggggctatttaccagggtagaaaaaggagcttacctcccacctttggtcctaagtccctgccccctccccttcacaccataactaggtaacagtttgataactagggaagaaagcagaacagttaagcagccgccacatccccgctggctgggggcctcactccaggaaggggctggactggctgtcctttccagtggcctggctccgctgtgtggatggggagatcggggccagaggcagaaccctggtgaggaagctccagtcctgctctctacccagcccatcttgcctccatggtgcctctggaggcctctgggcctcctctaacaggggctggtgggcaccaagagccaatggagtagacccctggctggtaagggccaagtcccaccggttgcttctgggaaggggtttctaacactagtctgtgtgctgtggttcctggggtgccctccactgccctctgttcagtaacagggccttgctaatcgggttgtcactcaacaaaagtgctttggatttaagttactatcctggctttgcccaacctcagcaacctgtaagactgataatgaaataaatcatgttaatcctaaaaaaaaaaaaaaaaaaaaaaaaaaa

SEQ ID NO: 503386 - DNA, 2658 bp, Homo sapiens
aagcggcacgaggctcgggttgtgccaccgctggactcccgtgtccctccgcgcaggcgggcggccccggagcgctggtgccggcagaggcggcgacggtggcgcccctcctcatcatgaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaaggagctgcgacaattcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcacgctcccaacacaaggtgggcagggaggcaccattcaggaacctggaccaaagctgacgaggctgggccaagccagggatggggccacagccagaaccccgagccctacttccaggttctggttagctcagccccagcccagcccagctgctctgcccagagctgggtgagtggggagacacctcagagccccgcaaaacccactgaccggaggcaaaaggcagtggggctgggggtagttttccatggtcacagagaactagtggtggctctgagaaggggaggacctctgggctttgattccatctccttgtcttttttctttgtttttagagacagggtcctgctatttcccaagctggagtgcagtggtgcgatcatggctcactgcagcctcgaactcctgggctcaagcaatcctcctgagtgatcccatttcttaatcagtgtagccccaagaaggctggggctatttaccagggtagaaaaaggagcttacctcccacctttggtcctaagtccctgccccctccccttcacaccataactaggtaacagtttgataactagggaagaaagcagaacagttaagcagccgccacatccccgctggctgggggcctcactccaggaaggggctggactggctgtcctttccagtggcctggctccgctgtgtggatggggagatcggggccagaggcagaaccctggtgaggaagctccagtcctgctctctacccagcccatcttgcctccatggtgcctctggaggcctctgggcctcctctaacaggggctggtgggcaccaagagccaatggagtagacccctggctggtaagggccaagtcccaccggttgcttctgggaaggggtttctaacactagtctgtgtgctgtggttcctggggtgccctccactgccctctgttcagtaacagggccttgctaatcgggttgtcactcaacaaaagtgctttggatttaagttactatcctggctttgcccaacctcagcaacctgtaagactgataatgaaataaatcatgttaatcctaaaaaaaaaaaaaaaaaaaaaaaaaaa

SEQ ID NO: 503387 - DNA, 635 bp, Homo sapiens
acaccataactaggtaacagtttgaaggggagggggcagggacttaggaccaaaggtgggaggtaagctcctgccccctccccttcacaccataactaggtaacagtttgataactagggaagaaagcagaacagttaagcagccgccacatccccgctggctgggggcctcactccaggaaggggctggactggctgtcctttccagtggcctggctccgctgtgtggatggggagatcggggccagaggcagaaccctggtgaggaagctccagtcctgctctctacccagcccatcttgcctccatggtgcctctggaggcctctgggcctcctctaacaggggctggtgggcaccaagagccaatggagtagacccctggctggtaagggccaagtcccaccggttgcttctgggaaggggtttctaacactagtctgtgtgctgtggttcctggggtgccctccactgccctctgttcagtaacagggccttgctaatcgggttgtcactcaacaaaagtgctttggatttaagttactatcctggctttgcccaacctcagcaacctgtaagactgataatgaaataaatcatgttaatcctaaaaaaaaaaaaaaaaaaaaaaaaaaa

SEQ ID NO: 503388 - DNA, 322 bp, Homo sapiens
ccacctcagcctcccgagtagctgggactacaggcacgcgccaccgcgcccggagggttaagggctcccggagggttaagggctcccggagggttaagggctcccggagggttaagggctcccggagggttaagggctcccggagggttaagggctcccggagggttaagggctcccggagggttaagggctcccggagggttaagggctcccgggggttaagggctcccggagggttaagggctcccggagggttaagggctcccggcgggttaagggctcccggagggttaagggctcccggagggttaagggctcccgg

SEQ ID NO: 503389 - DNA, 665 bp, Homo sapiens
actagttctagatcgcgagcgccgccttttttttttttggttaggattaacatgatttatttcattatcagtcccaccggttgcttctgggaaggggtttctaacactagtctgtgtgctgtggttcctggggtgccctccactgccctctgttcagtaacagggccttgctaatcgggttgtcactcaacaaaagtgctttggatttaagttactatcctggctttgcccaacctcagcaacctgtaagactgataatgaaataaatcatgttaatcctaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaagaaggggggggggggcgaccaaaaagaatacccacccaggggagggcgcacaactcgacgccggccgccgccgcggttgtgtgcttgacaagaagagggaggcgccccacaggaggggggagacccatatattaaacagcgaggaggatcgcggggtgcgcaacacacaagcgaacgtggaagggagaaaacaacactggggaggagaggaccaccaaggggagaaacaacacacctccgggagggggagcacaatacgcggccgacacaacacggag

SEQ ID NO: 503390 - DNA, 328 bp, Homo sapiens
ccgtgtggctccaggtgcacatcccttctatcagcgtggatgcttatcaaaaacagtcgagaattcagtcagcagttagtagagcctaacagctggatgtgataccggaagaggtagaaagcttaacagagagatcatggaaagagctagtcaaagacagcctggctcaatgtcatcccaggtagactccggacttgccccaggggggcgtgtgtgccgacgtctggcatcacgggggtctgctgtctgtggatacttgaggatgttactacgtgtagcgcgagggaggcgcctgtgggctgcttggggtctgtgttctccatctacc

SEQ ID NO: 503391 - DNA, 322 bp, Homo sapiens
agccttaccctagtggtagtagcaaatattcaaacgagaactttgaaggccgaagggttaagggctcccggagggttaagggctcccggagggttaagggctcccggagggttaagggctcccggagggttaagggctcccggagggttaagggctcccggagggttaagggctcccggagggttaagggctcccggagggttaagggctcccgggggttaagggctcccggagggttaagggctcccggagggttaagggctcccggcgggttaagggctcccggagggttaagggctcccggagggttaagggctcccgg

SEQ ID NO: 503392 - DNA, 154 bp, Homo sapiens
ctgactgatcccttaaccttatgcctgtgggatgggacagacctgtatacgtcccccagccctgacacccgtaaatgggtctgtgctgaggaggattagtataatgaggaaggaatgcctctatgcagttgagacaatgaggaatggcatcttg

SEQ ID NO: 503393 - DNA, 148 bp, Homo sapiens
  misc_feature (133)..(133): n is a, c, g, or t
aatgtctttgccccccccccgccagcccgcgatacgggcgcagttccctatattcatgttatttatttgtgtcctgactccctctgccccgtccaaataaaaaaccccaaggttcgagcccccgggccccgcnaactccgggtcggga

SEQ ID NO: 503394 - DNA, 2794 bp, Homo sapiens
aagcggcacgaggctcgggttgtgccaccgctggactcccgtgtccctccgcgcaggcgggcggccccggagcgctggtgccggcagaggcggcgacggtggcgcccctcctcatcatgaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaaggagctgcgacaattcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcacgctcccaacacaaggtgggcagggaggcaccattcaggaacctggaccaaagctgacgaggctgggccaagccagggatggggccacagccagaaccccgagccctacttccaggttctggttagctcagccccagcccagcccagctgctctgcccagagctgggtgagtggggagacacctcagagccccgcaaaacccactgaccggaggcaaaaggcagtggggctgggggtagttttccatggtcacagagaactagtggtggctctgagaaggggaggacctctgggctttgattccatctccttgtcttttttctttgtttttagagacagggtcctgctatttcccaagctggagtgcagtggtgcgatcatggctcactgcagcctcgaactcctgggctcaagcaatcctcctgagtgatcccatttcttaatcagtgtagccccaagaaggctggggctatttaccagggtagaaaaaggagcttacctcccacctttggtcctaagtccctgccccctccccttcacaccataactaggtaacagtttgataactagggaagaaagcagaacagttaagcagccgccacatccccgctggctgggggcctcactccaggaaggggctggactggctgtcctttccagtggcctggctccgctgtgtggatggggagatcggggccagaggcagaaccctggtgaggaagctccagtcctgctctctacccagcccatcttgcctccatggtgcctctggaggcctctgggcctcctctaacaggggctggtgggcaccaagagccaatggagtagacccctggctggtaagggccaagtcccaccggttgcttctgggaaggggtttctaacactagtctgtgtgctgtggttcctggggtgccctccactgccctctgttcagtaacagggccttgctaatcgggttgtcactcaacaaaagtgctttggatttaagttactatcctggctttgcccaacctcagcaacctgtaagactgataatgaaataaatcatgttaatcctaaaaaaaaaaaaaaaaaaaaaaaaaaattcgggggttttatgtgggggggggaaaaaagggttttgaaaagggctgggcataggtggttttcgggcccagtttttttggtcaaaggtggaattgggggcccaaagaggggcggataaatcgaaaagcagtacg

SEQ ID NO: 503395 - DNA, 142 bp, Homo sapiens
tgtcacaccagctcacaccattccagtgctcagcctagcacatgtgctttaatgcacacttctcagacctgtgatccgtgtatctactccccagtgacagaagtcgagaagagaatggaacgcagcatactccccccgcatg

SEQ ID NO: 503396 - DNA, 3016 bp, Homo sapiens
aagcggcacgaggctcgggttgtgccaccgctggactcccgtgtccctccgcgcaggcgggcggccccggagcgctggtgccggcagaggcggcgacggtggcgcccctcctcatcatgaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaaggagctgcgacaattcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcacgctcccaacacaaggtgggcagggaggcaccattcaggaacctggaccaaagctgacgaggctgggccaagccagggatggggccacagccagaaccccgagccctacttccaggttctggttagctcagccccagcccagcccagctgctctgcccagagctgggtgagtggggagacacctcagagccccgcaaaacccactgaccggaggcaaaaggcagtggggctgggggtagttttccatggtcacagagaactagtggtggctctgagaaggggaggacctctgggctttgattccatctccttgtcttttttctttgtttttagagacagggtcctgctatttcccaagctggagtgcagtggtgcgatcatggctcactgcagcctcgaactcctgggctcaagcaatcctcctgagtgatcccatttcttaatcagtgtagccccaagaaggctggggctatttaccagggtagaaaaaggagcttacctcccacctttggtcctaagtccctgccccctccccttcacaccataactaggtaacagtttgataactagggaagaaagcagaacagttaagcagccgccacatccccgctggctgggggcctcactccaggaaggggctggactggctgtcctttccagtggcctggctccgctgtgtggatggggagatcggggccagaggcagaaccctggtgaggaagctccagtcctgctctctacccagcccatcttgcctccatggtgcctctggaggcctctgggcctcctctaacaggggctggtgggcaccaagagccaatggagtagacccctggctggtaagggccaagtcccaccggttgcttctgggaaggggtttctaacactagtctgtgtgctgtggttcctggggtgccctccactgccctctgttcagtaacagggccttgctaatcgggttgtcactcaacaaaagtgctttggatttaagttactatcctggctttgcccaacctcagcaacctgtaagactgataatgaaataaatcatgttaatcctaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaagaaggggggggggggcgaccaaaaagaatacccacccaggggagggcgcacaactcgacgccggccgccgccgcggttgtgtgcttgacaagaagagggaggcgccccacaggaggggggagacccatatattaaacagcgaggaggatcgcggggtgcgcaacacacaagcgaacgtggaagggagaaaacaacactggggaggagaggaccaccaaggggagaaacaacacacctccgggagggggagcacaatacgcggccgacacaacacggag

SEQ ID NO: 503397 - DNA, 226 bp, Homo sapiens
tccttgcatattgcaacactgtactcaggctatcctggatgtcgagctgatgcccctcctacttgctgcaaggtcacttgagagtccaatacactctgttggggctaaagcaggtcttcatgatcaggccaagtccgatgcgttcagtgtcgtagtacgcgtatttcactgtcagaggcgtgaacatcactcccattgtcctcccagggactcccacggacatcgt

SEQ ID NO: 503398 - DNA, 2458 bp, Homo sapiens
aagcggcacgaggctcgggttgtgccaccgctggactcccgtgtccctccgcgcaggcgggcggccccggagcgctggtgccggcagaggcggcgacggtggcgcccctcctcatcatgaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaaggagctgcgacaattcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcacgctcccaacacaaggtgggcagggaggcaccattcaggaacctggaccaaagctgacgaggctgggccaagccagggatggggccacagccagaaccccgagccctacttccaggttctggttagctcagccccagcccagcccagctgctctgcccagagctgggtgagtggggagacacctcagagccccgcaaaacccactgaccggaggcaaaaggcagtggggctgggggtagttttccatggtcacagagaactagtggtggctctgagaaggggaggacctctgggctttgattccatctccttgtcttttttctttgtttttagagacagggtcctgctatttcccaagctggagtgcagtggtgcgatcatggctcactgcagcctcgaactcctgggctcaagcaatcctcctgagtgatcccatttcttaatcagtgtagccccaagaaggctggggctatttaccagggtagaaaaaggagcttacctcccacctttggtcctaagtccctgccccctccccttcacaccataactaggtaacagtttgataactagggaagaaagcagaacagttaagcagccgccacatccccgctggctgggggcctcactccaggaaggggctggactggctgtcctttccagtggcctggctccgctgtgtggatggggagatcggggccagaggcagaaccctggtgaggaagctccagtcctgctctctacccagcccatcttgcctccatggtgcctctggaggcctctgggcctcctctaacaggggctggtgggcaccaagagccaatggagtagacccctggctggtaagggccaagtcccaccggttgcttctgggaaggggtttctaacactagtctgtgtgctgtggttcctggggtgccctccactgccctctgttcagtaacagggccttgctaatcgggttgtcactcaacaaaagtgctttggatttaagttactatcctggctttgcccaacctcagcaacctgtaagactgataatgaaataaatcatgttaatcctaaaaaaaaaaaaaaaaaaaaaaaaaaa

SEQ ID NO: 503399 - DNA, 660 bp, Homo sapiens
caccagggtttcttgtcgcgacggttggggataatcctgtggccaacaggtaaaggcggttttctaaataaaaggtgcaaccgacgtttgacagctcgaatgcaaccctcgttgaacaattgtttccccagccgggccacctttcgcggtagggcccaatagctatgggagaacaccccgcttgttgaacacgcccgcattaaaaggtgtcgccgaagtgaatggggcatacctgataaaacattgagatactcataggaaaaccactaatcccagaagtggttacgaaggctgtttgcgccgcatttataagcacccattcctggtgcagcaaacaagtgattgacacaacccctggtggtaatccgtcaacccgcatatggccacgcgtcacaagtgttgttgtcttctacactccaccacatgtcgcgcttacacagtgggggacgcgcactcaatgtgtgcgggcgcttcattcatgaggggtctcgccccaagccccgggagcaagccacgtttgtaggtagactccacaaatggtcactccacacaggtaattttcgtggtttcctattattggtgtgacacacgcgggggccgcgcgtgtggttcaacaaaaatggttttatataatgtccgctctaaatcacggtcgagaag

SEQ ID NO: 503400 - DNA, 331 bp, Homo sapiens
tataaaacacagtctcactttgtggcccaggctggagtgcaaaggcacaatcttagctcactgcaattcccgcctcccaggctcaagcaattctcctgcctcaccctcccaaacagctgagaccacaggcgcccgccaccacacctggctgattttaatattttaagtaaagacggggttcaccatgttggcgaggctggtctcgaatttcctgacctcaggtgatccgcctgccttggcctcccagggtgctgggattgcaggtgtgagccaccacgcccagccagtccctcttggtagtacttatatcagcctggtgtttatttgtgga

SEQ ID NO: 503401 - DNA, 2488 bp, Homo sapiens
aagcggcacgaggctcgggttgtgccaccgctggactcccgtgtccctccgcgcaggcgggcggccccggagcgctggtgccggcagaggcggcgacggtggcgcccctcctcatcatgaacagaggcttctcccgaaaaagccacacattcctgcccaagatcttcttccgcaagatgtcatcctcaggggccaaggacaagcctgagctgcagtttcccttccttcaggatgaggacacagtggccacgctgctagagtgcaagacgctcttcatcttgcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaaggagctgcgacaattcgtccctggggatgagcccagggagaagatggacttggtcacctactttggaaagagacccccaggcgtgctgcattgcacaaccaagttttgtgactacgggaaggctcccggggcagaggagtacgctcaacaagatgtgttaaagaaatcttactccaaggccttcacgctgaccatctctgccctctttgtgacacccaagacgactggggcccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttacgctcccaacacaaggtgggcagggaggcaccattcaggaacctggaccaaagctgacgaggctgggccaagccagggatggggccacagccagaaccccgagccctacttccaggttctggttagctcagccccagcccagcccagctgctctgcccagagctgggtgagtggggagacacctcagagccccgcaaaacccactgaccggaggcaaaaggcagtggggctgggggtagttttccatggtcacagagaactagtggtggctctgagaaggggaggacctctgggctttgattccatctccttgtcttttttctttgtttttagagacagggtcctgctatttcccaagctggagtgcagtggtgcgatcatggctcactgcagcctcgaactcctgggctcaagcaatcctcctgagtgatcccatttcttaatcagtgtagccccaagaaggctggggctatttaccagggtagaaaaaggagcttacctcccacctttggtcctaagtccctgccccctccccttcacaccataactaggtaacagtttgataactagggaagaaagcagaacagttaagcagccgccacatccccgctggctgggggcctcactccaggaaggggctggactggctgtcctttccagtggcctggctccgctgtgtggatggggagatcggggccagaggcagaaccctggtgaggaagctccagtcctgctctctacccagcccatcttgcctccatggtgcctctggaggcctctgggcctcctctaacaggggctggtgggcaccaagagccaatggagtagacccctggctggtaagggccaagtcccaccggttgcttctgggaaggggtttctaacactagtctgtgtgctgtggttcctggggtgccctccactgccctctgttcagtaacagggccttgctaatcgggttgtcactcaacaaaagtgctttggatttaagttactatcctggctttgcccaacctcagcaacctgtaagactgataatgaaataaatcatgttaatcctaaaaaaaaaaaaaaaaaaaaaaaaaaa

SEQ ID NO: 503402 - DNA, 301 bp, Homo sapiens
atagccaggcgtgatggtgtgcacctgtagtcccagctactggagaggttgaggcaggaggatggcttgagcccaggagtttctggctgcagtgagctggacacagtgagaccctgtctcaaaaaaactaaaagatagccctgcacagtggttcacatctgcaatcccagcagtttgggaagctgagatgggaggattgtttgagaccaggagttcaagaccagcctgggcaacatattgagaccccatctctacaaaacagcagcagaaacaaaagcaaacaacagcaacgtacacaaac

SEQ ID NO: 503403 - DNA, 116 bp, Homo sapiens
tatattctagagcatccctttgctctctacagtagttattgctttgtgctgtacatttgggttacaggagttgtatatgtgtatgtgacagcataatgccctcaccagcgattgct

SEQ ID NO: 503404 - DNA, 124 bp, Homo sapiens
gagagtctgagtgcagaccctgatcagtgcttcctcgccaatctgtgagtctgtcccaggaagtagaggagagagagccttagccttgcgtgcaaccatgatgaatggttagctttacgtggtg

SEQ ID NO: 503405 - DNA, 1216 bp, Homo sapiens
cattttttcgtgcgtgtcgcctggtgtagccttctctggactcccctttcgggttctccacttggggcgttggcggatcttgtggacccgtttttctctcccgatgtactcggcgccttttcagggggcccaacgctctactttagccccctttgtgtcccccccttttcatctggggggaccccggtggagtgtttacccccctcctctccggttcttctcccactctccctccttgccaccccccgtttgggttagcaccccctggcccaggttcgtacccctgaccaactgtggggatcctgtgggagggcattccagggccccccatttccaaggccccgtcactggcccccgcccagtaaggtcctgttgggattggcccccccccccgggggaaactcgtgggccgtcgtattggcccccgcgggggcttctccccgggtcatctaatccccgtgcccttttttcttgggcgctttccccaatggcctttttgggcccacgggtcactcccctggatggctgtatcccgggaagcgtccaccttggcccatgcgccctttcccggtggttcgcccccccgggccccaccggtggtccacactgggttgggaacctggaacctcgccgctttctatgtgtaaccctcgtccccaatattgagtgaaccactcccagagaaggtttggttaaaccacgggcctttccgaaggggccccccctccacaggggcaattcctggggctaccccctggggccccccccgcttggtttccctcctgaactttctaccacgcgagcaccccacctcctccccccctcttgagagcctgggggctggccacttggcccctccacaccgagccacctcttgtcccaagctcaatttccctggtattgacccaccgaatatttggctaccacgccaccacggggtggtggagcctcacatggcccaccactgggccttccacaagggaggtatagaaccccctgggccacccacgccccccgcacagagccaccagaggaagagagagaccctccactgctggggagatccctgcccaccactccagtccccccacccaccactgaatctcccctcctccaccagattgcccatgtagaccccctgaagaggggaggggcctagggaacccccccttggtccatgtacccatccatataagtaccctgtgctcccacccca

SEQ ID NO: 503406 - DNA, 192 bp, Homo sapiens
taatctattctatctccatatgctttaggtgtctggtaacagatacctgcacgaagcgttgctgtatcaaacaaaaccacagacaagatccaagaactgttatatcatcttcatcttccttacttcgtcgaagcatgtctctgatcagcgggtgtctgggattaatttcaaatgttttcttctgactcgcat

SEQ ID NO: 503407 - DNA, 327 bp, Homo sapiens
atacgaattgagctggtacccgttagcagcgccagccgcataattcctctgctgtcaggaaggctggggagagggtgcggtgggacccaggccactcaggagcgggatgccaccgagttctcaaagatcttgtccgccctggcccttccgtgtccggcctccagtgggcaccagatctccacccagtgcgtgaccaccccctccccaccaatccctcagcgagattctagcagaggggacgagagccaggggccgtggggacccagtgttgagaaaggggctggcagagacgcatgggagtccacccagggtcaggttcaggcctgc

SEQ ID NO: 503408 - DNA, 125 bp, Homo sapiens
tctgaccctgttctcatatctgtagagggcaagaagtctcacgacctcctgggatttttttggtgaaaattaaatgagaacggtaagatcttccaggccttcctcctggtccatctgacccatct

SEQ ID NO: 503409 - DNA, 855 bp, Homo sapiens
  misc_feature (54)..(54): n is a, c, g, or t
  misc_feature (64)..(64): n is a, c, g, or t
  misc_feature (66)..(66): n is a, c, g, or t
  misc_feature (74)..(74): n is a, c, g, or t
  misc_feature (100)..(100): n is a, c, g, or t
  misc_feature (119)..(119): n is a, c, g, or t
  misc_feature (122)..(122): n is a, c, g, or t
  misc_feature (126)..(126): n is a, c, g, or t
  misc_feature (129)..(129): n is a, c, g, or t
  misc_feature (132)..(132): n is a, c, g, or t
  misc_feature (139)..(139): n is a, c, g, or t
  misc_feature (148)..(148): n is a, c, g, or t
  misc_feature (150)..(150): n is a, c, g, or t
  misc_feature (153)..(154): n is a, c, g, or t
  misc_feature (156)..(157): n is a, c, g, or t
  misc_feature (159)..(159): n is a, c, g, or t
  misc_feature (161)..(161): n is a, c, g, or t
  misc_feature (163)..(163): n is a, c, g, or t
  misc_feature (167)..(167): n is a, c, g, or t
  misc_feature (169)..(169): n is a, c, g, or t
  misc_feature (176)..(176): n is a, c, g, or t
  misc_feature (183)..(183): n is a, c, g, or t
  misc_feature (187)..(187): n is a, c, g, or t
  misc_feature (197)..(197): n is a, c, g, or t
  misc_feature (206)..(206): n is a, c, g, or t
  misc_feature (218)..(218): n is a, c, g, or t
  misc_feature (225)..(225): n is a, c, g, or t
  misc_feature (230)..(230): n is a, c, g, or t
  misc_feature (236)..(236): n is a, c, g, or t
  misc_feature (254)..(254): n is a, c, g, or t
  misc_feature (263)..(263): n is a, c, g, or t
  misc_feature (336)..(336): n is a, c, g, or t
  misc_feature (350)..(350): n is a, c, g, or t
  misc_feature (370)..(370): n is a, c, g, or t
  misc_feature (408)..(408): n is a, c, g, or t
  misc_feature (602)..(602): n is a, c, g, or t
  misc_feature (618)..(618): n is a, c, g, or t
  misc_feature (776)..(776): n is a, c, g, or t
  misc_feature (845)..(845): n is a, c, g, or t
tcccctctgaagaggacttccagggtataacccctggggcccagggcccttccncccggggccnanaacctgangccaggcccaacccggacgcctcggnaaccggaaggtcccacccnagnaccnccnccnctacccnccccccccncnacnncnnancngnagangnccaaggnggaaganaccnagcggaaggnatcacaacnccccaagggtcncccaccngaccncaacancgcccaggagacccaganggagatganactcctgctggatatctacaactcaccccccaacgaccaccgggataacgtccacctcatggcagcggaaccnaggctaaggccgancgttgatgacctgcggaccncatcccggaattggaggagagggatccaagggagagcnagaagatcccggatgacgatcccctcccgcccattcggcaggcagaggagcagatagaacacctccacgcgcaacctccgctgccaccaaccaccgaggaggaggctctgctctcagagatggatgtgacaggtcaggcttttgaggacatgcaggaacagaacgggcggctgctacagcagttgcgggaaaangatgatgccaactttnagctaatgtcagagcggatcaaggccaaccagattcacaagctgctgcgggaggagaaggatgagttgggcgagcaggtccttggcctcaagtcccaggtggatgcccagctgctgactgtgcagaagctggaggagaaggagcgagccttgcagggnagcctcggggggtgtggagaaggagctgacgctgcgcacaaagccctgggagctcaacaagcggaaggntgtagaagcc

SEQ ID NO: 503410 - DNA, 367 bp, Homo sapiens
gcagatttcagcttaaatctgctgagcgagggagcaaagctactccagctcagcaggaaaaagcagttggggcagtggaaagcccagagtggctccgagatgtatccatgtctgctccttaagccttcctagctgtgggaccccagggataactgtccctcacatcaccttccacgaatgtgagcccaattcctgacttagggggtcccaactcaagacacgaagcctgtaaaatccaggctcagagaacctggagacagccttcagatgatactagaaattaaactgaatttacattgtctacagagacagggtctctgtcgccaaggctgggtacagtggcacaatcacagctcactgcagcctt

SEQ ID NO: 503411 - DNA, 343 bp, Homo sapiens
ccccctccccgggtaccaatttactgtattagtctgtttttatgctactaataaagacatacccaagactgggcaatttacaaaagaaagaggcatattggatttacagttccacctggctggggaggcctcacaatcatggcggagggtgaaaggcacatctcacatggcagcagacaagagaagagagcttgtgcagggaaactccctatttatatattaatttattttggggagggagtttctctcttgttgcccaggctggagtgcaatggtgcaatcttggctcaccgcaacctctgcctcccgggttcaagtaattctcctacccggggaggggggg

SEQ ID NO: 503412 - DNA, 169 bp, Homo sapiens
  misc_feature (80)..(80): n is a, c, g, or t
  misc_feature (112)..(112): n is a, c, g, or t
  misc_feature (150)..(150): n is a, c, g, or t
ggttctccttcaggctaacagagaccctgatgctggaattgatgaagctcaagttgaacaagatgctcaggctttatttnaggctggagaacttaaatgggggacagatgangaaaagtttatcaccatctttggaacacgaagtgtgcntcatttgagaaaggtgttt

SEQ ID NO: 503413 - DNA, 315 bp, Homo sapiens
cactcaatctaaccctcccctggaatggggcaatacgcagcagtgacctcttccacacggagtcttgtgcaaaaactccagttttaccccattgtacacaagcttgtaagtatagacagaagccccctgccacagatcgggggtttagtatcaggtccttggacacaccctccagcatataccagtcttcaccagtgttggaaaacctgcacacagccacactaaaagctgcctttttctgtaccatgctggacaaggtccagtgttgttcccttgaaatgggattcatcactcggctcacagaggcccactgcc

SEQ ID NO: 503414 - DNA, 422 bp, Homo sapiens
  misc_feature (284)..(284): n is a, c, g, or t
  misc_feature (301)..(302): n is a, c, g, or t
  misc_feature (343)..(344): n is a, c, g, or t
  misc_feature (346)..(346): n is a, c, g, or t
  misc_feature (360)..(360): n is a, c, g, or t
  misc_feature (376)..(376): n is a, c, g, or t
  misc_feature (412)..(412): n is a, c, g, or t
acgttttacagatcaggaagaagaacactcaaattgagtctcactcgtctcctgatgtgcaaaacagtttattagaagataagacttaccctgattctgaagagagaacttctattgatatagcatgctctgagggagagaacagcaattcaactgatcaagatttatttggtgggtgtcagcttaatcagcgccactcaaatatgagccatcgaaaatagtcattttaggtgcccgactcatacgatatcgtcaaagccacctattccctctccaaaaaaggnagggtcaggtaatcaanncttactccgggaccccacttactagaaagcttcttctagtnnanaattctgcagattntttaaccccgggccgnccctcggacccccactccacctcgtcctcaagccanaccctttggt

SEQ ID NO: 503415 - DNA, 498 bp, Homo sapiens
gacatactcaccattaatataacagtcatcaccatcacaatcattaccactaacaccaccaccataatcatcatcatcaccacaaccatcatcatcattatcctaacaataaagatggcagaacaaatgaatctcatttgttaatgccccacatggtagcactgtgctgagggcccttatctgctacatctcatcactcagccttatgttgcttccctcagacctttaaggatttctaagcaaaatgggataaccttattcctggaagaattaattgcttcttgagtcaataaactatattgagggactcagtatgtgggtgggcatccatcagagagcaaaaccaggtgtggttcctgccctcgtggagcttacagtccagtggggagacagatattactcattacataccgaatggacacttacagatagaggtaagtagcttgatagaaagttccatggggttggccaggtgtggtggctcatgcctgtaatccc

SEQ ID NO: 503416 - DNA, 237 bp, Homo sapiens
  misc_feature (23)..(23): n is a, c, g, or t
  misc_feature (37)..(37): n is a, c, g, or t
  misc_feature (51)..(51): n is a, c, g, or t
  misc_feature (203)..(203): n is a, c, g, or t
  misc_feature (206)..(207): n is a, c, g, or t
aattcgcggccgcgtcgacgtcnacgcggcgggttgncagatgccgcgcgncaggttgtagcggttgaaatcgatccgccattggcgcagcagctaccgcatactatcgccaaattccgccccgataaggcacaaaacgttaatgtggtgcttatggacgctctcaaggtgactgagcttccccacacgccggatgcgctgtnganncggccgcgaatttagtagtagtagtcgacc

SEQ ID NO: 503417 - DNA, 381 bp, Homo sapiens
tacttttgcgcacaggacagatagaaataaacgctgtcagcagtcactgtaaagaactttccaatcatcagtttagagcaggagtgcaagtgatgttgcatacgattcctcacattatttccacacccatgagaggcattgctaatcagtcgtgccagcgatacccgcctcggcctatatacagcctcaaaattattttccacacagtactctggtcagccattaccaatgaaccaggagctggcccttcagataaaatctctctgctcttcctgatttgtggctttgctgaatgttgtccttagcatcatggtcacacacttctacagtctgcatctcaggggagaagcctggaactgcatttcccagaatccctttccc

SEQ ID NO: 503418 - DNA, 205 bp, Homo sapiens
gtgggcagggggtgggggtggttggccaacaactactttgttgagtgtgttgagctgactgcattggcaagaaagagcccagtaaggggttgatagtaaggccctcacttgcttgcttaccccactacactgtactacttggaaatgaggaggctttaggaggtcctagaggcaggcagcagactaggtcttcctgccttaccag

SEQ ID NO: 503419 - DNA, 546 bp, Homo sapiens
aattattccacgttgtattcatagatcataatgtcactttttaccctataaatatgtaaaagagtccgggtgcagtggctcacagctgtaatccttggcctcccaaactgctggaatgacaggcgtgagccactgtgcctggccttcattaaataaatttaaagaaatagatgagtgttaccaattcaagcaatgaagtatttggagggcaatttggtgtttctgtcaaaattgttttggtatgtgtccagcatttacacagcaaatgatttatctttccctgtggatatactcaccccactgttcaaggatacatgtccaaagatgcattgcttatgaagcaaagacacaaacctagaaagagctgagatgtccctcaatggacagctgcttcacttaagtgtaatccatctacgcggcggaatgcaaggtaccatggttgagaaaaagaaagctggctggatttgctgacctagaaagagatctgcaatataccgttaagtaaaaacaacagtagaataatatgatcccattgtgaaaaaaaaa

SEQ ID NO: 503420 - DNA, 411 bp, Homo sapiens
  misc_feature (17)..(17): n is a, c, g, or t
  misc_feature (379)..(379): n is a, c, g, or t
gatctcaagtgaaccancagcctcagcctcccaaagtgctgggattacaggcgtgagccacgcgcgcacggctatcccttccaatatttccgaggccagctgcccagagaaggagggctgggtggagaggaccgtgccagcagcagtaggcctgggccaggagacaggcacgcacctccgcggtctctggcgagtctatgtccacacagcggcaggacctccacccccagccacctgcagcagccccacatctccaccgggtcaccctgctgacatcaagagtgcctcccgcaatgtcccaacccatgagggcttcttgggagctgaaccaggggcaccggccacttctggaggggggctgctcgtgacttccgacctnttgtcttcgtagttggcatgagaagatggatt

SEQ ID NO: 503421 - DNA, 166 bp, Homo sapiens
tctagaggatccctaaagacatgactttaaagaataatttctaattagtacatagccaaagtgtaagggttactaagtctacccccaaaaagaatccgttgatctaccaggtaaaaatcttatctgtattgtacaaaaactcaatgcattttaatacagttttgat

SEQ ID NO: 503422 - DNA, 333 bp, Homo sapiens
  misc_feature (1)..(1): n is a, c, g, or t
naataccgcatctcaatttggaatccattaattcatcaggttgtgcccctttccacacagcttccatatctagagtgtttggtgaaccaaaaattgtctgtcccataaccttgtgttcactctttccattcggttcatagtcaaaggcctgtaccatttctgaaccagtcacagttgaccttgggccaataattccactgttgctatccgatggatttcgcaatttaagatttgtagtgtctacatctgtaaaggggcctttgaatttgaggtctgtgcgcggatcgaggcacagtatgtgctcgtgcttcgacatggcccctgaggcgcacg

SEQ ID NO: 503423 - DNA, 824 bp, Homo sapiens
cagatcatgaggtcaagagatcaagaccattcctggccaacatggtgaaaccctgtctctactaaaaatacaaaaattagctgggtgtggaggcacgcgcctgtagtcccagctacttgggaggctgaggcaggagaattgctggaacccaagaggcagaggttgcagtgagccaagattgtgccactgcactccagcatgggtgacaaagcgagactccctctcaaaaaaaaaaaaaaagatttaggctttaggggccaaatatgctcttagggcttatgccttcatctttttcaccaatccttaacatggtaaaaaccattcttagctcaatgagttcttcaaaaccgggtttgggccaatccctgggtttattattaaacgggggtccaccctaaaaggttaaccaagcagataacatgaaataataggccaggtgcgggctcatgcttgtaatcccagtacttgtgacaggctgagatgggtggactcatgaggccggagtcgagatcagactggcaaaatagcgaaactcccgtcttccattaaaattcaaaaaattaccggtgggggggcggccctgtattcccaagtatccggcgggccgaggcaggaaatcgctgacccggagtggagggtgcatgaccgagattgagcatggactcagctggtgacagagggaaaccggtccaaaaaaaaaaaaaaattgggcgcgccgggccaaaattttaaatcgtgccgcggccaagtgagagtgacatgtccagacggtcagagggttcccaaaacgcggcggtggaccaggggggtggtcaggcagagga

SEQ ID NO: 503424 - DNA, 808 bp, Homo sapiens
  misc_feature (31)..(31): n is a, c, g, or t
  misc_feature (271)..(271): n is a, c, g, or t
  misc_feature (301)..(301): n is a, c, g, or t
  misc_feature (316)..(316): n is a, c, g, or t
  misc_feature (345)..(345): n is a, c, g, or t
  misc_feature (359)..(359): n is a, c, g, or t
  misc_feature (387)..(387): n is a, c, g, or t
  misc_feature (414)..(414): n is a, c, g, or t
  misc_feature (419)..(419): n is a, c, g, or t
  misc_feature (421)..(421): n is a, c, g, or t
  misc_feature (430)..(430): n is a, c, g, or t
  misc_feature (432)..(432): n is a, c, g, or t
  misc_feature (440)..(440): n is a, c, g, or t
  misc_feature (444)..(444): n is a, c, g, or t
  misc_feature (455)..(455): n is a, c, g, or t
  misc_feature (457)..(457): n is a, c, g, or t
  misc_feature (462)..(462): n is a, c, g, or t
  misc_feature (467)..(467): n is a, c, g, or t
  misc_feature (473)..(473): n is a, c, g, or t
  misc_feature (481)..(481): n is a, c, g, or t
  misc_feature (485)..(485): n is a, c, g, or t
  misc_feature (491)..(492): n is a, c, g, or t
  misc_feature (501)..(501): n is a, c, g, or t
  misc_feature (503)..(503): n is a, c, g, or t
  misc_feature (517)..(517): n is a, c, g, or t
  misc_feature (546)..(546): n is a, c, g, or t
  misc_feature (797)..(797): n is a, c, g, or t
aaacaatcccgacccggagtggacaggtgangaggggaggacttgcctcgccgaggccgctgcgaggagcgtgcccaagggcgaaggtccagggaacccggctcccgcgcaccgaagacggccgccatgccggcccgttgtgtggccgcccactgcggcaacaccaccaagtctgggaagtcgctgttccgctttcccaaggaccgggccgtgcggctgctctgggaccgcttcgtgcggggttgccgcgccgactggtacggaggcaatnaccgctcggtcatctgctctgaccactttnccccaccctgttttnacgtctcttcggttatccagaagaacctncgcttctcccagcncctgaggctggtggcaggcgccgtgccnaccctccaccgggtgcccgccccggcncctancncgggacagnanggagaccnaccnggccgcctggncncgccncgcgncctccncgcaaccnggcnttctgnngctgccccngntccagtctcctctncacgccccccaactgggaagcacgctgcngcttcacaggtaaagagagaccaccgaagttggtgtaaggacccctggactctggctgggctcctccacttagtgtcaccttgggaaaggcacctcatctcgaaagttcctgttttctaatctgcaaagttaggggtgtgctttagaggtgatctccaaggtcccacttatcattaacactttggaattaagtgacccagttaattccttctaactgctcctcccccaaaactcacacacacacacacacnaacacacccac

SEQ ID NO: 503425 - DNA, 115 bp, Homo sapiens
tcctctacgcagtgtgctgactgccagcacgctcatggagccatctacttgtggagatcagtgtccagagcaggtgtcggtggcatctacggggtttgaacaggaagcggggccg

SEQ ID NO: 503426 - DNA, 326 bp, Homo sapiens
gcgtcgacctttaaagaccctgtctccaaggctgtgtgcagtggcttatgcttgtagttccagcgctttgggttgccaagttgggaggattgcctgaggtaggagtttgagaccagcctggccaacatggcgaaaccctttctctacaaaactctacaaaaaaaaagtacaaaaattggcagagcatggtggcttgcctgtagtcccagctactcgggaggctgaagtgagaggattgcttgagcctgggaggttgaggatgcagtgagctgagatctcaccactgcactccgtccagcctgggtgacagagtgagaccctggtct

SEQ ID NO: 503427 - DNA, 164 bp, Homo sapiens
cgtggggactccaggccgtatcctagaccctggctcgcaataagagcctcaacctcaaacacattaaacactttatttatggctgcatgtgatacgatgctatgaacagctcgacatgcgtcgggatgtccaggaactaaatcgcatgaacccccacgagcagg

SEQ ID NO: 503428 - DNA, 951 bp, Homo sapiens
tcttgtatattgctctggggactctcgccggggaagatggggctgatttcccacctagagaggttgatggcagaaggaaaatggggaggcactggggttgtggagggcatgggtatggctgaggagggtgctgggaacggcaaggcggtctgggggatggggaggggcaaaggtgagagatcaccttccctatcctccaccttcccgcaggaagacgaagccaggtgccaggctggggtcgggacacccatgttctgggcggcttgaccccaaatcccagaccccggaagctccaggctcgggatgtgtcctgagcacctgtcccggccgctcctctccaggctgtcaggcagctcgccggagcggcttcctcaatctaggggcagatagccccagggcaggcctaggcgcagcccgctgcattgccgtttgccccagaggtggccccgtccacctcttgtctgatgctctacccggatctctctgcccctccttattcctcacaggtgccatgagtctgcagacgatcttcggggtctcagcctgatgctgccatgaacattcgtgggttaacgggggaggggctctaggaaggaacgggggggaaggggaccaggctaggtgcgctgggagaggaaccccttttctcggtgctaggacacaagcccttcccttcgtcccggggagctgggagcctggttgttcccgaatccagttacgggacaaagcggcgagcaacgatgggtgggtggccggtcgtcagcggaccacggtgggggagacggcgagttgggtgccaaacagcctgctgggtcaaaggggctcaccgccatcaacacaaacacacggatgaacgcaccgggaggacaccctagcctggccactgcaggaggtcctcgggaccgccaccagacctgcgaccgagaggggaacgtgacgcgccgtacccag

SEQ ID NO: 503429 - DNA, 104 bp, Homo sapiens
acacaggcacaccagatgtaccatgcttctgaggtcttagatgtatcactacacaagtgctatacagttagatcctgactctgcaggaacgtgactgaatggat

SEQ ID NO: 503430 - DNA, 363 bp, Homo sapiens
ctactactactaaattcgcgacacactcgacagcagaatggcatgaacccaggaggtgcacctcgcagcgagccgagatcttgccactgcactccagcctcagcctcccgagtacctgcgattacaggcacccgccaccacgcccagccaatcttttgtatttttagtagagacggggtttcacagtgttggccaggatggtcttgaactcctgacctcatgatccacctgcctcagcctccaaaagggctaggactacaggcgtgagacaccgcgcccggccccaagctttctttaaacagggagaatatgcacataaaaattcaaaaggcctaggctgggcaagttggctcatgcgtcgac

SEQ ID NO: 503431 - DNA, 398 bp, Homo sapiens
ttacaggttcccgacgctctctctgtggggcgttctttcccatggaatagtgtggttattggaagtttcctctttttatgaacgaacagcgatggatgtgctctctggggtatcctcctacccagctgactgttgtaagtccttgtggtgctcagggaggatgggtgacactcgctgttgcttcagcttcatcttgagcccacacagcatctccactagccaggtctcctcaggctcaggggcgagctccttctccggctcctcctcagattcatctgaccactccctcttccttttccagcccagggacctacatcgggggctgggatctaccccaggggctgagtaaagaaaccaggccaccgtgtaatgcttctgcatctgatcaccttagaccc

SEQ ID NO: 503432 - DNA, 152 bp, Homo sapiens
aatcatgcaactggactgatcagacaaagaggggcgtttggtattgggttatggcaggcggttttatattgaatattgtcgtgattaaattaatgcgtccctaagatagaggtgtcctttaaaaggtgttgggatcagtccgttcgcatgtt

SEQ ID NO: 503433 - DNA, 181 bp, Homo sapiens
  misc_feature (17)..(17): n is a, c, g, or t
  misc_feature (89)..(89): n is a, c, g, or t
tctagaggatcccgatnatcgcccaacacacttctcaacacaacttcctaaggaatatatgatcatctcttagtcacttaggaacaacncatggagtcatttggattcctccttcttgccaatccaagtagttgttaaaacctattgggattcttccactgcaatgtgttggggataacat

SEQ ID NO: 503434 - DNA, 268 bp, Homo sapiens
gcggatcagtccattcctgctgacgatctgctgccaccatgtttgcctcgcgcctggttcatgcgctggggtcccgctgaacacggtgcgtgatgtgctgggtcccggctcagtcgcaatgtccctgcgctacgcgcatttggtgcccgaccaacggggagaagccgttggccaaactcaacgagaagccggtccctgcgcttacgatgcgcttacagtggagcggccttcacgctgccagatattatccccataacaccacacaatt

SEQ ID NO: 503435 - DNA, 266 bp, Homo sapiens
actctcgtgatctcagcgtctggcatcatccgggacatctcagagatctcatgcttggtgtagcggaggtcatcgccatgccggcagctgtctgctgcagttcctcatacttggtctgataccaggactcggcttctgtccggctgcggatggcaatctcctcatactggggcttgacctcagcgatgatgctatccaggtccaggttgcggatgttgtccatggcgaggaccactgaggtgtcagagacatgcgtctgcatctgg

SEQ ID NO: 503436 - DNA, 363 bp, Homo sapiens
gtcgacgaatggaatggaatggaatggaacggaatgtaatgtaatgtaatggaatggaaaaaacccgagtgcaggggaatggaatggaatggaatgcaatggaatggaatcatccggaatggaatggaatggaatgcaatggaatggaatggaatggaatcaacccgagtgcaatggaatggagtgaaatggaatggaatggaatggagacaaccagaatggattggaatataatggagtgtaagggaattgaatagaatcaatctgaatgtaatgaaatggaatggaacggaatggaatggaatggaatggaatggaatggaatgcaatggaatggaatcaacccgagtgcaatcgtcgacg

SEQ ID NO: 503437 - DNA, 1013 bp, Homo sapiens
  misc_feature (400)..(400): n is a, c, g, or t
gctggcgccataatcttcaccgtggtgcaacgacttaaacgcccaccaaggggcacaccaaggtggcgtacacctttgactctggtcccaatgccgtatcttcaccctggacgacactgtggcattgagttatgtgggcctgcatgtgatgtcaaggattgtcccgcccgatggttcgaactgcgtagacagcagttgactgtggaaggcggctcgcagggtagacggccaggcccccctctcttcacgctcgacgcttcactagcttgcagcttaggccactaggacggccagacctcccacggctggggggtacaagatactatcattcgtacactcaaggttggggggcatcgacctcatacagtccctcgggattgagccccttgtttgtcgccanccggtcgctgcggttctcgtgagctggcgctgttgccgaaagccaagcgttgcctttgacgtggtgctcgagtcagtggaaccggcatttgcgctgcgtctgtgacgtacaccgggggcttgagcacatccgccctggtgagcctccgagggaatgccgggagattgctgcggctgggggcccttgggcccggagaaacatctcgttggaggaccatgtgttgggaggtcgttgttagagtttatgcaaggcccctgtggggcccacaattgcgagtccaggacctataggcgtttgctgggcgtgtccagttgggcaagcgaggacgattcacattgcaggaatcccgtcgcaaggtcgtcaagcgtccgaaaggtccccccagcaccgagcctagcgttcaagggtgcgccgctcaatgcgtggaaccatcctaccgtattgcacagacgaattggggataagcgtaacggcgggggtaatgaatagaactgagcggtaacccatacggagcaaaggcaccgggcgttcaagggtgtgactgacagacaaaacttgttccgatatatcctcagttctccttacgaaagaaacttccttgacgaagattggt

SEQ ID NO: 503438 - DNA, 179 bp, Homo sapiens
ttagacaatgctccaactgtagtttcgcaacatattgccgaagctattcaatatagaagtttagatcgtgatggttggttggggtagaacctaaatactgtaaacgcatagtaaacccgacaggtttttaaaacctgtcgggtttgttggttggtgaaatttgtggttaaatatttact

SEQ ID NO: 503439 - DNA, 214 bp, Homo sapiens
aaactctgcgcggacacgcaagagagactgtccacagttccattattgagccctccacacccctgcagagccacgtgagagagactgtccacagattcctctattattcagccctccacacccctgcagagccacgcaagagagactgtccacagttcctctattattgagccctccacacccctgcagagccacgcgagagagactgtgcaca

SEQ ID NO: 503440 - DNA, 291 bp, Homo sapiens
aacggaagccgccacgcgcttgagcttctgagagcgggctcgtcaggaagcctcccgaggagagctcctgtttcgagaggccctgcttcaagtggtacaccagcctctggtcagagtgcaccaagacctgcggtgtgggcgcgaggatgcgagacgtcaagtgctaccaggggaccgacatcgtccgtggttgcgatccgttggtgaagcccgttggcagacaggcctgtgatctgcagccctgccccacggagcccccagatgtaagctgccaggaccagccaggcacca

SEQ ID NO: 503441 - DNA, 678 bp, Homo sapiens
tgctccttcgttgggtctcagccggaagtattttgtggggcgccgggtggtggggtccttgttgttgcgagtttgttgttggttgcccctgtgttgttcgcgcctcgttttttttactgcctgcgcgtcgattgggggtgggcgggtgtgtttctgtttgtgggtcgaccactgcggtggtcttatatagtatgtggtggcgtgcgcttctgtgcggcgtgttggatactccgctcctcgctcgttctgggattagatgctagattctaataataggatgactagatgctcggttgttaccccagagcacatggtgagggtgaatgctgctctcataggccccacacttcggtgagtataagggaacgtccgcccccctctacacgcttggtttttggcggactgttttgtgtgctgctctgcaatgcgtgcgattaaggtggcgctcattagatgagttgctgagcaataatccgcttgtctgtttgtttatcagaatatttgttaccgtggttgtttcccgcgtcagttacgcccataatattgattccaccaatagtggtctttaaaaagctaaaaaacaaaaaactaatttttttataaaaaaaatgtattgattttacatttcgttttcatccccctagtggtgtatccctggtgccaacaaatcatatacag

SEQ ID NO: 503442 - DNA, 1381 bp, Homo sapiens
  misc_feature (428)..(428): n is a, c, g, or t
cagagagacgcaacccatctccataacagcattcaataaatacctccccggttgtgtctatgtaaaatgctctggacgacaggaagaaacgtggtaaatccctgacatctttcccctgtgcctttccttcttccctacctcccctttttacatttacgactttacacgaagaacttaagatcaattcttcttatcctctgtgatatcttatagcaagacactcagctctgttggatgattgattctaagttgtgtagagacacaatgccagagatatacacattgctgctaccagaaggacgggtccctcctaagatgttgtagacttaagcttgtgttgaacaacgcgacagattgcccccggatctttgctctttgcgtccagggtgtactgtgcggaattcaagatcgcacgttggctccccacnggagtgagtcctactgcttacccagggtagctagctaacaattcgatgtacattggattgcaggcccttaaaatcgctgcaattgatggaccttactaatttttgagtgcatttccatgctcgtacattaacaaacactcggtccaagcacatctggttcgtacatagcgacataccatacagaaagacataaaacaacccattcaaagacctatgagaattaaccacattgagagattgattgattggccaacactaccaacttgagtcacagggattgccagaaggccccacccttcccaccaagctagcagcgttgctcctcagctggttccccgccttttcttccggacccaacttgcgccggcctgctcaaaaccccgcttaagtccgagtccgttctcttcccttggctggtgcctcgcgggaagcgacacggccgtggctccacaccgggctacttgggaaacccccttgcgaccttcaatctttgtccacacgccttcggaaagaggagaagccccatcaccccaggcagctactgcgagccccaaccaaccaatagcgcccatacatctcctggacagaccaccccgcgctcgaacaccatagataccatactacccatgggaatacggcgagtcccccaggttcatgtgttgacatttctctggggaagccgccacagcgtaacttgaggccccacgtgaccacatgtatcatattagcgggaatatccttccaaaaccgcaacgtgacccacaagccaaccccttgttaacacgccggccctatcatacattagagtttggcgtcgcgaacacattccaaatgtaagaagtggagacatcgttggtatgtgacgataacaatacccacattatatacacaggcattaaccatggacgctcgatgtatagtattagcacatggaccacaaacaaagatcaccc

SEQ ID NO: 503443 - DNA, 148 bp, Homo sapiens
  misc_feature (130)..(130): n is a, c, g, or t
gctgcgcggtgactctagtaggatcccggcaggtaggtaccgtcaaagtacaaagttgtcgcatctacgttcagcgccagccgcggtcgcctagtgggtacactggctcatcctaggactactcgtcggncttcttctccgccactaa

SEQ ID NO: 503444 - DNA, 1184 bp, Homo sapiens
  misc_feature (5)..(5): n is a, c, g, or t
  misc_feature (12)..(13): n is a, c, g, or t
  misc_feature (433)..(433): n is a, c, g, or t
  misc_feature (546)..(546): n is a, c, g, or t
  misc_feature (908)..(908): n is a, c, g, or t
  misc_feature (910)..(910): n is a, c, g, or t
  misc_feature (920)..(921): n is a, c, g, or t
  misc_feature (938)..(938): n is a, c, g, or t
tatgntggcggnnatggcgacggctcgagtgcggatggggccgcggtgcgcccaggcgctctggcgcatgccgtggctgccggtgtttttgtcgttggcggcggcggcggcggcggcagcggcggagcagcaggtcccgctggtgctgtggtcgagtgaccgggacttgtgggctcctgcggccgacactcatgaaggccacatcaccagcgacttgcagctctctacctacttagatcccgccctggagctgggtcccaggaatgtgctgctgttcctgcaggacaagctgagcattgaggatttcacagcatatggcggtgtgtttggaaacaagcaggacagcgccttttctaacctagagaatgccctggacctggccccctcctcactggtgcttcctgccgtcgactggtatgcagtcagcactctnaccaattacctgcaggagaagctcggggccagccccttgcatgtggacctggccaccctgcgggagctgaagctcaatgccagcctccctgctctgctgctcattcgcctgtncctacacagccagctctggtctgatggcacccagggaagtcctcacaggcaacgatgaggtcatcgggcaggtcctgagcacactcaagtccgaagatgtcccatacacagcggccctcacagcggtccgcccttccagggtggcccgtgatgtagccgtggtggccggagggctaggtcgccagctgctacaaaaacagccagtatcacctgtgatccatcctcctgtgagttacaatgacaccgctccccggatcctgttctgggcccaaaacttctctgtggcgtacaaggaccagtgggaggacctgactcccctcacctttggggtgcaggaactcaccctgactggctccttctgnantgactccttnnccaggcctcactgaccnatgacgacccggggtcccaggagcttcagttccgcctgacaaacgcacaacaatggctgcccggcgaataacaggacgcccagacacagaggggcggacaatacagtacagaaacggcacaacaaccgaccagcaggccaacaagaacaagcacaagccgacacacccggaaacaaacaacacacaacgagaaacaaagaaaccaaggcaccaaccactcaccacacacacgtggcacagccagcg

SEQ ID NO: 503445 - DNA, 159 bp, Homo sapiens
atgttatgtgaatatttattggtggatgaagctgatagtgattaatgttgagccagtaatgacgtgaagtctgtggatgcctgtggctacaatatatgttgagctgtagatgctgttggaaatggtgaatggagactcgaagcactctgaggcttgtag

SEQ ID NO: 503446 - DNA, 136 bp, Homo sapiens
  misc_feature (28)..(28): n is a, c, g, or t
  misc_feature (84)..(84): n is a, c, g, or t
ggtctcatatcattcccaggctgcagtnagtggcacaatcatgctcactgcagcctcaacctcccagctcaaggctgcagcgancagtgattgtgtcactgcattctaccctgggcaccaatgtagaccccgtctc

SEQ ID NO: 503447 - DNA, 1331 bp, Homo sapiens
gcttcagtccagtgcccggcttcctccaggtctcccgtgcaactggctgcgtgcctcgcccacgttatgtgcgccctgaggagaactgctgtgggacctgaactcttgctgcagtggtttttgatgctgcctgcttcctggctgtgtgctgcacactgctgctccttcccctgtgcagtgtgtggctgtgctgtggtgcgatgctgagagagggccctgcagtgtggtgtctgctggtgatgtcccagtggtgcatgactggggattggtgtctcccgtagcttgaaacccaccagtgcagcatcctgtgccacatgcttatgatgggcaaatgttaaagaagactcatcatggattactgatgcttgctagctggggatactttttgcaagacagtcctcagtgcaggctacagtcacactacttccaagaagacaacagccactcatcttcccactggtaccacagtgccttggtcacattgggatgccgacctctaccttgcatcaatgggccatctgagaaccctgtgcagccttacattaaacagactgtgctgtatttgcccaggaagccatcgtgtcgcttggtcggggtcctgcagaggctggcttgctgcctgggagcaacaaagctgggctcctgagtgtctaccgtggctttacctgtcctggcaaccaggagactgtgccagctgttcaccaccgagctaggccggattgggatcagatgcgacagcggaaacgctcaatcaatggaccagaaaatgtttccctatggagatgcacttggaaactggcaatgcctgaacctcacactgcaaggactcacaccatgactccaaagggatttgtgcgaatccagtccatctcccgggcacactttcaacatgcgcacaagcgtgggcatacacactttacacttcggacagtgaaagttattgctcaactattatacctcacaaatcgtgtgaaatcaagctgcacctataactacactcatcagttgcacaacagccgattacgagtgcccccaatcttgccaaccacgaaggggctctcacggacagatcgattaaacagggagcgtaaagttcgtacgcccagaactaacacacttgcttcgcgcaccaagtcagtgtacctaggcaactcgtcccacgtgtgtgatccgctgttcatagctagcctcgagcgactagtcagagcacgagtccaaaacgacaggtgtaagtcaaagcgctaacactcgagtaaccgagcctgcaaccagaacacgtagttccgaggtagtgggactcacttcatcgaagctagacaagctccgcggct

SEQ ID NO: 503448 - DNA, 380 bp, Homo sapiens
aagaatgccactatagtagttatctattgtgtgccaatctcattgctaggcattggggatgcaaagataaccatctttattgtgtcttgggtagcagaagaaaatatgtgtaaaatcaatttataatttgtaactgccacccatatataggctatatctgctgagtgatcattgattactctatcctaagagatacactgggggcccaacatttattatcattattgacctccacagagatctatgtgtagattacaagcctacagttctatacagataggaatgactatgggctactgaatggtgattacttctgtggggccggactacaacccaaggaaataaaatgatgttatcattatggggccccaagaggaatg

SEQ ID NO: 503449 - DNA, 218 bp, Homo sapiens
  misc_feature (43)..(43): n is a, c, g, or t
  misc_feature (64)..(65): n is a, c, g, or t
  misc_feature (69)..(69): n is a, c, g, or t
  misc_feature (77)..(77): n is a, c, g, or t
gttataagaataaatattgttcttctaagatttttaataactntcttcagttattacatttttnnctantttttttntaaatagagatgaggttttgctatgttgcccaggctggtctcctggactcaagcaatctcccacttcaggctaccaaagtgctgggatttacaggcatgagcacctctcccagtctcagttattattttaataaatgagac

SEQ ID NO: 503450 - DNA, 197 bp, Homo sapiens
tcgttagaggatccctgttgctaggtggagtgcagtatttgccaatcacgcatcttaaactcctgggctcaaacaatcctcgtgctcagcctcctgagcagctgagactacaggcgcgtgcaaccaagcccagctaacctttaaatcttttgcagagacagagtcttactgtgtcgcccaggctggtctcgaactcc

SEQ ID NO: 503451 - DNA, 916 bp, Homo sapiens
  misc_feature (155)..(155): n is a, c, g, or t
  misc_feature (175)..(175): n is a, c, g, or t
  misc_feature (181)..(181): n is a, c, g, or t
  misc_feature (194)..(194): n is a, c, g, or t
  misc_feature (205)..(205): n is a, c, g, or t
  misc_feature (217)..(217): n is a, c, g, or t
  misc_feature (231)..(231): n is a, c, g, or t
  misc_feature (233)..(233): n is a, c, g, or t
  misc_feature (247)..(248): n is a, c, g, or t
  misc_feature (251)..(251): n is a, c, g, or t
  misc_feature (254)..(255): n is a, c, g, or t
  misc_feature (257)..(258): n is a, c, g, or t
  misc_feature (266)..(266): n is a, c, g, or t
  misc_feature (280)..(280): n is a, c, g, or t
  misc_feature (282)..(282): n is a, c, g, or t
  misc_feature (291)..(291): n is a, c, g, or t
  misc_feature (295)..(295): n is a, c, g, or t
  misc_feature (331)..(331): n is a, c, g, or t
  misc_feature (361)..(361): n is a, c, g, or t
  misc_feature (378)..(378): n is a, c, g, or t
  misc_feature (387)..(387): n is a, c, g, or t
  misc_feature (390)..(390): n is a, c, g, or t
  misc_feature (399)..(399): n is a, c, g, or t
  misc_feature (405)..(405): n is a, c, g, or t
  misc_feature (410)..(410): n is a, c, g, or t
  misc_feature (415)..(415): n is a, c, g, or t
  misc_feature (417)..(417): n is a, c, g, or t
  misc_feature (476)..(476): n is a, c, g, or t
  misc_feature (597)..(597): n is a, c, g, or t
  misc_feature (627)..(627): n is a, c, g, or t
  misc_feature (632)..(632): n is a, c, g, or t
  misc_feature (671)..(671): n is a, c, g, or t
  misc_feature (696)..(696): n is a, c, g, or t
  misc_feature (714)..(714): n is a, c, g, or t
  misc_feature (734)..(735): n is a, c, g, or t
  misc_feature (743)..(743): n is a, c, g, or t
  misc_feature (762)..(762): n is a, c, g, or t
  misc_feature (819)..(819): n is a, c, g, or t
  misc_feature (824)..(824): n is a, c, g, or t
  misc_feature (836)..(836): n is a, c, g, or t
  misc_feature (843)..(843): n is a, c, g, or t
  misc_feature (903)..(903): n is a, c, g, or t
gaattgatccgtttagaagtttacaatgaagtttcttctaatactgctcctgcaggccactgcttctggagctcttcccctgaacagctctacaagcctggaaaaaaataatgtgctatttggtgaaagatacttagaaaaattttatggccttnagataaacaaacttccagtnacaaanatgaaatatagtngaaacttaatnaaggaaaaaatncaagaaatgcagcncntcattgggtctganngtnccnnanngccacttnacccctcacccctnanagatgatgnaagncccatacgcatgatgagagtccccgctgatccatcntttcagggaaatgccaggggggcccgtatngaggaaacattatatcncctaccgantcnataattacncacctnacatnaaccntnaggatgttgactacgcaatccggaaagctttccaagtatggagtaatgttacccccttnaaattcagcaagattaacacaggcatggctgacattttggtggtttttgcccgtggagctcatggagacttccatgcttttgatggcaaaggtggaatcctagcccatgcttttggacctngatctggcattggaggggatgcacatttcnatgangacgaattctggactacacattcaggaggcacaaacttnttcctcactgctgttcacgagattngccattccttaggtcttngccattctagtgatccaaannccgtaatnttccccacctacaaatatnttgacatcaacacattttcgcctctctgctgatgacatacgtggcattcagtccctntattnagaccaaaaganaacaacncttgccaaatcctgacaattcagaacagctctctgtgacccaatttgagttttgatgctntactacgtgggaa

SEQ ID NO: 503452 - DNA, 398 bp, Homo sapiens
ggatcgagctcggtaccgggaagaggagagtagtagtagctgtagagatgtaaatcaaggagattttcaaagcacaggacaaaccaagcaacccctaggggttgcttggttacaaaatcaacatacaaaaatcagtagcatttatatgtgccaacagtgaacaatctgaaaaatcaagaaagtaatcccatttacaatagctgcaaaaaatataaaatacctaggaatcaatctaaccaaagaaataaaagttctgtacaaggaaataaaattctgatgaaagaaacagaagaggacaccaaaaagtggaaatatattccatgctcatggattggaagaataatattgttaaaatgacaatactactacaaactacttacagattcaatgcaacccct

SEQ ID NO: 503453 - DNA, 1093 bp, Homo sapiens
cttgggcctgggctcacgaggataggggctgcagttctccaaggattccgtctgctcccagtacccccggaatgtcgtattgaagccctgttcctggtacgctgacgtcggctttcatgggatccctcgccggacgccgcggaggtgacagatgcctgggaagccgtcgccccgccccgtcccgcgcgcgctttgcgggccctggggcgctgatgacccgcgtagagcaaagcgcaaggctcccagtcgtccccgttgtgctccctcgtgtggcatgtggtcctgggcaaagttgtcattgcgaggggttcatggaagccccggcctgtgatcgtgagctggaaacccctccatggagttttccccctaaagcccatggacagtccctagatcttcggtgacgcttcaacaatgcctctgctggagtggcaccatgaaatgtgagacccctgccacagaatgccttggcaaggcattgagcatggagagtcccacactttaaacgagacgataagcccatttgcccgagatcccgtgagggcggtatagacagttccctgtacacctgtgcatcattcccttccgatgatgcgctggcccatggggggacacaatggaccccttgatgttgcagtgacccatgtacatccaagtgacagtagactcgggactgggattggagagccagccaggtcatatcacccaatattatctaacccccaatgaaccaccctcggcttgggctggtcttctccattgactgtgataggctactacatgtgacccccgttggtccattcgtagtgaaccttacatggtcataggccccacgaaaagacacgaaccaatgggctttggggccccaaaggcgggaaccattccatcggcggtcgtcaacggggtgccacggccatccacgtgccaggtgcccttatccatgccttggaacgcgtccctcagccccggtccgtgaggctaggacccggttgtagcaactgatatttgcggaacttggcctccgtgcgtagaccacctttagcccggcctaacactttacccatcccagataaacacagcccctatagttgcccct

SEQ ID NO: 503454 - DNA, 753 bp, Homo sapiens
ttgtagttcgaagtgccctcgagagcggctagatgtcttggctgtgcctgagagtgactagttgtcccagcgtgccctgcgcctcagccctgctgcgctctgctgcttctcgctctcgcctgcctgccctgctccgcttgacttgcgtcgctgcctttctgcttctgccctctacctctgatgtgatctgatgtgtgtgactcttgaccacatgcctgtgtgcttggtgaatgtgtgatgacatgatgtgctgtgctgtgctgtgctcatgggtgaaactgatgtgcttgcatgatgtgttgtgtatgtatgtgaatgattgtctgtgtgctgagtgacgatgcaacatgtgagcaaactatctgctgatgtgaccttgtgtctgtgaccaatgtataatgattgtgtgtgtgtgctgacatctgccaacatgtggtactatctggttccttgtgttgtgaatggcatctagctcagtgtgtgtctgtgtacttgatgcctttgtgttgacgaagatggttgattgccagtgattattgtgaattgaaagcatgtggaaaatcttcagatgaaatgaaacatgtgacaagttgaagaaatggtattgctttacccaccagcatttctgagtaaaatacacagtagtatagtcacttctcccctttgaagagcgaccaggattatattctcaagggaagggtgacttggtaaaagatttgaccttggggtccatgtggatggcttcatcgctaa

SEQ ID NO: 503455 - DNA, 348 bp, Homo sapiens
  misc_feature (16)..(16): n is a, c, g, or t
  misc_feature (43)..(43): n is a, c, g, or t
acaaatagtgagcatnaggtatagattattcctgaatgacaanaaagtcacctaattctctcttcaagaaaaatatgatttaaatccaaaaagctaatcaagataatagcctgaaataaaactctctatctctgatttcacttattaatataaatgcatattgtttcagtaacatcccagcaaatataatttagtgacatgaaaaatggaggctttatctaggaggtcactctaaagatgagtcaacaaaaagaaagcactgtaattttgcagtagattaaaagataaacggaaaccatttacatagataacattttaaattcatctctaatttttaaaaatcatttt

SEQ ID NO: 503456 - DNA, 338 bp, Homo sapiens
cggatatgtatcattgtcagatttagtgcttattttaagaatggaatcgtgggtatatctccctttatcagaatgtatcttaactgtgacctgtcactgtttacgaactagtgcgttgacagcaccgtgtcccattttttagaacccttgttagccagaccgaggtgtcctggtcaccgtttcaccatcatgctttgatgttcccctgtctttccctcttctgctctctagagcaaaggttaatttaaggacaaagatgaagtcactgtatactaatctgtcatagtttttacctgccttttctttttcagtgcagaatttaaaagtattgtataaag

SEQ ID NO: 503457 - DNA, 212 bp, Homo sapiens
cggacttgcatggctcgagtatcacagtgacatgaacaatatctccgatacgagtataagacatcaggtctccccttaaagtgctgccgtgtaggtcatcatgcgtggtgctgttcgtctgattactccttgttgagtggtgattagtcggttgttgatccgatatttggaggtggggattaatagagggggaaatagaatgatcaacaacc

SEQ ID NO: 503458 - DNA, 344 bp, Homo sapiens
tgagacagagtctcactctgtcacccaggctggagttcagtggcccaatctgagctcactgcaacctccgcctcctgggttcaggcaattctcctgcctcatccttccaagtagcagggattagaggcacctgccatcatgcctggctaattgttgtatttttagttaagacagggtttcaccgtgttgcccaggctgggctcaaactcctgacctcgagtgacctgcctgcctttgcctcccaaagggctgggattgcagccatgagccactgtgcccagcctacattcattcttgaatgatggttttcctcgtttcccttattttaaattgatgacttttgc

SEQ ID NO: 503459 - DNA, 728 bp, Homo sapiens
caagatagagaacccttagagatatcttggggttttttaccattccagagcttgtgagcataatcatattgctttatatctgatagtcctgaactcctaagttggcagctaccacccaggacccataaatggtgcgttctgcttcttgtaattcatctctgctaagtaaattataaggaagcaacggaaattagggaaaatattttatcttggatggtcttctataaaccagggactataattcttgtaccattattgtttcatctttgctgtcttctttgagccgtctaatgctgccacaccattatctccaggtatttgttttctataagaattgttttaaaagtattcttgttacccgagtagcttgtattatattctccaaacgtaagatgatttttaaaagcctgagtactgacctaagatggcattgtatgcactctgctctggagggaggggaggatagtccgtggaagtctgtaagactcttatttttttgtgcccatccaatatcaggtaaaaataattcgtgccattctgctgtttaaacaggaactattggcctccttggccctaaatggaagggccgatattttaagcttgattatttgtattgtaaattaatcccacctagttccttttaatttggttgaatgtctttttcttgttacaatgatgttttaaaaataaaaactggaagtttcttggccttaaaaaaaaacaaaaaa

SEQ ID NO: 503460 - DNA, 297 bp, Homo sapiens
accgctctcagctccaaagctttctgaggaaaatctgaccccaaggactgaggctctggcgaagctgggtataaactggtgcccactcgtgggcgctgatgctgtcccccagcccaaggaaagggccccctgccagctgtggctcctcgacccaaggccccgatacagtttgggccctctagctccatcaaggaaaacgcaggggccccttctggacctgtatggccagaagctgcctattggccacacacccccaactccaccagcgccaccactgcctctgccctgagaacccag

SEQ ID NO: 503461 - DNA, 335 bp, Homo sapiens
cattttttggttggagtgaagagtaattatatcttactttggacagggtttttgtacaggtggtaaagattttgtttttgacttcgttgatctgcccgccttggcctcccaaagtgctgggattaaaggcatgagctactgtgcctggcctggccaacatggtgaaacctcatttctactttaatacattaattaggtgggcatggtgatgtgtgccttgtagtcccagctacttgggaggctgaggcagaagaatcacttgaacccgggaagcagaggttgcagtgagccgagattgcaccattgcactccagcctggtgacagagcaagactc

SEQ ID NO: 503462 - DNA, 2237 bp, Homo sapiens
atcattcggccctcagactgggctgggcaggtctgagagttagggaaagtccgttcccactgccctcggggagagaagaaaggagggggcaagggagaagctgctggtcggactcacaatgaaaacgctccttcttttgctgctggtgctcctggagctgggagaggcccaaggatcccttcacagggtgcccctcaggaggcatccgtccctcaagaagaagctgcgggcacggagccagctctctgagttctggaaatcccataatttggacatgatccagttcaccgagtcctgctcaatggaccagagtgccaaggaacccctcatcaactacttggatatggaatacttcggcactatctccattggctccccaccacagaacttcactgtcatcttcgacactggctcctccaacctctgggtcccctctgtgtactgcactagcccagcctgcaagacgcacagcaggttccagccttcccagtccagcacatacagccagccaggtcaatctttctccattcagtatggaaccgggagcttgtccgggatcattggagccgaccaagtctctgtggaaggactaaccgtggttggccagcagtttggagaaagtgtcacagagccaggccagacctttgtggatgcagagtttgatggaattctgggcctgggatacccctccttggctgtgggaggagtgactccagtatttgacaacatgatggctcagaacctggtggacttgccgatgttttctgtctacatgagcagtaacccagaaggtggtgcggggagcgagctgatttttggaggctacgaccactcccatttctctgggagcctgaattgggtcccagtcaccaagcaagcttactggcagattgcactggataacatccaggtgggaggcactgttatgttctgctccgagggctgccaggccattgtggacacagggacttccctcatcactggcccttccgacaagattaagcagctgcaaaacgccattggggcagcccccgtggatggagaatatgctgtggagtgtgccaaccttaacgtcatgccggatgtcaccttcaccattaacggagtcccctataccctcagcccaactgcctacaccctactggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaaggaggggccttgtgtctgtgcctgcctgtctgacagaccttgaatatgttaggctggggcattctttacacctacaaaaagttattttccagagaatgtagctgtttccagggttgcaacttgaattaagaccaaacagaacatgagaatacacacacacacacacatatacacacacacacacttcacacatacacaccactcccaccaccgtcatgatggaggaattacgttatacattcatattttgtattgatttttgattatgaaaatcaaaaattttcacatttgattatgaaaatctccaaacatatgcacaagcagagatcatggtataataaatccctttgcaactccactcagccctgacaacccatccacacacggccaggcctgtttatctacactgctgcccactcctctctccagctccacatgctgtacctggatcattctgaagcaaattccgagcattacatcattttgtccataaatatttctaacatccttaaatatacaatcggaattcaagcatctcccattgtcccacaaatgtttggctgtttttgtagttggattgtttgtattaggattcaagcaaggcccatatattgcatttatttgaaatgtctgtaagtctctttccatctacagagtttagcacatttgaacgttgctggttgaaatcccgaggtgtcatttgacatggttctctgaacttatctttcctataaaatggtagttagatctggaggtctgattttgtggcaaaaatacttcctaggtggtgctgggtacttcttgttgcatcctgtcaggaggcagataatgctggtgcctctctattggtaatgttaagactgctgggtgggtttggagttcttggctttaatcattcattacaaagttcagcattttaaaaaaaaaa

SEQ ID NO: 503463 - DNA, 325 bp, Homo sapiens
cttcagaaacctttctgtattctctttgaaaagagatttacttaggcacctgtagtcccagctgcttggaaggctgaggttggaagattgcttgagcccaggagtttgaggccagcctgggcaacatagtgaggccccatctctaaaaaagaaaaagaaaaaaaaaaaaaaaggatttactcccccattcttggggaactcccctttctgtcccagcactccttgtcttggctccaactgtcccagattggacacttatgcaaatgattgttgtcctccaacccagggtctgggtaaagggggggcaaaagcaggggtaccgagc

SEQ ID NO: 503464 - DNA, 2095 bp, Homo sapiens
atcattcggccctcagactgggctgggcaggtctgagagttagggaaagtccgttcccactgccctcggggagagaagaaaggagggggcaagggagaagctgctggtcggactcacaatgaaaacgctccttcttttgctgctggtgctcctggagctgggagaggcccaaggatcccttcacagggtgcccctcaggaggcatccgtccctcaagaagaagctgcgggcacggagccagctctctgagttctggaaatcccataatttggacatgatccagttcaccgagtcctgctcaatggaccagagtgccaaggaacccctcatcaactacttggatatggaatacttcggcactatctccattggctccccaccacagaacttcactgtcatcttcgacactggctcctccaacctctgggtcccctctgtgtactgcactagcccagcctgcaagacgcacagcaggttccagccttcccagtccagcacatacagccagccaggtcaatctttctccattcagtatggaaccgggagcttgtccgggatcattggagccgaccaagtctctgtggaaggactaaccgtggttggccagcagtttggagaaagtgtcacagagccaggccagacctttgtggatgcagagtttgatggaattctgggcctgggatacccctccttggctgtgggaggagtgactccagtatttgacaacatgatggctcagaacctggtggacttgccgatgttttctgtctacatgagcagtaacccagaaggtggtgcggggagcgagctgatttttggaggctacgaccactcccatttctctgggagcctgaattgggtcccagtcaccaagcaagcttactggcagattgcactggataatatgctgtggagtgtgccaaccttaacgtcatgccggatgtcaccttcaccattaacggagtcccctataccctcagcccaactgcctacaccctactggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaaggaggggccttgtgtctgtgcctgcctgtctgacagaccttgaatatgttaggctggggcattctttacacctacaaaaagttattttccagagaatgtagctgtttccagggttgcaacttgaattaagaccaaacagaacatgagaatacacacacacacacacatatacacacacacacacttcacacatacacaccactcccaccaccgtcatgatggaggaattacgttatacattcatattttgtattgatttttgattatgaaaatcaaaaattttcacatttgattatgaaaatctccaaacatatgcacaagcagagatcatggtataataaatccctttgcaactccactcagccctgacaacccatccacacacggccaggcctgtttatctacactgctgcccactcctctctccagctccacatgctgtacctggatcattctgaagcaaattccgagcattacatcattttgtccataaatatttctaacatccttaaatatacaatcggaattcaagcatctcccattgtcccacaaatgtttggctgtttttgtagttggattgtttgtattaggattcaagcaaggcccatatattgcatttatttgaaatgtctgtaagtctctttccatctacagagtttagcacatttgaacgttgctggttgaaatcccgaggtgtcatttgacatggttctctgaacttatctttcctataaaatggtagttagatctggaggtctgattttgtggcaaaaatacttcctaggtggtgctgggtacttcttgttgcatcctgtcaggaggcagataatgctggtgcctctctattggtaatgttaagactgctgggtgggtttggagttcttggctttaatcattcattacaaagttcagcattttaaaaaaaaaa

SEQ ID NO: 503465 - DNA, 2062 bp, Homo sapiens
atcattcggccctcagactgggctgggcaggtctgagagttagggaaagtccgttcccactgccctcggggagagaagaaaggagggggcaagggagaagctgctggtcggactcacaatgaaaacgctccttcttttgctgctggtgctcctggagctgggagaggcccaaggatcccttcacagggtgcccctcaggaggcatccgtccctcaagaagaagctgcgggcacggagccagctctctgagttctggaaatcccataatttggacatgatccagttcaccgagtcctgctcaatggaccagagtgccaaggaacccctcatcaactacttggatatggaatacttcggcactatctccattggctccccaccacagaacttcactgtcatcttcgacactggctcctccaacctctgggtcccctctgtgtactgcactagcccagcctgcaagacgcacagcaggttccagccttcccagtccagcacatacagccagccaggtcaatctttctccattcagtatggaaccgggagcttgtccgggatcattggagccgaccaagtctctgtggaaggactaaccgtggttggccagcagtttggagaaagtgtcacagagccaggccagacctttgtggatgcagagtttgatggaattctgggcctgggatacccctccttggctgtgggaggagtgactccagtatttgacaacatgatggctcagaacctggtggacttgccgatgttttctgtctacatgagcagtaacccagaaggtggtgcggggagcgagctgatttttggaggctacgaccactcccatttctctgggagcctgaattgggtcccagtcaccaagcaagcttactggcagattgcactggataacatccaggtgggaggcactgttatgttctgctccgagggctgccaggccattgtggacacagggacttccctcatcactggcccttccgacaagattaagcagctgcaaaacgccattggggcagcccccgtggatggagaatatgctgtggagtgtgccaaccttaacgtcatgccggatgtcaccttcaccattaacggagtcccctataccctcagcccaactgcctacaccctactggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaaggaggggccttgtgtctgtgcctgcctgtctgacagaccttgaatatgttaggctggggcattctttacacctacaaaaagttattttccagagaatgtagctgtttccagggttgcaacttgaattaagaccaaacagaacatgagaatacacacacacacacacatatacacacacacacacttcacacatacacaccactcccaccaccgtcatgatggaggaattacgttatacattcatattttgtattgatttttgattatgaaaatcaaaaattttcacatttgattatgaaaatctccaaacatatgcacaagcagagatcatggtataataaatccctttgcaactccactcagccctgacaacccatccacacacggccaggcctgtttatctacactgctgcccactcctctctccagctccacatgctgtacctggatcattctgaagcaaattccgagcattacatcattttgtccataaatatttctaacatccttaaatatacaatcggaattcaagcatctcccattgtcccacaaatgtttggctgtttttgtagttggattgtttgtattaggattcaagcaaggcccatatattgcatttatttgaaatgtctgtaagtctctttccatctacagagtttagcacatttgaacgttgctggttgaaatcccgaggtgtcatttgacatggttctctgaacttatctttcctataaaatggtagttagatctgga

SEQ ID NO: 503466 - DNA, 629 bp, Homo sapiens
tttctaaggatcccggctcgcgaccagatactgtgagaaaaacctttgattttcaaaggatcctgagagagccaggtgtccagaggctgtcggggtcctgtgactggctgagggtcctgtggagggtcctgtgcctgcctcatgccacatgcggaagcaggaaaggctgagcaccgtgtgagaacagggctggaagggggcattccttcccacggatggattccagggtcttctgtctgcccgggacacctgccctctccatgaagggagacagggaagaagaggtgtccccaacaatgccaggatcactttccttctagagaactccccagagccggtctggatcatgagtcaccatccatggaggtgtaggtgggggctggagggcaagtacgagggcagagacaccccaagggagggagaaggagaagctgtcacctcactctccaccaggccctcccagccccaggcatctgcgcagaggatgctttctccactgtccacaggtctccttgtggccactgaagaaatgtgtgggcaggatcttagggtcattcactcacccattcaaatgtaccaagcaattccaacacagggacaacaggctcggatctgctcgcgacgatgac

SEQ ID NO: 503467 - DNA, 333 bp, Homo sapiens
aaacccaaatttacttagtgagtatttggacaacaaagaactaggggcttgtttacagaaaggtggcccacctttactctaaaataataaaagtaattttcacaatatgcaaacttacaaaaatcacaaggcttgttattataaggcaaaggtgactagataaatctaatcaactggggaatttgtttcataaaacttttttaacacacacacccattaggcaaatagaatcaacttctttgttgtgcagaaaaaagtagatccatcttggccaggcgcggaggctcacagcctgaaatcccagtacccggggaggggggggaacagagctca

SEQ ID NO: 503468 - DNA, 560 bp, Homo sapiens
gatatacttaattacatcttcccacaggagcaattttattaggagaaaatgtgacttttatatgtatgcattataaactaggttttacaagcataggtacaaagcaacaacaaccccccccccaaaaaatacccaaactatcaaattaaatatatcttattttttcaagtttttctgttaatagttactcactattatatttgctttatcatcttttagaacttgctagcctgggtagcaggcaccatagatttgagaaaaattgtggaaagcaagcctaaagttgtgaaaacctgcccctttaacttaattttccccccagctgatggggaaaacacagccattctgatttgattttctctgtacaatatcccattcctcttcagtggtacataggttaagaaccactcttctagagtaagtctgttaaatcagatatgaattaaataaaagtcttgtagactcttttcagctttctccttagttcctctggaatctcaggtaagggtttgcagccatttacctatttttttttggcctatttttttgccattcacatg

SEQ ID NO: 503469 - DNA, 148 bp, Homo sapiens
aagctttttttttttatatctaaactatatacatcttggcgagtaccttctgcgaactaatatatatatatctaacgaattataatttaatataaatattatatttataaaaattattaaattaatatttttggtcgttgagaagctt

SEQ ID NO: 503470 - DNA, 1845 bp, Homo sapiens
ctatttggtccccaggttaggccacatctgtagctagagggaaatgtagtggttcattagaggaggggcatcaccaggcttctaggggcccccactcagtgtatgagagctgagggaagagaccctgccagctgtggggctgggtggcattagggcagggatgcagccagtgagccgatggcataagcaagagcagtgcacttctttccagagacgcacagcaggttccagccttcccagtccagcacatacagccagccaggtcaatctttctccattcagtatggaaccgggagcttgtccgggatcattggagccgaccaagtctctgtggaaggactaaccgtggttggccagcagtttggagaaagtgtcacagagccaggccagacctttgtggatgcagagtttgatggaattctgggcctgggatacccctccttggctgtgggaggagtgactccagtatttgacaacatgatggctcagaacctggtggacttgccgatgttttctgtctacatgagcagtaacccagaaggtggtgcggggagcgagctgatttttggaggctacgaccactcccatttctctgggagcctgaattgggtcccagtcaccaagcaagcttactggcagattgcactggataatatgctgtggagtgtgccaaccttaacgtcatgccggatgtcaccttcaccattaacggagtcccctataccctcagcccaactgcctacaccctactggacttcgtggatggaatgcagttctgcagcagtggctttcaaggacttgacatccaccctccagctgggcccctctggatcctgggggatgtcttcattcgacagttttactcagtctttgaccgtgggaataaccgtgtgggactggccccagcagtcccctaaggaggggccttgtgtctgtgcctgcctgtctgacagaccttgaatatgttaggctggggcattctttacacctacaaaaagttattttccagagaatgtagctgtttccagggttgcaacttgaattaagaccaaacagaacatgagaatacacacacacacacacatatacacacacacacacttcacacatacacaccactcccaccaccgtcatgatggaggaattacgttatacattcatattttgtattgatttttgattatgaaaatcaaaaattttcacatttgattatgaaaatctccaaacatatgcacaagcagagatcatggtataataaatccctttgcaactccactcagccctgacaacccatccacacacggccaggcctgtttatctacactgctgcccactcctctctccagctccacatgctgtacctggatcattctgaagcaaattccgagcattacatcattttgtccataaatatttctaacatccttaaatatacaatcggaattcaagcatctcccattgtcccacaaatgtttggctgtttttgtagttggattgtttgtattaggattcaagcaaggcccatatattgcatttatttgaaatgtctgtaagtctctttccatctacagagtttagcacatttgaacgttgctggttgaaatcccgaggtgtcatttgacatggttctctgaacttatctttcctataaaatggtagttagatctggaggtctgattttgtggcaaaaatacttcctaggtggtgctgggtacttcttgttgcatcctgtcaggaggcagataatgctggtgcctctctattggtaatgttaagactgctgggtgggtttggagttcttggctttaatcattcattacaaagttcagcattttaaaaaaaaaa

SEQ ID NO: 503471 - DNA, 1186 bp, Homo sapiens
atcattcggccctcagactgggctgggcaggtctgagagttagggaaagtccgttcccactgccctcggggagagaagaaaggagggggcaagggagaagctgctggtcggactcacaatgaaaacgctccttcttttgctgctggtgctcctggagctgggagaggcccaaggatcccttcacagggtgcccctcaggaggcatccgtccctcaagaagaagctgcgggcacggagccagctctctgagttctggaaatcccataatttggacatgatccagttcaccgagtcctgctcaatggaccagagtgccaaggaacccctcatcaactacttggatatggaatacttcggcactatctccattggctccccaccacagaacttcactgtcatcttcgacactggctcctccaacctctgggtcccctctgtgtactgcactagcccagcctgcaagacgcacagcaggttccagccttcccagtccagcacatacagccagccaggtcaatctttctccattcagtatggaaccgggagcttgtccgggatcattggagccgaccaagtctctgtggaaggactaaccgtggttggccagcagtttggagaaagtgtcacagagccaggccagacctttgtggatgcagagtttgatggaattctgggcctgggatacccctccttggctgtgggaggagtgactccagtatttgacaacatgatggctcagaacctggtggacttgccgatgttttctgtctacatgagcagtaacccagaaggtggtgcggggagcgagctgatttttggaggctacgaccactcccatttctctgggagcctgaattgggtcccagtcaccaagcaagcttactggcagattgcactggataatatgctgtggagtgtgccaaccttaacgtcatgccggatgtcaccttcaccattaacggagtcccctataccctcagcccaactgcctacaccctactggacttcgtggatggaatgcagttctgcagcagtggctttcaaggacttgacatccaccctccagctgggcccctctggatcctgggggatgtcttcattcgacagttttactcagtctttgaccgtggggccccgtcttgcgggggctgcccgtcttgcgagggcgcccgtcttgcgggggctg

SEQ ID NO: 503472 - DNA, 540 bp, Homo sapiens
  misc_feature (68)..(68): n is a, c, g, or t
  misc_feature (75)..(75): n is a, c, g, or t
  misc_feature (77)..(77): n is a, c, g, or t
  misc_feature (93)..(93): n is a, c, g, or t
atgtcttttcccctcaaagccttcacattagcagttatccctctggttaggacctccctctgcctctnccccacntncctctgactaattctnacctctccttcagtccaagtataactggtacttcctcagggatacccttcctgacttctgaactagcccatattcctctgctttatgaacccacagcattctgaggggatgtcagaattcaagcctgacacacagtcacactcaatgcatatctgctgaacgaatcaaagaaatgcagagaaaagacatccaaaaataccaagtgaggccaggtgcagtggcttatgcctgtaatcccaacactttgggaggccaaggtgcaaggattgcttgagcttaggagttcaagaccagcctgggcaacatagcaagaccttgtctcttttacaaaaattaaagaaaagcaagtggacagtttttaagaattaacatttcacttttatacctcttagtaggagcattgtttaagcctattagagatggttagttgatagccaggtggcttat

SEQ ID NO: 503473 - DNA, 155 bp, Homo sapiens
tggcacacctggatccttaccttctgagtgaggcagggattcaacctgctcacaaagactacctagggtccttaacccactgagccacaacaggaactctgtgaggatgggtatcattaactctcccaccttgcaggcgaggcattctaaacact

SEQ ID NO: 503474 - DNA, 214 bp, Homo sapiens
ggatcacattggctccgtcattacttatgcgaatttctacaacccagtctcctgagaaaatagatttttcttttctgttgcatcatcaggctacaaattttctgaacttttatgctctgcttcttctcgaatgctttgctgcttagaaatttcttctgtcagataccttaaatcatctctctcaagttcaaagttccacagacaaagggaaaca

SEQ ID NO: 503475 - DNA, 901 bp, Homo sapiens
cggcgacatgtttttattttattattatttttttctttttccagtatactagcttgtcttttaagaaaggggatattaaaaaaaaaaacggacaaagtgttttaaaaaaaagcaacacccacacctgtgtctggtatttagtcagcttatctcgtgtccaatcggtctggatctctacagagagaaggtggaaaatggctggtatcaagggtgggcttagctgtggccttccaataaaggatgtgagaacgttggcaaaaaaaaaaaaaaaaaaaaaaaaaaaattttggggggggtgggcccgagaaaagtttttaaacccttctgttggggcgggcgggcccaaggatttgtaaagtctgaaccactgtgcccaaaaagcggtggtccagagggagcacccggggcatcaacaacatgtgtgctctggttttctctacccaaattaaaaaaagcggcgcgggggggaacacagcggtctttttgagacaaccccaagaaagggtgttcggagggacatagggggatctcacacagggggtccaggcgagcgccgatattaaatctgcccccggacatggacgcaaatactcaaccaacaacaaaacacacggaaaggagggagacaacggacaacaagggcaagaacgcaaagagaacggttcgcagcgggagagaagcgaagcggaggtagagacgagaaaaaagaaagcagcaaagaacgaagaaagagcagggaagaggaagagacaagagaagcgaaaggagaaagaacagcgaaacgaaagagacaagaagaaaacacaagcagagaagaagaggaaaaaaaaaaagcagaaaacagggagacgaacggaaacacaaagagaaagagagaagaagagccgaggaatagaggaag

SEQ ID NO: 503476 - DNA, 381 bp, Homo sapiens
atggacaggatatgcacaagatccagagtgaatggacagaggatcagaacaagctgtggtgaggcgtgtgtgttttgtgaaccacgggagaccttatgggtttccttttttgtttttgcctccagcttgggtatcccaagtccctagaacagtgtttggcaccatcttggcctaaatggcaggtgccccaatcactatttgtttgcacaagcaatgattatagcatttgtcacagcgtgtgttgtgctgtgtgtgtgtgtgtgtgtgtatggtgtctgtgtgagtgtgtggcatagcactggtcaatgctttcacaaacagaactgtgacccacagtcccgagggtcgcgacactccgtcagcagcaccatcccaaaccaa

SEQ ID NO: 503477 - DNA, 492 bp, Homo sapiens
  misc_feature (21)..(21): n is a, c, g, or t
  misc_feature (46)..(46): n is a, c, g, or t
  misc_feature (53)..(53): n is a, c, g, or t
  misc_feature (69)..(69): n is a, c, g, or t
  misc_feature (72)..(72): n is a, c, g, or t
  misc_feature (76)..(76): n is a, c, g, or t
  misc_feature (82)..(82): n is a, c, g, or t
  misc_feature (89)..(89): n is a, c, g, or t
  misc_feature (102)..(102): n is a, c, g, or t
  misc_feature (115)..(115): n is a, c, g, or t
  misc_feature (123)..(123): n is a, c, g, or t
  misc_feature (134)..(134): n is a, c, g, or t
  misc_feature (142)..(142): n is a, c, g, or t
  misc_feature (164)..(164): n is a, c, g, or t
  misc_feature (167)..(167): n is a, c, g, or t
  misc_feature (211)..(211): n is a, c, g, or t
  misc_feature (217)..(217): n is a, c, g, or t
  misc_feature (242)..(242): n is a, c, g, or t
  misc_feature (245)..(245): n is a, c, g, or t
  misc_feature (262)..(262): n is a, c, g, or t
  misc_feature (265)..(265): n is a, c, g, or t
  misc_feature (271)..(271): n is a, c, g, or t
  misc_feature (284)..(284): n is a, c, g, or t
  misc_feature (293)..(293): n is a, c, g, or t
  misc_feature (300)..(300): n is a, c, g, or t
  misc_feature (304)..(304): n is a, c, g, or t
  misc_feature (319)..(319): n is a, c, g, or t
  misc_feature (335)..(335): n is a, c, g, or t
  misc_feature (337)..(337): n is a, c, g, or t
  misc_feature (347)..(347): n is a, c, g, or t
  misc_feature (358)..(358): n is a, c, g, or t
  misc_feature (370)..(370): n is a, c, g, or t
  misc_feature (396)..(396): n is a, c, g, or t
  misc_feature (407)..(407): n is a, c, g, or t
  misc_feature (413)..(413): n is a, c, g, or t
  misc_feature (491)..(491): n is a, c, g, or t
tgccagttttttttttatttntaaagctctgccaaaaacttctagngggtgcnaatgggcacctgccanacncgcnccaggntgtccgngtggccagcaaanagagtttggccancagcagancaggccagggnggggcacngggggggttctgccttgctgcnggnactgaaaacttcttgcttcagttcatctacaatgatctttcccnctaaancccaaaacttgatgcgggggcctgnggnagcccaaagccagtggnggntagggntgaagcacagggngttgatgangtccccnccanctagcgtgtaaaggngtttgccttcgttganancccaaaaaanggcctggccanccttgcctccanaagcacaaagggatccatctggaganaaagtaaccgngttcanaaagcctgtgtggccaatgtggttggtcttcagcttgcagttagccaggttccaaaccttgaccagcttgtcccagcna

SEQ ID NO: 503478 - DNA, 1174 bp, Homo sapiens
  misc_feature (553)..(553): n is a, c, g, or t
  misc_feature (699)..(699): n is a, c, g, or t
  misc_feature (741)..(741): n is a, c, g, or t
  misc_feature (761)..(761): n is a, c, g, or t
  misc_feature (956)..(956): n is a, c, g, or t
  misc_feature (965)..(965): n is a, c, g, or t
  misc_feature (1174)..(1174): n is a, c, g, or t
cgcactgtgtgtggggccccggggagtattctccctcattaggggcgcgggagggctgggtacgagggtgaggattgattgctattggaggcatctattgtctgcacgtgtgtctgcaaatgtgtctccctgcagagtgttccaatctatgtcgtgtaacgcaatcgaatagtctctatgacgacctggtagctatgctgtgtcttaatctgcactcattcacctgcctggacccgccatctgcgagaatggagtcttgctcttctgcctaaacgcatcatcctcttatcaattcctctcgctgcctgcatgagattacctactcccactatgtatagggggtgacacaagggacgtgttttctcctaattggacactacgttatgcacttgacgtccctttccccccctcccatgccaccgcacggcgtagctcgccacgacactcagcacacgacacgaccagcccgcccctgccacacagcaccccacggcagcgacgagcccaatgtcgtaagccgagagcgtctacatagcacctaccgagacggagnaatgtgtctttatcgtttttagcataattgtaatttttatcttgcacactgctcgcccgtcgccgatccactctcgtctctcgcatcttcgatgcggtgagcgacttctctgtatgactcataactaactttccgaagcaatatcncacgttacaacagctatatttatgttagtctgactcttatangtatgtgacccgatggcccnatcgcgtgcgctgcaggcgccgtctccagagcgcataagtgtgtggctccccgtcgtcatgtatcggtgtcgtcagctattcctcatactgccgtcgcgcacctcgacctacagagtatccaccagatcatatacactctctagagcactctccatattcgtgttcttcagcgctcgaggccgtgaacttggtcnaacctagantcttataattatgactcattcgtgacgtgtcgtgatacgctatctgttcctatatatctaacatactcctgtaacctccagccaatgaccgctcgacgagctactcacgacggtagcaccgcactgacaccacggcactttacgtaccttttctctgctctatcatatcgtcttctctcttacccttcacttttcttcctcgtacattn

SEQ ID NO: 503479 - DNA, 881 bp, Homo sapiens
  misc_feature (85)..(85): n is a, c, g, or t
  misc_feature (471)..(471): n is a, c, g, or t
  misc_feature (561)..(561): n is a, c, g, or t
  misc_feature (578)..(578): n is a, c, g, or t
  misc_feature (700)..(700): n is a, c, g, or t
  misc_feature (745)..(745): n is a, c, g, or t
  misc_feature (748)..(749): n is a, c, g, or t
  misc_feature (761)..(761): n is a, c, g, or t
  misc_feature (769)..(769): n is a, c, g, or t
ggtgctccagaaactctacagtgttttatttcaatttcgtttttaagtccattttaactattttaaaacttaataaaaagcaccntgctcactcacatatgatatttaccaaattgtcatagcaatgaatggcatcccgatatgtgctgtgaggatatttgaacttcttataaacatcttagacagttttgcttttcgctgatctttttcagtcctaccatgtctgcttaaccagaattgcccaggcaggaagaccctgtagtgtacatggagcacactcagctcagtgccgtgcacattgtgcccttcgtgggtaacggcccactcattgtacaaaataagtaaaggcctaatagtatcatgataaataatacagttaaatctagcccttattttgagttttggatgctttgtgtctgacccctgtcttagtagtaaagagcaaaagtagttgtatgaaatttttcacangtcatccaattttgaaacaaaactttgctgtttctccctttggatcttccagattacttaattgaaactcattccatggctgggcatggnggctcacacctgtaatnccagcactttgggaggctgaggtaggaggattgcttgagcccaggaattcaagaccagtctgggcaacacagcaagaccccatctcaatttttaaaaaaaattatttggggccaggtacagnggctcatgcctgtaatcccagcatttggggaggctgaagcagganaannacttgaacacanaagtttgngaccaacctaggcaacatttgtagaccccccttctctattaaaatttaaaaaattaacccaggccttatggtgtgcaccctgcagtgcccagctcttcccgagacttaggtg

SEQ ID NO: 503480 - DNA, 879 bp, Homo sapiens
ggcgttcggcgggctcccgggtacaaaaatggtgtggtagcgatatctacctgcgctactacgtagggcacatggcaagtctgggcacgagtttctgaagatcgaattcggccggagggtgtgacgtgtaattgtcaccataggagcggcatgaggagtaccaagcaagaggggagaggtaaagtcccacaggagggagtcaggaagatcttcttagaggaggcactctgtgagatgagtctcgaaatgagagactgtggcttgtgagagaaaaaaacagatttccagagcagtatgagcagaggatgaggtgaaacttgctacccaagtaggtgtgcacacaggtgtgttttctgacagcgctatccttagagaatgttacattgtgatctgtgctacctgcaacaagaaagttcatggggatatatatcgggggttggggaatgcaggttggtgttggacaacaggcaaatacaaaatttagggaaaagcttagatatgccaaaaagcaattacaaaaatgatgtgatgatcagaaaagaggtatgtgcacaagagtgtatggaagactgaagagaatcattgtggaccgtgaattccaaaagaagatgatgttgtgtgggctccccctgataggtgtggccgacagaataagtgatggtccagggttctgaagaatctgaaggctaattcctctgaaaaagaagggggtctgaagggctttcacctgggaatcttcaaaacctggaggagagattacatcctctgtatccgagagggcttgcaccttgggagaacaagtggaccactgcgggtcgcggacgactttggtcagagcacaaagcggacgtggggcgttcaccaaattgttgaacgcgg

SEQ ID NO: 503481 - DNA, 109 bp, Homo sapiens
acacttgctgcattcgtctctactacaatatactggagaacacccaagctaggaacctgggagtcatccttgatactttctcttcctccttaatcctgtgtattcagta

SEQ ID NO: 503482 - DNA, 205 bp, Homo sapiens
  misc_feature (1)..(1): n is a, c, g, or t
natgtatgaaatgtgaacctcactgaatatttttttttttcagttcttcttggtaaatatcctattgtggggaagatttaactatatcttagagtttaaattctgctgtgtagactctggcagctgcctctatggtgacgaaacaagctttttttattcatcttttatttttctccatacaacggggaaattgggggttccccag

SEQ ID NO: 503483 - DNA, 633 bp, Homo sapiens
  misc_feature (293)..(293): n is a, c, g, or t
  misc_feature (350)..(350): n is a, c, g, or t
  misc_feature (367)..(367): n is a, c, g, or t
  misc_feature (373)..(373): n is a, c, g, or t
  misc_feature (383)..(383): n is a, c, g, or t
  misc_feature (416)..(416): n is a, c, g, or t
  misc_feature (434)..(435): n is a, c, g, or t
  misc_feature (522)..(523): n is a, c, g, or t
  misc_feature (528)..(528): n is a, c, g, or t
  misc_feature (534)..(534): n is a, c, g, or t
  misc_feature (541)..(541): n is a, c, g, or t
  misc_feature (543)..(543): n is a, c, g, or t
  misc_feature (551)..(551): n is a, c, g, or t
  misc_feature (565)..(565): n is a, c, g, or t
  misc_feature (602)..(602): n is a, c, g, or t
  misc_feature (625)..(625): n is a, c, g, or t
ccccgccttttttaaattataatttttatttcccaacccaagacgatacaagatgtcccacgggcacaaaagaagggtcaagtcacaggacctccagacacaggacaaggtgcattacccaatcaaagcccattcacggggcgtcccaaccccacacacctacccctatgatggaatctcgagtctcgactcccgactcctcctccgatctatgcacacctgaggaaatcttcggtgggcagcgaccataccacaggtctgtccctaaggaggtggtccgctgacctctcaangggtgggggtggggtcagagcttacaggtttctgtcttcttgtgcttttagatgcanttgctctgtcctgaccnggtgancgggcctcanctgggggtggaggggcaattggaaggctgtttncctctggcaaagtctggnntctgtgcttgtgtgaggttaacccacccccacttccactctaggccccaggtgagactccaccaccagtcctggtagtgagggttcnncggtnagggtnaggtttntnggggttcngcgctttacaatgntaaagccttagccctcctccaagagctgagacctctnagggcctgaatcttcttttccanaagataaa

SEQ ID NO: 503484 - DNA, 875 bp, Homo sapiens
ggcaggaagatcccttgaggccaggagttccagaacaccctggacaacacggcaagccccatctctacaaaaacttagccatgtgtgctgcagcatgcctgtaatcccagctacttgggaggctgaggtgggagaatcatctcagcctgggaggtcaaggctgcagtgaaccatgattacaccactgcactccagcctgggtgacagagaccctgtctccaaaaaaaaaagtgaaaaaaaaatatgggcctgggcacaggggttcacaccttataaccccaagcacttggggaggccaaggtggggaggatcacttgaagccaggagttcaacgaccagcctggggcagtatactggagggccccatggctataatttttacctttctctttgcttttttttattggggctacttggactccaatatttttttcaaatttcaaaactggtcaaacttttgggctgggcgcgtggtgggataacccgggtaaatcccagcaccttgggtacgcgccagggcggggcatattcacagaggtcgggaaatcgagaccatccgggctaattgtgggtgaaaccccggttctcggcatcaagggtccaaacaacttaccgggggcgcaacgggtggggcgccctggtgggtcccaggtaatccggaacaggtagagccaggaaaagggcctggacccggcgaggcggaacatctgaaggtggggcccgaaattcggcgcacatggggacccccagccggggtgtggacagagcgaaaactccgttctcaagagcaccaaacgccgacagaacaacgaaaaccttgtgcgggacgctggcgccctctagagaaacgtttaaaaccacactctttggcagga

SEQ ID NO: 503485 - DNA, 333 bp, Homo sapiens
  misc_feature (117)..(117): n is a, c, g, or t
gtgggcaaaggtgtcccgagctgccatgtttaggaaaatactgcccatctgtatgatactattatggtagatgtatgtcattatacatttgtccaaagccataggatgtacaacacntagtgctgtgatgtaaaccatggacttcaggtgataatgatgtgtcatgtaggctcatcaatcatagcaaatgcaccactctggtggcgggatgttgataacgggggcagctgtacatgtgtgggcacaggacataaatgagaaatctctgtaccatccactcagttttgctgtgaacctaaaagtgctccagaaaaaaaataaagttttttttag

SEQ ID NO: 503486 - DNA, 197 bp, Homo sapiens
tgattcctctcatttccagcttttcagtttctgcctgggcaatggccaggggccaggagtggggaaagttgttatggaggggaaaggggtcacaccccaccccctgcctggttttaggctgctgcacaccaaggccctgcatctgtttgctctgcaaatatgtctctttggagttggaatttcattatatgttaaga

SEQ ID NO: 503487 - DNA, 1094 bp, Homo sapiens
aaaaggggatcctaggcaagcagcaggtacgaagtacagcctgtaagcgtacttcagaaagagcgaatagtatggagtatagttgccggaatggaggaaaggactacatgctgcctggcctgtcacgacaataaggagcacttacacagaacgaatcaatgtagaggaagagttgtgttctgcagagaacaactcgtgtgttgcagcgagagtgacaatgttaaaagtggcacaaaagcgtcaccatcagtagaaaagcatacagacttctcaagcagaacaagcaaaacccttacgggaggatattttaatgcaaaatattgaaactgtgcacccagtttcgaagaggatcagcagtagcgacatctcatttggaagttggaaacacgatgtccatcagaatttccttctaaaagcatcacctttacttccagaagcagcagccccgagaacaagtacaaacttttgcacccatgaggccacagaggcccagaccttcagcatctcaagtctagcccagctggatttccatttccagggcctcctaattttccgccacaaagcatgttgggatttccaccacattgggccactccattacttccccctccaggcttgggcttgctcaagaatcccatggttccctggccacctgttgttccatctcccaggtccaggcacagcgtatgatggggtcctctctcacaaggctcaaggtgtataggcccgagaatttttaccaggtaagacattcggagggccaaggggcccttttggcccttggtgtaggggacaccacgcaccggggtggccccaagaagggggaacggggacgcagcagaatttttcaggggttcaaccacattgtcggacagcggactccaaaggagggaggcaacaaattgtagggatacgacggacaaacgcccgtcaggacgacaacagacacggggtgcaggcaacaacaaagacgacgacaccagtgtgtgtagtacaaacacacatcgatgtgggatcacacacacgtgtatcagctaccaatacgtataagatgcagcaacacggccaaacagaggacgtcgtcacgacgtttg

SEQ ID NO: 503488 - DNA, 382 bp, Homo sapiens
  misc_feature (29)..(29): n is a, c, g, or t
cacaacttaaaaactttttcaaaaacccnctttcccccacagttacaccctgtaattgtatcctagaccctaaatcctagtatttcccctgtgtgtatattaatttcagtagatctgggccgggctcggtggctcacacctgtaatcccagcactttgggaggccaaggcgggcggatcacgaggtcaggagttcgagaccagtctggccaacatagtgaaaccctgtctctactaaaaatacaaaaaatactagccgggcatggtggtgtgtgcctgtaatcccagctactggggaggctgaggcaggagaattgcttgaacccaggaggcagaggttgcagtgagccgagattcggccactgcactccagtctgggtgac

SEQ ID NO: 503489 - DNA, 150 bp, Homo sapiens
ttcgataagtcgaaactgaagaagacagagacgcaagagaaagatccactgccttcaaagaaacgattgaacaggagaagcaagcaggcgaatcgtaatgaggctccccaatatcctgtacttcacagcttgccttcttattactctttt

SEQ ID NO: 503490 - DNA, 562 bp, Homo sapiens
gggggtcccccccggggggggccgcttttaaaatagtgggttccccggggtgcaggaatttgggccgaaccccagggcccgtttttttcagggccccacccccagggggttttttcccagagcctttttgggggtgccctaacttgcccggggcctttggttaaagcctcctccttttacattttaacaaaaaaaaggggtgggccttcttcctttccgcctggaaaaaaaaaaaaatgccttttttttttttacctttaaaagtagcccgatagttaccaaactgggtgggttattaacaaaacctttttttttccccaaaggaagggttggatgttcaaataaactgcctgggatttaaaaccgttaagcaaggggggccattccccttaaaggggtttttttcccggaacggggttcccccggggggttgtttttaaaaaccctattctgtgggcatgaaggtgggggtttgcccctaaaagaaagttttctcctttaaaaggggtgggctttcccattctgggcgggtggttccaggtaaccaaatccccctttttta

SEQ ID NO: 503491 - DNA, 1131 bp, Homo sapiens
  misc_feature (324)..(324): n is a, c, g, or t
  misc_feature (460)..(460): n is a, c, g, or t
  misc_feature (1049)..(1049): n is a, c, g, or t
  misc_feature (1052)..(1052): n is a, c, g, or t
  misc_feature (1054)..(1054): n is a, c, g, or t
  misc_feature (1058)..(1058): n is a, c, g, or t
agcttggcacgaggcggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccaggnccacaggtagctcctgggaccgcccgcccccactgccactcccagctgcaaggaccgtctctcagctgcgctgggaaccgctgcttctcgcttattagaaaactgtctctttccttttgtcctggtgtctggtganctcctcttgtcctgtggcatctataacctgagttcagtcacttaataccgaggtcctgcgctctgctgtgtgcctggccctgggctgggcactggggacatagcagtgaccgagacagacaggctcacaaggagacatacgacaaccaggtaaacatggcagacaagagcatgtcagatgcctgtgaagaacactgcggggcccctcctaggaggtggcatgagttacatgcagacagagacgatccgggggcagacggagttccatgtggggcagtggtgagggcagacgctctggggctgggatccctgggagtgttcgagaagcaccgagaaggcttctgtggctggagccggccagctgggggagatggggccagggagatggtctggggctgggatccctgggagtgttcgagaagcaccgagaaggcttaccatggctggagccggccagctgggggagatggggccagggagatggcaggggcctctccctgtcccaggacccagagccaagggaggctttaagcccaggaccaggggtctgaaaacgaaaagcactcacagtccttgaacattggaaaganaantnttgnagagtagcccttctttttgtttttgttggcattctaagttaataaacacgcttatgaacacacaaaaaaaaaa

SEQ ID NO: 503492 - DNA, 1103 bp, Homo sapiens
  misc_feature (324)..(324): n is a, c, g, or t
agcttggcacgaggcggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccaggnccacgagccctggaggaagcacccccgccctcctcagcctgatcctggaagagactcggggccccccagcctcctgcaacccagtgtcagtgcctgaggtgtagccacgagcctctctctctgctctgaactaaccaaccctgcccgcttggcagccagtgcatggcacctgcttgtctaaccacttggggtatcatcactgggcttgtgggatgatttcggaggtggcatggtggagtgggtgtctgcaggtccagaatgtaccagcactgctgctcagtggaccatgtcagcccatctcatcccactctctctccaccactcttcctctctcttttccatggccataggccccatgctagtcccagagatttccacccacccaagacagagaatggtgagcccacattatcctctatcctaccaagtgccaagaagcctcgctttaacccagagccacacagtctctcagtggcacgagccctggcaatgggcaaatatacccacctatctactgggacctaccccaaaccatctaacttgccctaaccgtgcatgtgttgaccccgaaggccaaaatttccaccgtacacccattccttcagggttcatcctagcacatatacacaatatatctcgttacacagggttgggcgatctccagggttgaccccagcggacacggcgtgcccaggtcgccacacgctgcacggcgaatgatagcatagggcacgccacatcgcgccaacctgcctagcatacgacacacgaatatcccc

SEQ ID NO: 503493 - DNA, 1316 bp, Homo sapiens
gggcacatgcttctggggctgggtgccccggcagccgggcaggcctggcctgacctcgacctccgccgtgcgggcccgaccggtgagtccatgccctggcatgtctgcagggaccctgttgcctgtcagcctctcccgtccacactcttcccttgcccccaggctgccatgttgctgcgggcttgcgctcgtgttgtgcggctgtgctgtgtgtgccctcatgtgctgtgtccattggctggcagtgctgcctaggtggccaggggtcctgtgccgctgctttggcttgatggggctgcttgattctgatgccagctagaagctgcgtgagctgcaaagcgtaagcgaggcggacttagggcagcgaaaggcatccgggtttgagcacagcggcttcgcgtgggggcaggtcctacgacttggcctccagaaaggcccggcccgtgctttggcgaaagttacattaactttgtggacccttgggtttgctcccaagggttgggaattccccctggcttctttgcgattgtgcctccccgaaagaggagtccgagttacaacccacttggcattgagagagcgatccgcgcgtgtacaaaaactagataggggtccaacgcaagcgagcctatccgaatagccgatcaaattctattccgttaactttggttccgcccaaactggtggccaagcccgtgaaagagaacggagccaagcccaatgttaacgctatggcgcaaccaatatttagcgcctttacacaacacttcggttgcgcaaccttggggaggcaacccttagtacgtgcagagttttatgataccgccagagtggtacccacccgcttggggctcaagttgggccgttacattcgcgactatcgcgcggacaacaccagaactgcgcgcgtatggacaagggaaagctgcgtacgacactctttccttttggtattatcccgccagcatataatagacgcggagcgagaaaagccaccttaccattatgctggagagcccaaatttgggggacatataggtttggacaccattacagtttcgtatagtatcaccagcagagcaacaggttaacgttttatcaagttcagagcagcaactggattggggcagaacaggcccatatttctccacaagagtatgtggcacaccgggccattcccgggcacgagttaacacggctcgcgaacacgcgtatacaggtccccccgcttgggcaccacttggggggctgcttcagagatatacgccgtatgggccttcccagttagtagctacaagcatctacgaaggcggaac

SEQ ID NO: 503494 - DNA, 115 bp, Homo sapiens
  misc_feature (1)..(1): n is a, c, g, or t
nagccttatcgtctttgagaggtaagctttgcttaaaggctactaggaaaagagtacgtattgccttacagctgaaaatccaagagcgactgagaggcgagagcgacttagacgg

SEQ ID NO: 503495 - DNA, 1075 bp, Homo sapiens
  misc_feature (324)..(324): n is a, c, g, or t
  misc_feature (460)..(460): n is a, c, g, or t
  misc_feature (556)..(556): n is a, c, g, or t
  misc_feature (993)..(993): n is a, c, g, or t
  misc_feature (996)..(996): n is a, c, g, or t
  misc_feature (998)..(998): n is a, c, g, or t
  misc_feature (1002)..(1002): n is a, c, g, or t
agcttggcacgaggcggagatgcagctcaaggggaagaaagtcacggacaagttcactgagagcgtctacgtcctggccaacgagccatccgtggccctgtaccggctgcaggagcatgtgcgtcgctccctccccgagctggcccagcacaaggcagacatgcagcgttgggaggagcagagccagggagccatctacactgtggagtacgcctgcagcgccgtgaagaacctggtggacagcagcgtctacttccgcagcgtggagggtctgctcaaacaggccatcagcatccgggaccatatgaatgccagtgcccaggnccacaggtagctcctgggaccgcccgcccccactgccactcccagctgcaaggaccgtctctcagctgcgctgggaaccgctgcttctcgcttattagaaaactgtctctttccttttgtcctggtgtctggtganctcctcttgtcctgtggcatctataacctgagttcagtcacttaataccgaggtcctgcgctctgctgtgtgcctggccctgggctgggcccaaanccctttgggtggtagtggaaatccaaaatttaatggccaatgtggatcctgaggacagaccagggggctcacaaggagacatacgacaaccaggtaaacatggcagacaagagcatgtcagatgcctgtgaagaacactgcggggcccctcctaggaggtggcatgagttacatgcagacagagacgatccgggggcagacggagttccatgtggggcagtggtgagggcagacgctctggggctgggatccctgggagtgttcgagaagcaccgagaaggcttctgtggctggagccggccagctgggggagatggggccagggagatggcaggggcctctccctgtcccaggacccagagccaagggaggctttaagcccaggaccaggggtctgaaaacgaaaagcactcacagtccttgaacattggaaaganaantnttgnagagtagcccttctttttgtttttgttggcattctaagttaataaacacgcttatgaacacacaaaaaaaaaa

SEQ ID NO: 503496 - DNA, 350 bp, Homo sapiens
tttgttcatgagcccactgggtgattgacagtagataggatgacaggtgggaaagagactggctggtatccacagaacaggtcatcctatctacttgattattaatatccttctctgctgaggtcatcctttggtgggcattgacataggagaatacaaataccttcagttttttttttttttttgcctgtttagagagctctagccaaataactcttccttacactttcttgtcatcgattttccaatcatgttccttctaagtccctgaccatccaaccaaactattgggtgatagtccataagttgatatgtaatccgatgtctgggtcgtttttccttcaagcaaa

SEQ ID NO: 503497 - DNA, 1158 bp, Homo sapiens
tggctttgaatgaacttagccaaatactttcttcaccaactctcatgaggagagggaacactgctgcagaaactgcatgaatggcttgcagataccacacgcacggtggaccgaaatctatcacttcaaggatatcaaagaaaccagactgtgatgactggcgaggagcgggcatgaactgcgatggagtgtgcattacagtttggactgaaacgtgtgaatcatgtcatctatctggaactgcaccttaaatctggctcacctgaccacacataaatgactccgcccactatgtgtgacttcacttgagaccatcagttatctgtaatgagtcacggtgaaatgcccattcctacaacgaaacttcccgggtagactcatcggtgactccacatcgtatgccgcaaagaatggagatgactggccgctggaatctagcgctatgtgacgcgtaattatcatctattagaactaagctactatcccctggggatgcacacgttgatggaattgacacatgctaaggccttcgtggcataagtttcccccacgtaaggcgcgtgcggggatgaactttcgcctggggtccaaccatacggtacagatggcaattgcagtggtatggggattatcccattgtaccctattatctactatagcttggtaccaacatgacagtaccagcattaatagttctatcgacctttgtacgcaatttccacttccaatactaaaacgaaatattttggttaacaccgacaggcttcacaatacttaggccttaacggagggggggggaggcagcggttacaaaaaatgacggacttccactcttgcgagtgaggcgtcctcacaaagttctaggacccgacgattacgccccgcgttcgttacggtgtgaccacgacactagtggtgcgtcccctctcaatagaaagccgcacgctgggaaagtctaacaaccggggagggcaagatcgggtgccgtccagttaaatccgacacgcgcggggcacctattggggtcaccaccagttgacctaattgcgtgaccattagcggagcgtacaggacctacgtaaaaggcagtggtcgggggggtgcgacattcattggggtcccctcttctccacggggggtacaattaatactagttcc

SEQ ID NO: 503498 - DNA, 215 bp, Homo sapiens
  misc_feature (31)..(31): n is a, c, g, or t
caagcttgaaggcagcctatatgaaaatacncagaggagccaagaataaagaatgaagcatgcttacaagatctagaaaacagcctcaaaagagcaaatttaagagttactggccttaaagaggaggtagaggcggagggtgcagtgagcagaggttgcaccattgcactgcagcctgggcgacaagagtgaacctccatctcaaaaaaaaaaaa

SEQ ID NO: 503499 - DNA, 321 bp, Homo sapiens
gcgagtagtacatgtccgcggagtgtaggtatagggggacgtgccagcggaagtggtgacgttcacttggcatgttgatacttcattgggttctgaattcccaggcttggcaaaatcaaatagatgcaccatatcaacatcatttggctttaccgagttttcctccgatgtgcagcctaagtctactttcaggacatgcagcaggtggcgcattttttcctcctccaaatgtttatttggttttatatgtcgctcgaacagtcgttctaaaaacctgtttgaaaataaaccaagtttcaaaatttcatctgttacatcttc

SEQ ID NO: 503500 - DNA, 134 bp, Homo sapiens
aggaccctttgcggtgctttccaccaaaaaagggagaactctttaatcagatgtgggtatgtagacttaataagtgaaacatcacagaagaagctgtattatacaatgacaacccaaacaaagtactccgcgat

SEQ ID NO: 503501 - DNA, 626 bp, Homo sapiens
  misc_feature (158)..(158): n is a, c, g, or t
  misc_feature (326)..(326): n is a, c, g, or t
aaagggaaggccaagaagcccttggctcccggacccaaggttgttgccagagcccccgggttttcagaaaattttctcccttcagagaaggttttagaaaagagtgatagggcaagaccccgccttttcagaatccattgaggagggggggcccgccnaaacctccaacggggccctgaaaaacaagcatggggagaaggctccttttcctttttaaaggtcctctccttggggaataccccgccgggaggggctttaaaaaaaaaaaaaaaaacaatgttttcccccgcccccgccccaaaaaggggtcctggagcaatttttcnccacagggttcacccgtaggggcttttcagccctgagtaatggaaaattaggatgcccaaccttggcccgccaaaagtcaggaatgtgaatttaaaaggcttgtttccccccgcttttttttttgggccccctcccccccctggatcccgtttttttggggacccccttttgcctttttaaaaaaggaaaaaggccgggaatttttattaactcctgttttcccaaaaaagtttccccgcctaaaaggatggaattttattttggtgttgtaaaaaaaaaaaaaagccaatttgtgggta

SEQ ID NO: 503502 - DNA, 401 bp, Homo sapiens
atcagttgaacctgggaggtggaggttgcagtgagctgagattgcgccattgcactctagcctgggcaacaagagcgaaactccgtctcaataaataaataaataaataaataaaataaactgaatagccgtcctttgtgtgtatccaccacctgttgttcatccactcatctgttgatggacacttgggttgcttccagctcttggctgttgggaatagtgctgcaataaatatgggtgggccggctgcggtggctcacatctgtaaccttggtgctttgggaggctgcagcaggaggatcacttgagcccaggaggtcaagaccagcctgggcaacatagtgagaccctatctctattaaaaaatgttttaaaattaaaaataaaatgggtgtactaat

SEQ ID NO: 503503 - DNA, 292 bp, Homo sapiens
cccggttgatattgtcctcattgttgggcctcctaagtcggctcaggcattaccgttcatgcattaacgatttcccagaactttcatgacgctcgttgaggtcctcaggccattaatgcagcagttgcgatacataaaaacatctcaactacgtctccttttcttcgtcacatagatactgacatgataggaagctctcagcttagggaaagagaatcaatttaagattatagaacatggatacaaaagtgactggaacacattggctgacgccttactggaaaccagtgaa

SEQ ID NO: 503504 - DNA, 128 bp, Homo sapiens
gagcagcctacttcgtccgtttggtaggtaaaccccatcgaaactctcatccgcgatatgttactgttcgggacattccaaacggcttaacatgcccaccgagtctccgagaccggcgctgtccctac

SEQ ID NO: 503505 - DNA, 294 bp, Homo sapiens
taggttaaggtcgttgtcagtgaggcgttgtctatgaacacacgtggtattgaggctgccgcgtttctccctgtagtggactgctgggacgggcccgatgggaagccggtcatctaccatggctggacgcggactaccaagatcaagtttgatgacgtcgtgcaggccatcaaagaccacgcctttgttacctcgaggtcagttggctgatttctggtggtgtgacttaaaggggaaggcagctagggttggatatgatagatggacagacaggcaaacacacactgacaacgg

SEQ ID NO: 503506 - DNA, 110 bp, Homo sapiens
ccggtaacactacgcataaaaaacatagaacatgaaaacgaaaaaggaaaaaatgaaaaaaaattagccttgacttgcattaacttccagatcttaaactgatttcttaa

SEQ ID NO: 503507 - DNA, 124 bp, Homo sapiens
aacgggtgatgagtacaagggcaagctgaggtgtccctgcgaactacactgctgccagtctggcacctcgtgcaccagctccaatgctctctgggaggtggaggtggtccaccactgacccctg

SEQ ID NO: 503508 - DNA, 338 bp, Homo sapiens
attcgcggccgcgtcgacttttttttttagagatggggtttcaccatgttgcccaggctagtctcaaattccaggcctcaagtgatcctcccaccttggcctcccgagtagctgggaccacaggcgcatgccaacactcctgggtaatttttgtattttttgtggagaccaggtctctctgttgcccaggctggtctccaactgctggccttgggagatcctcctgtattgggctcccaacgtgctgcgattacaggcttcttgctcacctcttaagtatgccaggtatgttgcccgactcagctgtagagcaggcttcatgtctcacccctttgcat

SEQ ID NO: 503509 - DNA, 1493 bp, Homo sapiens
cggttgggtgggtgagctgtgcttgtgtgggcgacaaagtagtgtgggtgggggttgatgccggcgttgcctacgctgtgggaggttgtgctggctgttgtccgtgttgtgctctcagaaggccgcgcgtctccggagtgtctgtgcttgtttgttgttgggcgaacttccccccaaagggggtggtccgaagggagtccacatcttctgggaggtttcgtgaggagatgtgtctttgtgttgggggacagattggcttctttggggtgtccttatagagtcgtgggggggagtttggcgatctgagcgaggtgcgctccgaatgtggcccgccgtggtggtgccaacagctgtttcctgtgctgtttagggtcggccgccttcgccgagtgttggaccccggggtggtgagacgctgggccgcaaagtgtgggggggcccccacagtgcccatgggggccccgcatcattattagggattctgttgtggggctttgtggggggggttttgtcgtctccgcgctgtggttggtgttctccacaagagtttctcagagtgtgttgtttgggcgccccgtgtcctttattgagaggcattttttatgtgataggcgacgccacgggtctcgcgccccagtgggtctctcccccggggcgcaccagaagggggtgtacaagtgtcttgtctgtgcgcgagtgtaagtgattgtgctgtgggtattggacactcgcgccctttggtcgctgtggctcctgtgtgtggcccacggtgggtgatccctctgagaggagaaaaaatgacacactgtgaaccacaccgggaacactctgcgcacacacagtgtgggggagacacacaggcacaacgctggatacaccctctatgtgggagagtgggagactctgtgatacttccgctctgtgtctatgaggggaggaattgtgctctgaggatgtctcatcagagagtgcgcacacccctctcttttggaggcactataggttgctcccacgaggagatctcgccgcgcttgtgtgtccccccctgtgagagatatagggacgcctacatacgtatatatgcgacgcacacataggtattatatatgggcgccacacatgcgactatattttgttgagaaaatgatatatgggtctctttctgtataaccgagactataaaggagatcttgttttggggtgtttttgcgcttataagtttttgagaccccaagatctcgctatgagcagcccccgcgctcgagtataatatatgttatagtataatctctggagagagagagaagaaatataatggatagtgaacccataaagatggagaattcctccctctatgatagttataggcttaggtttatgggaagaatagttaacataattccactttttcctccctcttttttggaactcttgttatttttctgccctagtttttttcatttttaatccataaaggagtataattgttccca

SEQ ID NO: 503510 - DNA, 204 bp, Homo sapiens
ctcaactgcgcccggacaattttgtagtatttatagtagagacggggttctccgtgttatccaggatggtctcgatctcctgacctcgtgatccagctgcctcagcatctcaaagtgctgggactacaggcgttagccaccgtgcccggaccacacctaggtgatttttaaagttcttctagtagagacagggtctcattatgt

SEQ ID NO: 503511 - DNA, 713 bp, Homo sapiens
gtgcaggcccccatggtaatcctgatgaggtccctcttgcctgtcgaggaacaaaccttgctgaatattactgcggggtacggtaaggcgtcctatatcgatacgttgtcgtcaccacattaagtgctctcacaacgatgctatcgaagacaggccctctccttctagccacgtaaagaggctgggtacgactgcatggtaaacatgcacctgctccttatcatcatcgttctcgccattagcagtgactagctctcatttagtgtagccataagcctaacaacagctgactccaggattgcataagcccccatgtgaaatcaggtgctgtactgcaataccctgccagctgtgacttgttatcctactatatgttctaaggagtgaataatattgtccgagtaactaacttatttaaaagacatttccttctgtgggcattgactgtatcccacctgttttccaatggtaaatggtaactctgtttctggagaacacctgaaatcaatggctatacattccaaagcaatctaaaggctatttcctttggtgtgggtttggttttgttcattttgaaatacacttttgaacactgagatccgtaaaatactagatctctggaagtgtaattgtgaaagaaattgcttgcagctttaacagaagtgagaaactttccaaataaaaactagttggaagtttaaaaatataaaagg

SEQ ID NO: 503512 - DNA, 793 bp, Homo sapiens
ctcgtaaaaacttcccttttaaaacacttccccaacgagttctttttccctccacaataatttattccgcgccttcgtggaatcaaaaccagtaatttttagagcatatacccctccttaagaaaccctgtataatggtcgcagagataccccccattattatgttgattccaccggagcactggggcccccacattcgtatagattctctatctacgcaaagggaccccacattgatcgcctctgaagtcacacaaaatattattggcgtaataaatagatcctccctccaaaggccatactatcaaagaatgctgttggcagtgacccccctcacagccgctctctgtatcccctctccgagggcatctcacccacaaatatatagcgagatagagagaggctgtggggaggtgattttttaagagagagatattctttttatgcgagccatgatgtctctcttctctctctcttctctctgtcagtaacgctcactctctctgtctgagagagagagtgtctccttaaagttattaactcgcaccgtctacgcacacgtgtctactattggggccactaacaagagtgcatttttaggatgcggataatcccccacgacgctcgctttaagaagacagaacaataatattcttcgtcgtggtgatctctctcatatgcctcattgttttctctctattgtagctaccacaataatcgtgcacccccagatcgtttccccctaaaaaattttgacatcaagaaacatttatactatataaacatataacac

SEQ ID NO: 503513 - DNA, 548 bp, Homo sapiens
  misc_feature (4)..(4): n is a, c, g, or t
  misc_feature (35)..(35): n is a, c, g, or t
  misc_feature (102)..(102): n is a, c, g, or t
  misc_feature (121)..(121): n is a, c, g, or t
  misc_feature (257)..(257): n is a, c, g, or t
tccnactgctacaatctagctccaagagacagatnggaaaataagtgcacgaaccttactatgttatatgaagaaattacatgggtaaatagtgtcagcggntgggggaggaaagggaggntgggaattcacagttggttggggtgggtccctgcagaggagccgagaacgcacatatgagaacaagcagcctttctgagggaggcagagagcagcaagtgaaaaggccttgggctgtgatccacaggcagctgaanctgtggccgtcagcccacgaggagcaagtgcaggagcacagtggaagtgggcagcgtgcagccacagtctggagtcagcgctgtttccttgtgtgcaatgtctgggttctgcagtggaagcttcatgaggtcacacacctactacacccactactgtgcaccagctcctagcaagtgcctccccggaggtgctgagtagatgttcatgaacactgaatggatattatttttatgaatgagattagtttgatctccatcccctttctgtctttacgttaaccatgatctgac

SEQ ID NO: 503514 - DNA, 275 bp, Homo sapiens
caagggacagcatcaagcactgcaacaatgcagctcaaaacgcttagcctagacacacccccacgggaaacagcagtgataaacctttagcaactcaacgacaagtttaactaacgctatactacaccccacgggtttggtcaatattcgttgccagaccaccgcgtgtcacactgattaaccccaaacggttgaccctggcgaccttctgtggtgatccctctaggatgtctgacgctgcatggcgatagcaatgctatgtgcaccttgtgcct

SEQ ID NO: 503515 - DNA, 1418 bp, Homo sapiens
  misc_feature (201)..(201): n is a, c, g, or t
gtgctattctacattccagtcctcgctgatcaatgccatgaaccgatacttcgaaggccaggcggcggccccattgagtccgacactgggcgttgggctgtgtcagctaggatttgcctcatggtctctccttgttgtgcctctgtaagctccagcgggggtgccagactgctgcatgatcgggtacgggttggcagcggnggcttcgctcgatccatgggcggcatgctgatcgaatggtgcagttggtgtggccagacaactcattgctgtgcactccatggatcggctacgatcgagactcctagtcccggcggtcttctggtgtgctcctgatccgggcactcctttcgcctggcccgaccttggttagcatctcgtggagtccgttcttgtgcgcgaggaggcgggtggacttcttttgtagttctttcaatctgcccggatgggggctggtcgctacgcgttggatggagttgcctaggcgtgactcttttcctgtacactctgccacaggttgttttccagtcgcgttagacgacttacagttcacactggtaccctggggggacaggtggcccgcagaatagcccaagggccccgtccctttgctcatggtctcatccagtgcctgggggactttccatttagtttcattcctttctggcagtcggaggactgcgccccgtgggtgggagcctattccggatagggcggtgcgtggctccttgagagccaagaagagtggacgagacgcacattacctcctcaagaaacataatctccattccgtcaacttagcttttccttccctaagtggttgtactttttgcaaaccgtggttctttgcaggccggaatccgcataggctgagtggactttcggtaaccgcgtaaggtgtcatgtaacatcaaacagtgattgaggtcccgtaccaggttgggtatacatgttctcggtcaattctttacatttcagcgcgattcaatcgcttaacgggtccatttggttgtggggggtgccccccgtgcgaggtgttcagaacgcgatggtttctatgggcccattccggttgggggcctcgccctacttaaagtttccttccgatgtggccaagttgtgggaagccgttgaggtgtcatagccttgcagttgtggagttaggccgtaggttgtgcgccggcagagcatcggttcggggagtcccccaccccttttccaggaggaagggggcaaacacttcccgtgggtaaatgggatagcccaaagcgttttaaccataggttaccggttgtttcaactcccaatggcggtgcgagcccataagaggttgggtcaaaccctcacattcccgtggaattataggcttgggaagagacaaagattcctttctggatttagggagagaaggcccaaaa

SEQ ID NO: 503516 - DNA, 755 bp, Homo sapiens
gcaagaatgtgcccaaccttcatgtcgattgaaggccatgcagctctctctaagtcccgaggctgacgctgaaggaacagtttgcctgggagacgattgtctactggtaccttacgcaactggaggcgtatccgagtcatctccggtggattaccctgtcgatctgacccccggcgagattcgttgctctggccatccacgtaacagaccgataagccagtcctaggagaactagtgtcgagtgcgctcgagacgcgtaaagggtcttgggagggttgagacgatctcgtgacgaagcactgcacataggagggcgacagcgtgaccagaggagtaccgtaccagagcggagtctgcatgtgctcaccttggatgccgtaccaacgaagagccgaaggtcgtggggcttggggctcagcgaagcgcgaattttcccaggtctttacgagcgccggacattgttggtacggttgggaccgcttggcgtcaccgtcgcgagccatgcaagatcaacatcacagtctgcgtacagatggcgagtttcctcttttggggccattcaggagattataaagcttatgaactatggccccaaaacatgagaaccttttggcaaactagaagagaacgaacagcggccttactaaccactctgcacggccgggcacatcttaccacacttgcggggctcgcggggcacacaccgaaggcgcgtcacatgcacaccacttgtgcgccatcatggcgcgcacaaa

SEQ ID NO: 503517 - DNA, 286 bp, Homo sapiens
taatagcgacgcaattaacctatcaagtcggcaaactgattcaccttcagccaactccacccaagaagatgggattgcccagaacctcctcacgtccccgcttcctaaagctattgcaacctgagaaaatggcaccgcccaccctcacaccctctgattggatccccaagggccaggcaaagtataaattcgccaggtaaggaccccttaaacatttcctcctctctctgcgcaaagccagggagcagacggttccccgctgcgtgcgcaagcggtcgctaaattt

SEQ ID NO: 503518 - DNA, 483 bp, Homo sapiens
tcctccctttgggccaagcacaccagagaaaactgtgaaacctggggggtaaatggttaaccgggtcctttggtggacataaaggaactgggcatatgggagcccttggctgtgaagctgcagacttataaaacaccagtggagacggcagttttgtttctgcgaatttatgacatcgtttcgggccccaaaaaaaaaggcgattcccaaaaccggcaaggcggggctccttattctggccaggagtgagtgctaggcaagggttttttcaatgcccaaaaccaacaaagtttccccttttcttgagccaaagggccaggaaccctggggaggtttttgttcaaaagggatcaggttggggggcagccccccgtccctttttgtcccagcccagttttccaaaaaaccctgacagggaatttttttttattgtaagggttccctttagtttgcttccgatgattaaatttaagtcctttgaga

SEQ ID NO: 503519 - DNA, 324 bp, Homo sapiens
  misc_feature (93)..(93): n is a, c, g, or t
  misc_feature (270)..(270): n is a, c, g, or t
agctgagcatccaagccacttagtagcagccgtggctcgatcagtcagcaagacttgcatttattcagtaaagattaattgacaaaggttgtnagtcaacaccactagagggaaattgacattgcggacttccctaagtagaaagcaatgaagcacctgcgattacataaaaggttagtcttaggaccacatgagtaaacaagttagttaggagacattccccacattcctttgcttctactctaatttatttaactaaaggtaggggantgggtgcctttcagccgggtttttttactggaagtttttacaaacggttcaggg

SEQ ID NO: 503520 - DNA, 919 bp, Homo sapiens
ttaagcttagaaggtgacagcgcaggatctaatgttgaaggagcaggcggtagcttgtggagtctgatgattagtaataacatctttggcatagatagtagaataaaataagctgattactttatgaaatatatagctcaataggtttacgtaaaaattgttgctgtagcgctacattgtatcttaatagttaacttgtaataggtaaagcattttacaccagaggaattatgaggtacattagatagagttgaggatgagggataggaaaagtatcagaggtttctagtacatgacctgcaggtgaaaatgacaagtcttcatttatgggagcttcataatggtttctagatatgaacaaaattgtacgaatgaaagcgtatctatctagtacgacccaagaatatattaaatagccagattaggagagagggcaaaaggcatttatggaattggaaaatgaagggtgactttggacattgtttaagctgaagatctatgaaagttagtagaggtgacttggaataattctgaattgggcgaactctcatatgaaatgagattaaagaacgaagtgtgattgataacgacgcttgagaagtccagtagaccgcagaggtgaaatggcgtcttatgaaaaagcctacttaagagttgcgttatatttaacacggcaaggaactgggcgtgtgaccgattcttgtgtgagttggttaggattgtaatccagatttgtcctgaacgatcagtaaagtctggaccgtcgtactatcttggaaggatgacacagtactgccagaagggtagttaaaccctgaattgttagcaacattggtccaaatttgaaagatattctcattctttcccaaagagcctccgactgcagtttccactggggaaatcgtgcaaagggaaacca

SEQ ID NO: 503521 - DNA, 529 bp, Homo sapiens
cagatgtgaaggagtttcttgtgtcctgcgttgaatgtaagataacttaaacttgggcaccacaaatggtacttctttgccatcagatggtaatctggaaagcaaaataatcctcaggctacagccaaagctgaggcctgtacagaaaccagaagtcaaatgggagctacagagactagtagcacttttgactatctgggaactgcctctttaaaatctcctccccacagaaaagtggtgtttttctgttcacccatagaaacatcctccacagcaactctttataaattctgttgccattacattcaatttccaatatccagcaaaagacacaaacttccaatcttaatattaatctcccacgccgcaacggcgggcgccctcacaggcgccccccacagccctgagcgagctgccaggtgggagaagcgcacctgagccaagccacgccgcgcctttccccgcccgggtcccgccgccctctccgggtctccacgtcccaacgcccgctggccgcccgcgcggccgc

SEQ ID NO: 503522 - DNA, 212 bp, Homo sapiens
cgaccaccaagaagcggcacggcgcgcacatccaatgtacttcgcaactgtctgaccagtcccagatccaggagtataaggatggctttcaacatagattgaccatgaaccgtgatggctatcattgacaatggaggacctgcactgacatgctgggcctctgctgggagaagaaccccactagactgaatacctggcagggcatagataga

SEQ ID NO: 503523 - DNA, 414 bp, Homo sapiens
  misc_feature (200)..(200): n is a, c, g, or t
  misc_feature (353)..(353): n is a, c, g, or t
  misc_feature (358)..(358): n is a, c, g, or t
ttcctacattatgaagacagagtccatgtggtcagtgtcttacccggtgtagggtaaatgcacctgatagcaataacttaagcacacctttataatgaccctatatggaagatgctcctgaatgtgtgtttcgagctagaaaatccgggagtggccaatcggagattcgtttcttatctataatagacatctgagccccnggcccatcccatgaaacccaggctgtagagaggattgaggccttaagtttggggttaaatgacagttgccaggtgtcgctcattagggaaaggggttaagtgaaaatgctgtataaactgcatgatgtttgcaggcagttgtggttttcctgnccagnctgccaccaccgggccatgggggtatgttggtccagcccaacaccacaggaccatc

SEQ ID NO: 503524 - DNA, 571 bp, Homo sapiens
  misc_feature (478)..(478): n is a, c, g, or t
  misc_feature (512)..(512): n is a, c, g, or t
tggcaggctctctacctccaaagcagagggtagcatctggctggcagtagtcacatggcctccttctccggtgtccaatctctctctcgggcccccactcataaggacactggggatggcatttaggggtccacccagataatctaggataatcccctcatctcaagatccttaatttaatgacaggtgcaaagtccattaggtcatataatatgcacaggtgacaggggttataaaggggtatatggggggggccactatttagcttaccaccagggaagcaagctccaaaggtggggaagaaacacagttcagatcccgggtccacatgaaagaagtgtccgataaggagcctgggcagcgtccccaggccagggtctttcttaaacggtaagggctggctatttaaataggcagcaggccaggcaggggggctcaggacggtaatactagcacttggggaggccgaggcaagggnatcactagaggtcaggagttggagaccagccggnccaagatagtgaaatcccgtctctactaaaaatacagaaactagctgggcttgaatgag

SEQ ID NO: 503525 - DNA, 310 bp, Homo sapiens
ttcgagcttggacccgtgtgcgtgggtgtgtgtgagtacgactccactagtggacgagctggtgctgctgctccagcaggtccaggttgggggggtagttcacgaggctgcaggcatactgatacaaggaacggaagtgagaccccagcctaccagacagctgaatgggtatgcgcccgatctcctccatcttggactggatccagggccccacaacattgggcgggctgacgaactgccggcgcaggagctgcgcgctgtagcgtctgcttcgcattctccaaggatctgcggagcagctcgagacaca

SEQ ID NO: 503526 - DNA, 802 bp, Homo sapiens
  misc_feature (4)..(4): n is a, c, g, or t
  misc_feature (69)..(69): n is a, c, g, or t
  misc_feature (84)..(84): n is a, c, g, or t
  misc_feature (91)..(91): n is a, c, g, or t
  misc_feature (104)..(104): n is a, c, g, or t
  misc_feature (106)..(106): n is a, c, g, or t
  misc_feature (124)..(124): n is a, c, g, or t
  misc_feature (171)..(171): n is a, c, g, or t
  misc_feature (182)..(182): n is a, c, g, or t
  misc_feature (184)..(184): n is a, c, g, or t
  misc_feature (189)..(190): n is a, c, g, or t
  misc_feature (193)..(195): n is a, c, g, or t
  misc_feature (277)..(277): n is a, c, g, or t
  misc_feature (299)..(299): n is a, c, g, or t
  misc_feature (354)..(354): n is a, c, g, or t
  misc_feature (395)..(395): n is a, c, g, or t
  misc_feature (400)..(403): n is a, c, g, or t
  misc_feature (412)..(412): n is a, c, g, or t
  misc_feature (424)..(424): n is a, c, g, or t
  misc_feature (483)..(483): n is a, c, g, or t
  misc_feature (530)..(530): n is a, c, g, or t
  misc_feature (657)..(657): n is a, c, g, or t
  misc_feature (666)..(666): n is a, c, g, or t
  misc_feature (679)..(679): n is a, c, g, or t
  misc_feature (705)..(705): n is a, c, g, or t
  misc_feature (708)..(708): n is a, c, g, or t
  misc_feature (714)..(714): n is a, c, g, or t
  misc_feature (726)..(726): n is a, c, g, or t
  misc_feature (728)..(728): n is a, c, g, or t
  misc_feature (736)..(736): n is a, c, g, or t
  misc_feature (756)..(756): n is a, c, g, or t
tctngggacatagcacctgagcaggacacctcagtccgatgtagagtgtgaccggcaccaaggcatgtntgccctacccaagangggaganaggccctggggtnanttgtatccagcccttcangaccccaagacctgtcccccacaggggccagggctgaagcaccaatnggaggcacctnanggtannaannngaggagggaggatggggtaacagaacctaggcagcagaagcagcagacgggggtccggccccctctccaagttcagccagtncctgactgaggtcatgccccancgtcctttcccctcgaaccccacctgcactcagctgaggatcttccggggcagtncaacagcagcccggatgaagactgcatcatcccgaacatantatcnnnnaaaaatgtnctggtgggagangaacttgggataaccaaagcccagagaactctcatccagggagccccgccacgtgcctngcttctagaaaatcttccagtatgggtcggggtggaaggtctcagtnacgtgctgtggtttagccagcccagggtcgctctgatccagcagggagaaggtgacacggcgggcaaagggccactcaaggagattgtcaaaggcaccaggcagcacacgaatgtccagtgagaagngtgtgcccncaccactgccatngccattgaggaatgcagaaacctgcngcntgtgancatacttatgtntnttgaaggntgggctgaagcactcaaggntgggcttggccttaggctcctgtagccgccgtccatagctgccaat

SEQ ID NO: 503527 - DNA, 342 bp, Homo sapiens
ttttttttttgagatggagtcttgctctgtcacccaggctggagtgcagtggtgcaatctcggctcactgcagcctccgccccgctgggttccagtgactctcctgcctcagcctcctgggtagctgggattacaggtgcacaccaccacgcctggctaatttttgtatttttagtagagaaggggtttcaccatgttggccaggctggcgtcgatctcctggccttgtgagcctcccgcctcggcctcccaaagtgcagggattacaggtgtgagccaccacgcccggcctagtacatccacttcttaaaagccctcctcctggatgtgggcacagcattc

SEQ ID NO: 503528 - DNA, 588 bp, Homo sapiens
ccctagggctgtacgctctggggtttatggagtgaggcggcggcgctgttgtcctgtgggtctgccggtccgtgggtctgccctggccgcccggcccgccctgtcccccggggcggctctggctccatggccctgtggcggcggctggcggcggcggcgggtgtgagtgcgaccgtgggcctgcggtgtgcctgctgaccgtggctggcgtggaggcggctgggtgccgtggccatggggtgactgtgaacctgtccgcatgccgcctggatcctgggagccctgcccaagtcggatgcggtgtcccctgctgagccccgagcgccggcagccggatgccctgggcccactgggcgggccagtggccgcctgcgggatgagcagactgctgggggggacgctggagcgcgtctgcaaggcttgtgctccttctctgcctgctgcacttcctcgtggccgtcatcctctactttgacgtctacgcccagcacctggccttcttcagccgcttcagtgcccgaggccctgcccatgccctccacccagctgctagcagcagcagcagcagcagcaactgctcccggacca

SEQ ID NO: 503529 - DNA, 546 bp, Homo sapiens
tttagataaagtacacgaatcttaaatggggaatttgataacgagaacgtcgatccaaccgcctatagacatgtttgtttgtagcaacatttatatttatatttcttaagatcaaaatactcttgcatacttatccacactcaatcaagacagatgaccacttttgtttttactatactctaagttttagggcacatgagataccatctcacaccagttagaatggcgatcattaaaaagtcaggaaacaacaggtgctggagaggatgtggagaaataggaacacttttacactgttggtgggaccgtaaactaggtcaaccattgtggaagtcagtgtggcgattcctcagggatctaggactagaaataccatgtgacccaggtaatctcttttaatactctgctggatgcattactgaaggatttttacattgcatttcaggaacgagattgcgctgccattatcctatttcacatgatattgtctgcgttagatgcagaagcatatacgccatgaaatatctttggaaatcatatctcatt

SEQ ID NO: 503530 - DNA, 302 bp, Homo sapiens
aaagctgaggtcgcttcatcagaggtgaccacaaccagaagaaccaacaagtactaatgacgtcaataataagtctgatgttttcatcgtcaataacttcataagtaacattcttaatcaccatagaaaaataatgaacaagtaaaactcttataaaaccaatatgggaacaatcatgatcacttatagcattatcaccaccattctttaatcactacttgtcgtaattttaatcacaatcaatagttatcataatcaccaccaatagtaatcttattcactacttaccacaaccggaagaa

SEQ ID NO: 503531 - DNA, 219 bp, Homo sapiens
gttaccttgggggaatgctaacatcgctactccctcaacagggaatcaagggctgagtagtggcttgtgcgggccgtttgagggcaattacgaagtctcaaggcggattttagcccacagtgtctaagcatagatgccctttgtccttttgccatgcccaaggtggcaaaggcctttaatccacaaaatgggaacttcgttggcgtgtgcccccttgcc

SEQ ID NO: 503532 - DNA, 522 bp, Homo sapiens
  misc_feature (45)..(45): n is a, c, g, or t
ttaaaccctctgccctttgaaagtagatcatgttcactgcaatgntggacactacaggtatctggtccctgggccagcagggacctctgaaaccttctttgtggccttttttttttttcatcctgtggtttttctaatggactttcaggaattttgtaatctcataactttccaagctcccccccttcctaaatcttaagaactttaattgacagtttcaattgaaggggctgtttgtagacttaacccccagtgaaagcccagccctcatgacaaatccttgaatgtttttttaaaaaaatgatgctggtcatcgcagcttcagcatctcctgttttttaaagcttggctccctctgctgatttcagttttctgggttttcctccctcagccccttttcacccctttgctgtcctgggtagtgatttggtgaaaaatcgttgctgcccccttcccccagccccatttatgagtttcaagttttattattgcaataaaagggctttatgccggcttttttca

SEQ ID NO: 503533 - DNA, 1186 bp, Homo sapiens
ggataaaaccatagccccgaaacccacatccaccttactaccatgacaaccttagccaaaccatttacccgaaataaagtataggcgatcagcacactttgaaacctggcgcaatagatatagtaccgcgaaggggacaagcatgaacacaattataaccaagcaatactatagcaaaggcactaaccccttataccattctgctatacatgcacatcacactagaaacatacactttgcacaggcagaagccacaagcttaagaaccgccctgaaacccagacgagcttacctaatgaacagcttaaagaggagccacacccgtactcatgtagcaacactagtggggacagcacttcatacggtagaggcgcacaaaccttaccgagaccttgtgttgaatagctgagttgtccaagatagaatctaacagttcaacctttaaaatttgcccacagaagcctctaaatcccctttgtacacattcaccttgtaaggctccacatggtcaggcaaccaggctcattgtgggacaactaagggaccataaccctttgtcagacgcacgagtacaaacaatttaaacaaccccatacgctacggccttacaacggcgagaccacccaatttcagcgacaatgcgtccaatgctccaaaaccccaataccctaaaaaattccaaaagcattataacttgaaacgtcctcacaaccacaaatagggacaaatctatcaacccgtatacgaacgacactacatgtcagtataaaagtaccctgcaacaccattcctcctaccggcaaaacgccagaggatagcactgacacgacccactggcagctgtgaacaattaacggggcacagataattcaacgatatatagccaacagggacattatatacgcctacacgtggttaacccaaagtgcgaacactgtgtcctaaggaacaggtttatacacacatgtaacaagggtgcctggcgaacttatcacccgcagctgttaccaaaaagagacttgcgtcttggccacaccggttaaggacaccacgcatcacgtgccacttataaaggcgacgcgaaccaaaccggcactggctcatcactcacgtgtcgcaacgagcgcagtagatggccacgcggcacagtcttacctcaacacagatactgcgcgaagggtggcaa

SEQ ID NO: 503534 - DNA, 729 bp, Homo sapiens
agagaaaaacaggatcatcatcagaaggatctgcatggaagacacccagcaagcccatgaggatgggcatgagagcaagcatgcatgccatcatcctcaaccatcatactgttcccgactcaaaggctgacatacaccagaccacactgacgagagccatggtctcgggccatgatccgacctcttcaatgactccagacccatgatggttcatggaggagagcatgggatgccctaaatgccatcacataagaagctggatgcatggacaacacagattggcactcattgaagagactgcacaaggaaatccggctcatagaggaacgagagcaaaggcgagcatgtgccagagattactagactacccgaagaagggagtgacctccataccttccagagttgcagggaaggagtcctgactggacagaccctgagcagaaggaggaggcagaccaaagacctataggcttggtaatccgcctgacctcgagctgacgccactgaggaccctccgatggctcagccatcacatggcccatctgatcctgatcctgtggggaaccaggttcagctggactgtgaccggcggctctgctcggagacactcagactcttgtaggctaaggtgggattgccctgaaagcccttcctgcccaagcttgcagacactttcacccaagcctgaggaatacaccgggtggtgcgctgaaggcgcactgctctggg

SEQ ID NO: 503535 - DNA, 605 bp, Homo sapiens
ccgagagctgactgagatcctgtatcggtgtatctgagtcacgatcgtgatagctgggattacaggacgtcgaaacatgcccagctagtatgctgtataaaagtagagataggggtattgtaccatgtgaggcaggctggtctcaaacatctgaccttgtgatccacccgccttggcctccgaaagtgctgagattataggtgtgagccctgtgcctggcctgaattcttataagttctaagtctatgttctttattgggttggtgcactatggttctttctaaaagatcctcttctattccaaggttatgaggatgtccttttatgatttctcttagaagacttcacttgaaatatagtgtttcatctgacataaatttttgcgtataacttcaggtaggtgttgatgtatagttttctttcctatgtggatatccagcagttctaagaccattgtttgaaaaatattctttctctattgaatcgccttagtgttaggtcagaaagcagctgagcttatatgtgtacctccttctcttctatcgatgtctttccctggatatactcaagaaaacactatcgtaatcactgtaacttcatagtaa

SEQ ID NO: 503536 - DNA, 264 bp, Homo sapiens
  misc_feature (52)..(52): n is a, c, g, or t
  misc_feature (117)..(117): n is a, c, g, or t
  misc_feature (191)..(191): n is a, c, g, or t
  misc_feature (202)..(202): n is a, c, g, or t
gagaaggagccttgccagtttgatgaaaagtgtcctcagcatcatgcctggnctgagtgggagggaaaccccactcatctgtcctgtatgtacaaagtacaacctgagaatcacaancggtgtggtggtgtgtcagtgtggcctgtccatcccatctcatgcctgtgatacttgggctgtgagcctctagngccagcttggnctcacatcattctatggggttgaaggcaactcattccctctgaggagccttgtacatacaag

SEQ ID NO: 503537 - DNA, 152 bp, Homo sapiens
ggtgtggtgatctagaggatccctaaatctccatgatagctgagctccacggagtaggacatgttgtcgttggtctgtgtgtctccgagagaagaggtcctcgcagagctgtgggatgatgccctgctggtccttctcctgcttgcccatca

SEQ ID NO: 503538 - DNA, 420 bp, Homo sapiens
atcccgggactcagtgattgtcctacctcagcctcttgattgagttgagaccacacggctgcgccagctaattattttgtattttctgtagagatagggttttgccatgttggacaggctggtcttgaattcctaggttcaagggatccacctgcctccacctcccaaagttctgggattacaggtgtgagccacggtgccttacagggtctcgctctgtcacccaggctggagtgctgagtgaagtggtgcgatcttggttcactgcaacctccgcccctctaggctgacgccatcctcccacctcagcctcccaagtagctgggaccacgcctgcctttataataataataaaaggaataaaaaaaaaaagataggaatctaacaatgtagaccaaaggatgatctaaaaatcctgga

SEQ ID NO: 503539 - DNA, 157 bp, Homo sapiens
gcgacctttggccctggccatctttgcactaactcatttgaattatgaaggtggcagtcttggtcagtagtttaaaaagtttccctactttttaaccctttttgaaataaaccttttacaggtagaagatttctattaataaaattatttaagttca

SEQ ID NO: 503540 - DNA, 328 bp, Homo sapiens
tctaacacaggtcaggtctcttacatgcatcgagtacgtgtatccagacacggacaaatcacgaggcttatcaggcggcaagtaccaagaacatgaactcatcatatcttctctcctaaacctgggatgataggcagaaagggcatccatacaactttttcttctgcattcggcatagaaaacatggacttccctgtagtctgtagtcacaaatcattggtaaagtagccaataaatccgtagccacttagtggcaggccacaggcaggtcagcatcgccatgagcccaaggacttcaagcactatcctgggcaacacattatggcag

SEQ ID NO: 503541 - DNA, 198 bp, Homo sapiens
ttgtttgtaactcttggcttttttatcacattacaaagtttttcgtcacactgcagggttgaaaccagaagttagttgcttagagaacataaggtcttgcgcaagaggaggcctcgctcttctgttccttctcggcaccaccctggatcttttggggctctccatgttcgcgcacgcctcacctggctatcagcttac

SEQ ID NO: 503542 - DNA, 651 bp, Homo sapiens
cctccacctcctgggttcaagtgatcctctcacctcagcctcccaagtagctgggactacaggtgtgcaccaccacaccccgttaatttttgaattttttgtggtttcaccacgttggccaggatagtctccatctcttgaccttgtgatctgctcgcctcggcctcccagagtgttgggattacaggtgtgagccaccatgcccggccccaacatgtgcttcttgctatgtctatgtttattttttcacctttgcttacttcttactactttcttcctcctacctctccctttacttcttcccccctatatctttcctccctctcttctctttaatccctttcccttcttcaccccaccgcttcttttcacttaattctgctttacctcctcacttcttcttccctcctctatttcttcattcttatcccctcttatctccaccttctctcctcctctctattcctctcctcctctgttcttctcctcatcctcttccttctctctcccccatcatctttctcaatctctttccttcctttctttccattctctacttgctcctctactactcttctactctcttctatcttctcccttttccctacccttatccacttctcccctttccgcttctccttctctttgtcg

SEQ ID NO: 503543 - DNA, 1293 bp, Homo sapiens
  misc_feature (176)..(176): n is a, c, g, or t
  misc_feature (179)..(179): n is a, c, g, or t
  misc_feature (200)..(202): n is a, c, g, or t
  misc_feature (227)..(227): n is a, c, g, or t
  misc_feature (238)..(238): n is a, c, g, or t
  misc_feature (259)..(259): n is a, c, g, or t
  misc_feature (262)..(262): n is a, c, g, or t
  misc_feature (343)..(343): n is a, c, g, or t
  misc_feature (539)..(539): n is a, c, g, or t
  misc_feature (634)..(634): n is a, c, g, or t
  misc_feature (701)..(701): n is a, c, g, or t
  misc_feature (721)..(721): n is a, c, g, or t
  misc_feature (726)..(727): n is a, c, g, or t
  misc_feature (808)..(808): n is a, c, g, or t
  misc_feature (832)..(832): n is a, c, g, or t
  misc_feature (889)..(889): n is a, c, g, or t
taaagaattacagagaacctagcacctctgttacagtgaaatgccccaactaaatactaccgtatggcccaccataattacccccatactccttacactattcctcatcacccaactaaaaatattaaacacaaactaccacctacctccctcaccaaagcccataaaaataaaanatnataacaaaccctgagaaccannntgaacgaaaatctgttcgcttcatncattgcccccncaatcctaggcctacccgccncantactgatcattctatttccccctctattgatccccacctccaaatatctcatcaacaaccgactaatcaccacccaacaangactaatcaaactaatctcaaaacaaatgatagccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagngatataggctttcgctctaagataaaaaatgccctagcccacttcttaccacagggcacacctacaccccttaatcccatactacgttatatcgnaaccatcagcctactcatcaaccaatagccctggccgacgcctaaccgctaacatactggaggccanctactcatgcacctaatggnaagcnngcacctagccatatcgaccattaccttccttctacactaatcatctcacacatctaaatctaactgctatcctagaaatcngctgcgctttaatccaagcctacngttttacaccttctaggtaagccttaacttgaccgacaccacgtaaaaaaacaaaanacacaaacccgaattgggtaactgggcaattgcctaaaggggcgatacaataatggccgggtttaaacggggatgggaaacactgggtaccaattatagcttgagaaaaccctttgccctggggaaacgcaagagcccccgagcgcttccaagtggccccgatggcaaggaattgcgcgaatttggaaaccggcaaattgtgaaagcctttatcaagggcgatggaaaactttatataaaaacccccaggggggggtccttgaaaagccttttaaagggccctcaggggaaacttttgggggcccctggacactccaaaatttgggggcgcacaatatagccagggcctcttattgtgggcgcccctccggaaggcttctttgggggagggtccccccctttcg

SEQ ID NO: 503544 - DNA, 199 bp, Homo sapiens
gagagagagagagatagagagatacattctttttttttccccgttctggttatttatatgctacttaatcccacatctccacttcttctatattttcaatctccatccttctcttctattctctttcctttatctctctactctctctcttctctatttcacctcctattcctctatttcttcctgacttttctctttt

SEQ ID NO: 503545 - DNA, 810 bp, Homo sapiens
  misc_feature (176)..(176): n is a, c, g, or t
  misc_feature (179)..(179): n is a, c, g, or t
  misc_feature (200)..(202): n is a, c, g, or t
  misc_feature (227)..(227): n is a, c, g, or t
  misc_feature (238)..(238): n is a, c, g, or t
  misc_feature (259)..(259): n is a, c, g, or t
  misc_feature (262)..(262): n is a, c, g, or t
  misc_feature (343)..(343): n is a, c, g, or t
  misc_feature (539)..(539): n is a, c, g, or t
  misc_feature (810)..(810): n is a, c, g, or t
taaagaattacagagaacctagcacctctgttacagtgaaatgccccaactaaatactaccgtatggcccaccataattacccccatactccttacactattcctcatcacccaactaaaaatattaaacacaaactaccacctacctccctcaccaaagcccataaaaataaaanatnataacaaaccctgagaaccannntgaacgaaaatctgttcgcttcatncattgcccccncaatcctaggcctacccgccncantactgatcattctatttccccctctattgatccccacctccaaatatctcatcaacaaccgactaatcaccacccaacaangactaatcaaactaatctcaaaacaaatgatagccatacacaacactaaaggacgaacctgatctcttatactagtatccttaatcatttttattgccacaactaacctcctcggactcctgcctcactcatttacaccaaccacccaactatctataaacctagccatggccatccccttatgagcgggcgcagngatataggctttcgctctaacgattgacaaatggcccccagactaacatactaacgtatggggccacgcataattacccccatactccttacactattgcctgcatcgacccaaactgaaagctattagagcacgaactgacacctatctccctcagcaaagccgttaggaatccagggaaaaggccgaggcacaaatatccgcggcgaaaaaaaccctttatgggcttggtttggatcctgcgccgtttgttcaagggtaaatgccggcn

SEQ ID NO: 503546 - DNA, 1089 bp, Homo sapiens
cccaaatggtgcgagatgatggtcgcgtggtgcttgttcgtgtctgacgtgtgcatcttctgggccgtctgctgggtcagcgtggctaacacacgtgacctgctggagcctacaagcgtggtgcggcatactctgggaacaggctctgtatttgtgtcaatattctatggaaataagtagagaatacctgtttatcttcctgcaattggaatccaacaaccaaggccttatacccgaaaagccccttaccagatgtcccgtaccacattccggatcctccatggcggatcctgtcgtgaagggatggtgcgccgagtataatcggaacgcagaagagacacgagacgggatcgtgggagcggtggttcaatggaagctgtgatcagagggtgctcagcgggctacgaaacgaccactagcaggaatgagtaggtgccgtgtggtcgctccacctgtcgtgctctatggatcggtttagaataaagtctgcctaaactgtgggcgcttatgcggtgcaggacgcgtggcgtcagcggaggtaccgacgggaaagatccccggacgacccgtgcaggacgacgcatggaaggagaagacgcgaaagaatgaaataccaggatccaaagaaccggaatcgatgaggctgcgcgatgacgggtacgagaaaaacggtcggagaaagaacgttgacaaatacaactgaggtccttcaaagacgtcggcatcatgcccggagcctggtacagagtcgatacgacagggatgcctgctgtgtcgcccagtgctgcctgaaagtgtgcgcgtgaccaggagggaccaggtcagtgcacagcaagcgcggaaaatacgaggtagtaccgaggcagggctaggagggctccggagtgctcaaaatcgggaaacggcgggactggacgtgaccatgagacaccgaacacaacggaggaacgcaaaggcacaaacccttgggcaggagagggggcacggcaacgggacaagggaaaggcagagcgcaaggtaacacaagagaaacgagacaccgagccgcgcttgtagaaaaaaagcgcgcccagtctaacggacgcaaaa

SEQ ID NO: 503547 - DNA, 237 bp, Homo sapiens
tgctgagacaacgaaagcctaggggaactttaggctagatatcatatattcacacgagtgaaggctacgtactctggtggtacactgggaatgtcctcagccattcagcaccatgcggacgagctccgccccatgggcccgtcacccccacaggatatgcctcacaatcgcttcctcgttgatactaccgttgctgtcctcatgccctgcccaccagcagctcgtctcttctcttgt

SEQ ID NO: 503548 - DNA, 182 bp, Homo sapiens
accgaggtgctcaagagtgtggtggccaagttcaatgcctcacagctgatcacccagcgggcccaggtatccctgttgatccgccgggagctgacagagagggccagggacttcagcctcatcctgggatgatgtggcctcacagagctgagctttagccgagagtcccggctgctgtagac

SEQ ID NO: 503549 - DNA, 154 bp, Homo sapiens
tcgtaggagggtgtcctgacggagggttggggtgaggaggactgtcagcttcgtgggatcttgctggagatcatcctcttcccgtttggattcattggctgtatggccttgaggaagcgacgatgccccaatttgtggagccagcttctgttaa

SEQ ID NO: 503550 - DNA, 392 bp, Homo sapiens
agcgagagagagagagagagagagagagatatggaaagaaactgatacgtagatttagggaattgtactcacatctgcttatctatagatcatcgtattgtcttgaatatggtcttgcattgcctcagacataaatgagcatattctgatgtactctttggatctgaactcatctccacaggttggactcactgcggggtctctatcttatttgggagcgttgattgctttggactgaccttcctcaggttcgcatgtagttgattgaggcagctaactgggcagatggagtccagcgttcaacgacagacgaatggcaggcaggcaacatcctctgtacgtcatattagattataccagccgtgaggtcagtccggcatgccttcggagct

SEQ ID NO: 503551 - DNA, 121 bp, Homo sapiens
gtttaccggtgggcttgcctggtgtgcacactggcgcccaataagagatagagaaagacaaacctgtccgttttgtagatagacaggaaggagccatggacgcagctcaccttgtctcacg

SEQ ID NO: 503552 - DNA, 176 bp, Homo sapiens
tggatcggggccctgttgaattaagatttaatgggattgctctttttgcaccagtaggttgtcattattggaaacaccaaaaactgtattatttgcaactaaagttttgctgccatacactaactcaaaaattttggtgttttcgttgacgtgatgattaaactttatgtgggtta

SEQ ID NO: 503553 - DNA, 399 bp, Homo sapiens
gaggtcgactctacggatcctaattctgcaccacagcaattctgcaccacagctcctacgtagctgacgcagcatgtgcactatgtctggctatttttttattttacagagacaggtcttgccatgttgccaggctggtcttgaaatcctaaacttaagtaatcctcctggcttcacctccccaagtactggggattacaggtgtgagccaccgtgccagcccttaaacatttttttaacagaaacagagactcactatgttgcccaggctggtgttgaactcctggcctcaagagatcctcctgcctaagcctcccaacatactgggattacagatgtgagccaccgtgccccgccatggatctgcttttaatgcctggttttagagcctcttagctg

SEQ ID NO: 503554 - DNA, 184 bp, Homo sapiens
tcagcagacgcagctgagttaaagacagaagatctaaagtggccaggtgtggtgtcctgcgcctataatcccagctactcaggaggctgaagccaggagttcaagaccagtgtaggcaacatagtgaggaacaccccccaatctctaaaaaataataaaatgatgagctgcgtctgctgaggag

SEQ ID NO: 503555 - DNA, 141 bp, Homo sapiens
  misc_feature (114)..(114): n is a, c, g, or t
cctccaaaaccgtgaaccacccactgcctgtcgggctggttggcatccagtcccacctcgaggggcaaggaccatatacctttgtagtcttagacacaggccaagaggcaccancccaattgataccagggtaaacagttg

SEQ ID NO: 503556 - DNA, 261 bp, Homo sapiens
ctccccgcttacctgaaaggaaagattctattctttggttgaggacacagacacttacaacatctggggaactcaaaaccttgaatgtctgtcatacgactctcgacaatctcacaccttacctattcccaaggaaccccagcgggcaacttacattgctccaaaataccctcctgatgtatcttgagatataaaagaaaggccctccacctctggctgtttcttgcctctaatcagaagaacactcctgttcataaacgt

SEQ ID NO: 503557 - DNA, 334 bp, Homo sapiens
  misc_feature (2)..(2): n is a, c, g, or t
  misc_feature (63)..(63): n is a, c, g, or t
  misc_feature (245)..(245): n is a, c, g, or t
cncctttctcacactggccggcacgggtgactggactccattgatggtgaagactatgtcggncaggctgctgatggcggagctgctgaccaccatgtcgccatctgagttctcgctggctccgatgtcgctctggatgttggcaatggggctggttggtccggtcagcagagaggcgcctgtgtcaacaatggcctggcagccctcagcgcagccgatggcctctccgttcatggtgatgctgnccacggtgatctgccagtaaccctcgacggtaacaggcacccagttcagacttccagtgtggagagaggcagtgtaccagtgtggagag

SEQ ID NO: 503558 - DNA, 282 bp, Homo sapiens
tcatgggccctgggggacccccagggcaaggcccatgggaaggaaaggaccaagggcatccttgggccaactgtcccccttttttgtcccctattctctcctttccccttttgttttcaaaaggctccctcctaggatggatcggggggtaggacaactgcagtcccatcccccagctctccccgcccctgtgttttttttcaaacatgagaaaaactggccagggtaaacttataaagcgtttttaatggttgtagattggaaaaaaagtatgtcctatta

SEQ ID NO: 503559 - DNA, 242 bp, Homo sapiens
ccactgcactccagcctgggggacagagggagactccatctcaaaaaaaaaaaaaaaggacacaataatattactgttataaagattaaattaatgtttttagaatacgtagtacagtgcctggaaattagtgctatataatattttttatttcaataaaattagcagaaattatgtggaatgagagaaaagtcttgaatgacatcaaggtttctgggttttttgatagatgatgctgccat

SEQ ID NO: 503560 - DNA, 205 bp, Homo sapiens
agccggaccattcaggcaggacgaggtactgggggcggggcgcattcgagagcccaggggagctctgaggctgaggccagctggtgctcccgagctgggagagggcagcctgggcattcagagcgggattatctttatccacgtctgagtcgagttcctgacaaggccacgcagtagattttccgctgttggtctgggaggaaga

SEQ ID NO: 503561 - DNA, 580 bp, Homo sapiens
attacagacaccaaaaaggtacagaggctaagtaacctgccagtgaagtggtagggacaggattcgtcgtgcgtgtctagtgttcttgatgagcacatgctgctactcttcaaatggaaaaaaaaaattcactatcacccagaaggcgatcatacgatgatgaattttgactttgctttttatttctaatccttcatcataaaagacacacttcctttgcagtttcatattctggggctaaaccatagctcaggaactttttcatttagaaaaaagaaaaaaaataggtcccagttatcatctagtagttataagagatagggaaggcattaaactacattattcctataatccttacaagagaatttcaggttcagagaagagactatcaaaatgataaacaatagtgaagtggtaattcagaaaagttcaggtttaagtttcatcttaatcttaatctcatggagggacatatattaaaagtaagaacactgacaaagtgagagataacgtaaactggtactcatcgtagggcttgtagataaaaaccaggtttcttaaaaccttgtgagtatctttt

SEQ ID NO: 503562 - DNA, 264 bp, Homo sapiens
ctgtgggacttgggattacaggagcccgccatcacacccggctaatttttgtatttttagtagagacggggtttcatcactgtggccaggctgatcttgaactcctgacctcaggtgatcggcctgcctcggcctcccaaagtgttggagttacaggcgtgcgctacggcccctgcccctcccccccgccttttttttttcacgattcttattttggtgtgcaaattctaccattttcttagaatggcttgaagatttggaggc

SEQ ID NO: 503563 - DNA, 144 bp, Homo sapiens
gtaatagacgaaaatgtggactaagccattgcgagggatatcggaataagctgacaacactatactaaaaatatagtagagagcatatagagagagcaccgttgacatcatatacgttcctcgccgtggctagtaacataagat

SEQ ID NO: 503564 - DNA, 444 bp, Homo sapiens
  misc_feature (161)..(161): n is a, c, g, or t
  misc_feature (193)..(193): n is a, c, g, or t
  misc_feature (269)..(269): n is a, c, g, or t
  misc_feature (443)..(443): n is a, c, g, or t
tcaaaaataaatcccccccaaattccacaaaaccccaaaacccaatgtgaaattggtacctcagggatggcaaatgtagcccccagtgaagcatttgcccccacttgtttgggtattattgaagcacaattagaaaaatgtgcaatgtatgccccaaaaantctataataagggcccaggcgcggtggctcanacctgtaatctcagcattttgggaggccaaggtgggcaaatcatgaggtcaggagatcgagaccatcctagctaanaccatgaaacccagtctttactaaaaatacaaaaaattggcccagacgtggtggcgggatcctgtagtcccagctactcgggaggctgaggcaggagaatggcatgaacccaggaggcagagtttgcactgagcctactctccagcctgaacgacagagcgagaccccctcccna

SEQ ID NO: 503565 - DNA, 123 bp, Homo sapiens
gccccaggatgcttctcagcatactcaaaatttttacctggaattaggagggatgggaggagggggtggggcttacttgttgtagcgcattttatttttttaccagagcttcacagaaaatgc

SEQ ID NO: 503566 - DNA, 129 bp, Homo sapiens
ttagaaagaaaaatttttttttatttttaaaaattggaccatttagggggggggggctttcttcctaaaccccaaataaatttaaccatttcaaaggccttctattgggtttagaagttgattccccgg

SEQ ID NO: 503567 - DNA, 473 bp, Homo sapiens
  misc_feature (73)..(74): n is a, c, g, or t
gcagtcacagtcttggctgaactgagccctttcctcccagtgtttggcttggatgctagaccaggtcctgggnnaaacctcactcctggggaagctcctgcgtgctacccctgtcagctgggagacagctctgccgcatttttttcagctcctccattgctctgctgattcacagcctccagcttccagaacctttcccctgtcgggacagtagtccaactccgttttcacatgcttgtcctatttgctcgttgggttccaggaggctctctccgtcccctggctctgtgtatggcccatcgtccttaccacactgtcctgcaagtgctcgttaactcacctggcttctccactgccctctctgttccctcaatgaaggaaccctgggatcttgctcgcccctagtatctggcacatagtatacccccaggaagtatttattgtgaaaatcaataaattacttgaattgaaaa

SEQ ID NO: 503568 - DNA, 556 bp, Homo sapiens
  misc_feature (73)..(73): n is a, c, g, or t
gagaacccatgcggggaacttgcatccgccaacctgtctccaactctgtgttggggagagtggagacagactncgcgagcagccaaggtgttggagcagctcacagggcagacccctgtgttttcccaagctagataccctgtcagatcccttggcatccggagaaattaaaaaatttctgtcccctgcccagttcgaggggcccaggccaaaaaaatcttggagaagggtcttaaggtgcgggagtattagttaagaaaaaccaacttttcagatactggaaactttggttttgggatccaggaacccaccgttttggggtttcaaaatttgacccaagccttgggattttcggcctgggcttttatgtggggctgggtaggcccggtttcagcctcgcagacaaaaagggcagggcagggtgccttgggggccaacccagaatcagcaaaaaggaggccctgcgctgggttcagcaaaagtatgatggggtcatccttcctggcaaataaatttccgtttttatcccaaaaagccataaaaagttttcagtgga

SEQ ID NO: 503569 - DNA, 143 bp, Homo sapiens
tggtacctgaattcggctctctgggtgccactgctgtctagtgatgcagaatgcaaagccctcccgccacattgctccctgctgctcctccgaaggccaggctggcccccgtgctgggctctttgctctggtcacaccccgtg

SEQ ID NO: 503570 - DNA, 410 bp, Homo sapiens
  misc_feature (13)..(13): n is a, c, g, or t
  misc_feature (33)..(33): n is a, c, g, or t
  misc_feature (40)..(40): n is a, c, g, or t
tttgccctggccncttccggcttatgtttggtncagatcnacagacccaattttccggtcgatgatcatagacaggctgcagttcggttatgccgaagagtatttggtctagtgccctagttttcctattgtcaggtggaaatttctgggtaaggaaaatgactctagtcacaagtgcaagttgtgtggtacataggagcatctctttaagttctcttttaaaaaaacgagacatctgattacatcgaatgttatttccttctctttacactattatttttaaagttaaagcactggtctgaaaggaagctgggaatatttccctatattcatagaataaagccaattttgaattactttaatttagaaagtaacaacgtatgtgccacagacatttttggagggtgggc

SEQ ID NO: 503571 - DNA, 234 bp, Homo sapiens
tctgggagagacggaattatgtcccaaggaacaagatgctgcttgaccttccacacagacttctccaacgaggagaaggggaccatcatggtctacaatgggcttcctggcctactaccaaggctgtggacctgtgatgattgtgcttcccgggagcaaagtaaggggagtgaggatcccacagccccatgtgccaggcaccttggtgtcacaatttacggttgggatggctac

SEQ ID NO: 503572 - DNA, 103 bp, Homo sapiens
agcttgtacctcgatagggcacacacagtagtaggtgtatcgggaatgggtggaaagatggaattaggcctgggacacaccccgtcccacccgtacgggtgta

SEQ ID NO: 503573 - DNA, 359 bp, Homo sapiens
  misc_feature (35)..(35): n is a, c, g, or t
  misc_feature (52)..(52): n is a, c, g, or t
  misc_feature (55)..(55): n is a, c, g, or t
  misc_feature (247)..(247): n is a, c, g, or t
  misc_feature (249)..(250): n is a, c, g, or t
  misc_feature (349)..(349): n is a, c, g, or t
agcatcgaagttttaatgggccgtgccattccgcnggagcgacacagccccnacnacctcaaagagcagcaccacatccgcgggtccatcacacaagggatccctcggtcctacgtggaggcacaggaggactacctgcgtcgggaggccaagctcctaaagcgggagggcacgcctccgcccccaccgcctcacgggacctgaccgaggcctacaagacgcagccctgggccccctgaagctgaangnncgccatgaggcctggtggccacggtgaaggaggcgggccgctccatccatgagatcccgcgcgaggagctgcgcacacgcccgagctgcccactggccncgcggccgca

SEQ ID NO: 503574 - DNA, 149 bp, Homo sapiens
  misc_feature (128)..(128): n is a, c, g, or t
ggagaaccctgttgacattacactcccatcagaggagtgcacaaccatgtatatgacaggtggcctgcagttgcgaggaagaggaacttccttcatgaatggcagttcccagaaagacttttcatagntcaactacgtcagaccgggta

SEQ ID NO: 503575 - DNA, 284 bp, Homo sapiens
tgttgctgtcagtgagtcctcagctcaccccatttgaccctcacaacccttccttcttggcccatatagcaactgctcccacaaaaaagttcagaacattgagcctcagtaccagtgactcaacgtttgtgggatcaggaactagttcctggtcccccgatgtggagaaaggacatggtatttcccctcccaagaataacaccatgatccctccagcctcagtctgcagctcttcctgtgtccaagtctacctcctctgcccggacaaaatgttatgggaatcc

SEQ ID NO: 503576 - DNA, 1060 bp, Homo sapiens
agcgtggcgccgcccgcgccccactcgactccggaggctcccgcagccccggcgtccgcccgatgcccctccccgggggccatgggggcgcccgggactaccggacctcagcttgaggtgcaatctacatccaccagctgccaccgcgacgacagttccagaatccgcccggtgcaccagcgataaacgcgccccaagagcaggaagtaccagcaggccatagatagatggatggaggactgagcgaggacctggagcatgagaggcctgacgaccatcagttatacagtcggcatgtactaaccatcaatccgcatatacatgacatgactgacgagaccacccacagacgaccaccaccagggatacacaagaatcacacactaccgacccccgagggagcaaggcctgcagtacacgcctgagcatgcctaagcactatgctacggaagcacatatactcagtcacagagacatgaaacagataggacaatatgagcagtacagagatatgacatattgagccaaacaaggtagaggaagcacgatgaatgtgaggatgatcaccaacgcgtcgaggacagtcatggacgcatagaatggcaacagcacaaaagacaaaaaaaacatcaaagaaaccaagtgtgaagcaacccatgagctggatctgcgcaccgaccagggcagcgaagaagcgacatgaggccgcagcgcagagaagacacgaccagcaagcacgtgcaaacaacccccatgcgcagcgcaacggtcgcctccgaagacccagacaccacagagaacgcaaagggagggcaattcgcacatgccagcagaaagagagcagcatatgaacgaaacaacaagcacagaaccagatagaagaggaccacaataagaaaacccacgcaaagacgacaatcggagcacatcaccatcacgaacaaagcagaaccgtccacaccacgtcgacaccccaccaataaaaaaaagactaggcgacacaacaaaaaaggagacaccaaatagaaaaacaagaaataacaacaagttgggcatagag

SEQ ID NO: 503577 - DNA, 953 bp, Homo sapiens
  misc_feature (768)..(768): n is a, c, g, or t
  misc_feature (903)..(903): n is a, c, g, or t
ggcagacgttcttcgcctgagagtcgtctggggtttcctgcttcaacagatgctatggacgtgaacccaggcgctcgttcccccacccctggaccgggcctgcccatagccagcacctcctgtcacctcttacaccgcacccatcggaactagccccaaatggcccccgactgaccgttccaagcgccctgcgcaagacacaaccgcacggccgaccgccggccatactcactataagtcggccgcctattgaacagaccggaggtccaaccttcagctaggatgccgcaaaggaaattacacaccgagagacctcagaagggccagggcattcaacaccggccagaattcacaccctgggagcttcataagggcacatccataacggtttaaccgtggtccaacggttctataacttaaaattttggacccggccgaattgcagggcatcggctttgagaaaggaaaatttttggcccaaaaattaaccttttctcttcacccaaaattacttcattgaagggcagacagggtgcaacatttgccttgaagcacacacgtggattgcaagggtggcacagaacccaaaccgcagggttggcctggattcctttacctttccaggcattattccaagacaaacccagaacttgtggatgaccctggcgagaagccgggcttggaaattgccaacggggcagttgtggcccttaaccctttggggacaacacagatggttgcactcaggtcactaagtgggactttgcncaaacgtggccagtggaaaataattgacccccatttgtgttgactccatggcgaacattcactgaatgagccggtaacagcactccaacacatgggttgactctgaccacatggcgcaactagggagccgacatntgtggggcatatcattaaaccaccctgtgaaggaaacagcacacggtaaa

SEQ ID NO: 503578 - DNA, 566 bp, Homo sapiens
agtgagaaagatcttgccatcgattttaatgaaccgctgcatgcaaatcttctttacttcagtctcctgtcaggacatacttaagtatgccccgtcacgggaacagtgcttaggtgtggcactgtcgcacagactgaggtgtgccggctgtcatggaccgagccatggctcgccggtccacgtaatcgatcgcagtcctgacgagcggctggcggacgtcctcgcacaggccgtctgtttcttgcatgcgattctattgtggaccgcgtggtgtctactgcgtctgtcgggtccatcacaacggcggcaacccgccgtcacaggtttgatcaacgcatgcagtgctcactcacctatcaactgctagttgtaccctagttacgaggaggcaagtaacctattaaaaggtagttaggccccctgtgacacaggggaggaattgaacgagttacaaagcacagaataagagaaattacagacggggacgacatacaaaagtcgagatagaaagatcccgaaagtaagttaataggccaaccacaggactcggatacaaggaagttgca

SEQ ID NO: 503579 - DNA, 1234 bp, Homo sapiens
  misc_feature (362)..(363): n is a, c, g, or t
  misc_feature (492)..(492): n is a, c, g, or t
cgcggtggctcacgcctgtaatcccagcactttgagaggccgggtggatcacgaggtcaggagatcgagaccacggcgaaaccccgtctctactaaaaaaaaatacaaaaaattagcccggcgcggtggcgggcgcctatagtcctagctactcgggaggctgaggcagaagaatggcgtgaacccgggaggcggagcttgcagtgagccgagatcgcgccactgcactccagcctgggcgacaagagcgagactccgtctcaaaaaaaaaaaaaaaaacaaaaacctagctgggcgtggtggcacgtgcctgtggtcccagctactctggaggcagaggcatgagaatcgcttgaacccgnnaggtggagtttgcagtaagccgagatggcaccactgcattccagcctgggtgacagagccagactgtctccaaaagaaaaaaaaaaaggccggacgcggcggctcacgcctgtaatcccaacactttgngaggctgaggcagccggatcacgaggtcaggagatcgagaccaacctggctaacacggtgaagccccggctctactaaaaaatcaaaaaattagcccggcgtggtggcggccgcctgaagcttagctactcggaggctgaagcaggagaatcgtttgaacccgcaggttgaggtgcaagtagccgagatcgttcactggactcaacctggcgaagaacgggattagcttggatttatctggggccgaattcggctaattggcaattgcccttatgggggggatttcaataatgggcgcggttacaacggcggaatggaaacccctgggtcccacttaaagggctgggaaaatacccttttgccagtgggccaaaagaaagagccccaccgtaggctttccacaggtggcccctctagcgaaggtaattcgagcctaattttgttcgtctatatttgtcctcctttttacaagaggccaactcataatctcttacaacagataacccctaatagctcgtggtctctcttaacagggcctctcgactagggtcctcctcatgcgtcaacaccttttggggggcgcctctgtgacactccatcatatcttttcaggtgctctcactctttgctctcgcacgtccctattcttgttgcactctatgcgtcgatgttcgtactactcgtgactctctccgatctctctatttctgatacgctctatatctcctgtgctggctctgcc

SEQ ID NO: 503580 - DNA, 601 bp, Homo sapiens
caccacccccccccccccccccaaccatcgccagcatcgaggcctcgcttaactccctcacggaaacactaccgggtaacctcgctgtacgcctgagcacccagagcgactgcctcatcttcaatgccaccagcccctcgggttccaatgactgcagctactgcgagacagagttctcacacacctgtggcgcgagctcatcgaggtgcacctgctggcgccatgtgacatgcatccctgccttcctcagctctgctcaccctcgagctcttcagcctgccagacctgtggctgtatgccttgcatgtgctcgtgtggtgcatatgcctggatgccactctgcttggcctgacctgcagtgtcccctgcccctgccatgccacagtgctggtgtgcactgtcctgcctctccatgccccacagtggcatgcagcatgacttgacagacactgctgggacctactgtctggtggcttccgtgcttggtgtgctggccagcaccctctccactgtgcagaccccatgcgtccctggagcctggtgtgtgggcgtcggccaccagcctgggttcctcacacttgtgaaatagaatcttctcccc

SEQ ID NO: 503581 - DNA, 163 bp, Homo sapiens
tagcaggactcataggctgtggggagctattggtttaagaactgggaatacagttgattcccattattcacagtagttattttgtataactgttgccacaaacactgaattagtgtgatactcaaccactcgttcctaggagagggggtccggactgtcttga

SEQ ID NO: 503582 - DNA, 205 bp, Homo sapiens
aaacttcagtggtcgtggtggctttggtggcagccgtggtggtggtggatatggtgcagtggggtatggctataatggatttggtaatgatgggaagcaattttgggaggtggtggagctacaatgtatttggggtatcacaacaatcagtctacaaattgtgcgccccatggagggaggatattttgggaggcagaagctctcc

SEQ ID NO: 503583 - DNA, 557 bp, Homo sapiens
tgagtgtcacgtcacgtaggaaaagaacttacggatgtaactttaaaacgctatcacacctctatccctgtaccaaagaataaattagagtcaatgccggagggaaatggagacactgatttttaatttttatcaggaatctatttactcctttattggttctaacatatattttattgaaagctactaatgtgccaaacactgtggtaggagtagagatacaagggtacatgagacaaagagactctgctctcacatgtcttttgagttacacagatattggacaaatacttaaaagtatgttaaatttgctctttcactcaattcataattaagtttaagtttttttgtcaggttaaattgttggtaaatatagcaaatccagatcattcacagttcttgcttcttctcttacctatcatgtcctagatacaatggaaatgtaagggtgagcaaaaacaaacatggtttctaccttcaaggagcttagattctggaggaaagtcaaagattactgaaacaattatataaacacatataaaatccaaattgaggtc

SEQ ID NO: 503584 - DNA, 1275 bp, Homo sapiens
gatcaccatggtggctgggacccgtgtacacgtatcctgaagaacgggagggtgcttcaaggctctcatcgcgtggtcagtacagcggggctcaggtccgagtgtcgtcgtccggacgcaactccgatttcgcattgtcgggtcgaaatcaatcgcgaccgcctgcaatgtctccggcacaatttcctgccggctcagggccccagccatttgcagtggtgccatggatggcatcgtgtgctgctttgcagcagccaacgccgattgcccctcattcatgctgcagccagattgccaggcagcgtgctgcggggcacagttacatccaagccatgggcgagcagagcacactagagatgggctgcgagatagagcggtagaggcatctatcgcatggcattatcctggagtaactcagctagccgccgcacaaggccaacgttacccgtcgtgagctgagtctgacccacgacgcctctgtgggcctagtcaacttgcacccgactagagccacaccaccgaggaggcacaacgcatgaacgacagcagctcgccacacaacgcgcacgcgcccatgcctcgcaccacgcccggcaacacattaccctagaccgcgcccagtagacgctcggcacacttgaggcggtactcaacccttctcggcacacggcacaccgcgaccgggacaccgtcctcctcatccattggcgcctcgtcgccgcccgcaacaaccggggaaggcgttggcaaccgacatttactggcgcaccttgggacccatagatccaaacccaaaggcctatctggcttcccctgggcctacaccacacagctgcatcatggactggcagacgattctcattacgttacacgcccccacggcggccttcaccattcagcgaacgagcccccatattccatgtctgctccccaggcacccacaagcgacaccgttctacccacacgcacgaatattcacccacgacaaacacgggacgatcgaggagttcaccacatccaaacccccacttggccgacacttcattaaacacaccacaagcacacccggcacgcgaacacccccgggagaccacgtgcgcaccctttgcgagccagcccggcacacggagatggacacacaccagttcggcagggccgcaaacgaacaacgcacatggtggccccggacggcacaagcggacagttggccatacacaaaccacaagcagcatgggccacgcacagaacagccggaaacagccataaccaccacca

SEQ ID NO: 503585 - DNA, 381 bp, Homo sapiens
gtgaggcacagtacgttaacctaagccgatgacaatgagaagcaatcgcactcagcacgctgtgtgttctcagtgaagattgcttcctacgcgcacgtcaggtggtaccacaggcaaataggcgcagaatagagaagataaacgcgtaaaagaacgataggttcccgtctccccacaacaggttggcccatcccagggggcagtgattggtcaaatcattccacacagttgtcgcagacactgcagtgtgaggttcggggtggccggaacatcttgcaggtgaagcagtacttcagcttcaccatctggccgttgatcagcaccccccgggtccgaaggggtgccggttgtagaactgccctttgttgtcgccatctgttt

SEQ ID NO: 503586 - DNA, 401 bp, Homo sapiens
  misc_feature (155)..(155): n is a, c, g, or t
actatggagtattcactaagcatacacttacgacatgatatctttctgtatgtactacgtcataaagggcagggacatattatttagaaggactggtctttccatttgcacacttcaaaaagtctaatttattcaagctcttcatgtgctacatntacatcatcaatagagcccatttagataacctagcaattttctaagccacatcattttaaaatgtcacagaagttgtttaagataaactactttttgaatctgtggataatgtccttatgggaagtttatcttaaagccacaagtaccctttggcataaaaattacgacaaacgattctttcattggtcctgtaagtgaatttgactacttgttttcattaaaatatcacacccggttggagcagt

SEQ ID NO: 503587 - DNA, 216 bp, Homo sapiens
cattttgggggggaattctttttttggggcctccccccctccccattttccatttgaatggccccctagaaatgaagaaaaagaaaatgcggcagctacatttttgcctttattttttgagccttcccccccgtaaactagggactttagttcggttttatatgcaagggatccctattttatttaattttttttaaataaaaaatccaatagcca

SEQ ID NO: 503588 - DNA, 1662 bp, Homo sapiens
  misc_feature (279)..(279): n is a, c, g, or t
  misc_feature (340)..(340): n is a, c, g, or t
  misc_feature (371)..(371): n is a, c, g, or t
  misc_feature (399)..(399): n is a, c, g, or t
  misc_feature (419)..(419): n is a, c, g, or t
  misc_feature (445)..(445): n is a, c, g, or t
  misc_feature (452)..(452): n is a, c, g, or t
  misc_feature (486)..(486): n is a, c, g, or t
  misc_feature (494)..(495): n is a, c, g, or t
  misc_feature (607)..(607): n is a, c, g, or t
  misc_feature (647)..(647): n is a, c, g, or t
ggacatatgagaatcgaagcccatccctcgaaaatacaggtaagttctgcggtgccagctatcagaccccatgccacatcttaaattttccaatctagagacaagatgacgttagttacagaccctgggaggagtacagtcgcgctgccgagaagcttgacctcgctgaccctatgaaggcacagtgtggttctcaaatatacggcattctgactgggaacttgtgtgttgacagtaacacgatgatttagatataccaacgctcgagaggatgtacangaagattgagaaattccacagtcaactaatgcgacttatggtagccaatggaagcccgcantgttaccatggaaactgagtgaatggtttgnaatgaagactttgtcgtgtacttaggangtaaatatcttttgaattanagaaagtgtgggacagaaagtacttnatgtaantaagtgggctgttcagaagcttagaggtcatttntgtaattnnctttttaattactttagagagctagggatgcaaatgtttcagttagaaagcctttatttacttttggaaattgaacaagaaatgcatctgtcttagaaactggagattattngatgttaggtaaaacatgtaattgtttctctggcaaattngtatcagtaatttgaaaatgagatattaggaaaaacaattcttcttaaatttagttcatctttctttcaacacagcaacatatcaaatgtaacccatattagtccagatccatgtattatggagcatacaaatgtatgctgtagtgaccaataaatcataacatatggtaattggcacttaactccacaccactagtatgcacttgttcatacactactgtgtacctaattatagtatacgcagtgtagtctcaattaataatctgaaacgtaacttagtggcctaaacaagtatgcaatagaacttattctaccacatatcaaacactacccatgcaaaactactacacgggggatacacgcaacacaactacaagacaatagaccagaacgcaacgaggcactataggacaaaacataagtcacacacaccaacgacacacgaaaccccccacacacgcaataactagaccactgatacggacactggcggaacctgactggaaatccacaagatcgaccaaatacatcgggaacccgccacaccgaaacccaaaattagacaaggcaaaaatcacagcaacgacaccaataaataagaagcccaacactagacacacaagaaaccccccaccaaaccggcgaccaatgccaatacaccagcaaacgcacaccaaggacaaaaaaagacacgaatgacacaaaaccgtcccgagggaaaaaaacacaaacagaacacaaaaaaaacacaagaaacacacaacactaaaagcccacaaaaacgcaacaaaacaaagaaaacaaagcaaaaacaaaaacggcaaccccactggcaacacaaacagaacaaaaatgagacaaagttcacgaagagctaagagagagaaaagcaaagcacagggaaccatggaacagacccacatacagtgcaaacagggacggcaacaaacacaaaaagaacaagaacgagcaccgagaagcacaccctaaagaaaagcaaaaagaaaacagaaca

SEQ ID NO: 503589 - DNA, 1699 bp, Homo sapiens
  misc_feature (316)..(316): n is a, c, g, or t
  misc_feature (377)..(377): n is a, c, g, or t
  misc_feature (408)..(408): n is a, c, g, or t
  misc_feature (436)..(436): n is a, c, g, or t
  misc_feature (456)..(456): n is a, c, g, or t
  misc_feature (482)..(482): n is a, c, g, or t
  misc_feature (489)..(489): n is a, c, g, or t
  misc_feature (523)..(523): n is a, c, g, or t
  misc_feature (531)..(532): n is a, c, g, or t
  misc_feature (644)..(644): n is a, c, g, or t
  misc_feature (684)..(684): n is a, c, g, or t
ggtttcgacttaggtcgcgcgactcccggacgtagtgtcgttcgtgtggccgaggttctgaagccttgggtactctttaattgttccactctaggccatcgtatggctggagtaccagagcctgggtatggatgttcatacgtcgttgtccgaacagatgtctttacctcggctgacccgtatgagagggcctcgtgtggtcctcatgatatgggcattctgaatggtgaactgtgtagtgctaaagacgtaccgagatgatgatagttgggtcgggtgtataaaaaacaggaccagagctcacatgtatgtacangaagattgagaaattccacagtcaactaatgcgacttatggtagccaatggaagcccgcantgttaccatggaaactgagtgaatggtttgnaatgaagactttgtcgtgtacttaggangtaaatatcttttgaattanagaaagtgtgggacagaaagtacttnatgtaantaagtgggctgttcagaagcttagaggtcatttntgtaattnnctttttaattactttagagagctagggatgcaaatgtttcagttagaaagcctttatttacttttggaaattgaacaagaaatgcatctgtcttagaaactggagattattngatgttaggtaaaacatgtaattgtttctctggcaaattngtatcagtaatttgaaaatgagatattaggaaaaacaattcttcttaaatttagttcatctttctttcaacacagcaacatatcaaatgtaacccatattagtccagatccatgtattatggagcatacaaatgtatgctgtagtgaccaataaatcataacatatggtaattggcacttaactccacaccactagtatgcacttgttcatacactactgtgtacctaattatagtatacgcagtgtagtctcaattaataatctgaaacgtaacttagtggcctaaacaagtatgcaatagaacttattctaccacatatcaaacactacccatgcaaaactactacacgggggatacacgcaacacaactacaagacaatagaccagaacgcaacgaggcactataggacaaaacataagtcacacacaccaacgacacacgaaaccccccacacacgcaataactagaccactgatacggacactggcggaacctgactggaaatccacaagatcgaccaaatacatcgggaacccgccacaccgaaacccaaaattagacaaggcaaaaatcacagcaacgacaccaataaataagaagcccaacactagacacacaagaaaccccccaccaaaccggcgaccaatgccaatacaccagcaaacgcacaccaaggacaaaaaaagacacgaatgacacaaaaccgtcccgagggaaaaaaacacaaacagaacacaaaaaaaacacaagaaacacacaacactaaaagcccacaaaaacgcaacaaaacaaagaaaacaaagcaaaaacaaaaacggcaaccccactggcaacacaaacagaacaaaaatgagacaaagttcacgaagagctaagagagagaaaagcaaagcacagggaaccatggaacagacccacatacagtgcaaacagggacggcaacaaacacaaaaagaacaagaacgagcaccgagaagcacaccctaaagaaaagcaaaaagaaaacagaaca

SEQ ID NO: 503590 - DNA, 252 bp, Homo sapiens
ggaggccccaaaaggagtggaaatcaatgcttaagctggcaatatggaagccacctgcaggacagagctgagactggaatccaaagatggagaggtgagggatgacaaggacataatttcatagagcttctactttaacaggccaacccttcccataactgagtgacctcggagttggattctacagtgtttcacaagaggagccatacatgttatatttctgaaacaattaatatgagcactatgattatt

SEQ ID NO: 503591 - DNA, 270 bp, Homo sapiens
tgggtagccatcacccttcatgtcttgccatatccggcttgcattcgggcttgatgtggggaggggtattcacggggttggctagggtataacttgtctgggtcgcctaggagggtctggtgagaatagtgttaactgtcattaacggcgagaaggacagagaagtaagccgagggcgtcttagctggtgtagtaggggtggcaggtgcattttcatcggcagtgggcaggtgatacctcagggggtagatttgatccccggtcatcatg

SEQ ID NO: 503592 - DNA, 173 bp, Homo sapiens
tgaagcactggggaggtagggtggggagcgggagcaagagctgaaaaacttacctactggggactgtgctcactacctgggtgacaggatcatacgtaccccaaacctcaacatcacacagtataccctggtctcaagtccccccagttgcttcagacccaggtgcttcagaa

SEQ ID NO: 503593 - DNA, 277 bp, Homo sapiens
cgtgagcagtccaccgaaaggtcaagtctcataaaggtcgtcgatcaagtctcaagagtggcgaaagctgagcgtgatgtcaaaatccccagtcttgctagactgccttgatagcatataagagaagtagcccgcctcctgtcttctggcagctcctcccatctcttgacttccatggacatcatgtcatcctatgttgtctggggatcctcccccacagatctcatttgatgggcttctccgttccctaagctctactcgtggaaatgtgggtacc

SEQ ID NO: 503594 - DNA, 270 bp, Homo sapiens
aacggatcaggtttttgacccttgatgaagatttaagatttttaaccggaatcttttttttttcttttcccctcttcctctctaattctgaaggatcttttgtcttctaagcaaaagaactgagagattgagagggagggctgccttcttttttttccttgtaagtaattaggaaagaggtttaaaaaaaacagaaaaatagaaaaaaaaagaaactattttctttctcagaaatttattttttattatttttgtttttttttgagacag

SEQ ID NO: 503595 - DNA, 262 bp, Homo sapiens
gttggtacctctaagataagatctacgataacactgttggaaaggccctcttgccagagtcctgagagtgccatatggaatgcggcctccagggttacatcgggccctcagtggtacatggagagtgcgtctggttagtaggcccagagtgagtatgcgctatgaagtgtaagttacatcacatgtgtagtcccatgttcactaagcagactatgagagccactattaatggtcatagaatgggaataactctataatagag

SEQ ID NO: 503596 - DNA, 141 bp, Homo sapiens
cctcggtccatttcattaagcatctactaagcccggtaagagaaaaggtttgttgtctgcttggtagatgcttattgaaaatattgaactttcgttgaccagatatgctacagaaggttgtggcgtctttcttccctttct

SEQ ID NO: 503597 - DNA, 456 bp, Homo sapiens
catttcaagaataacaaaataaaattttctctttgtctgaacctgcaaaaaaaaaaaaaaaaaaaaaagggaaaaaaaaaaaaaaaaaaaaaaaaaaaaaaaaaaaaaaaaaaaaaaaaaggaaaaaaaacaaaaaaaaaaaaaaaaaacccttttgggccccttggccccatcctattttaaacttaacaaatctttttattccgccccaaattcaacctcatttgcccaatcccccttttagggattcttttaaaaataaactgccccttttttaacaccctcctacctggaaaaaccttgcctttcccaaattaaatcgctttgaacaacatccccttttcgccatttgggttaataccaaaaaggcccccaccaatcccctttccaaacatttccccaccctaaatgccaaatgaaaatttaaaccttattttttttctccgcctttttttt

SEQ ID NO: 503598 - DNA, 435 bp, Homo sapiens
  misc_feature (31)..(31): n is a, c, g, or t
  misc_feature (95)..(95): n is a, c, g, or t
  misc_feature (287)..(287): n is a, c, g, or t
  misc_feature (289)..(289): n is a, c, g, or t
ctggagacagagcgagactcatctcaaatanataaacaaaaataaaaataaaggctggacgtggtggctcatgcctgtaatctcagcaatttggnagcccaaggcaggcagatcagcaggttgggagttcaaaaccagcctggcctacatggtgaaaccctgtctctactaaaaacacaaaaattagctggccgtggtgccgggtgcctgtcatcccagctactctggaggctgaggcaggagaatcgtttgaacccgggagacagagattgcagtgagtcacgatngnccattgcactccagcctgggtgacagcacgagactccatctcaaataaataaataaatataaaaaaagtaaaacaggcatcaacagcctcttgggagaccccgagcagtgccgcgtgcacggtcaacatcacaagattcagctatg

SEQ ID NO: 503599 - DNA, 459 bp, Homo sapiens
ggtgacttatttcttccttccatcaagttatacttcaaatggaagaactgattctcctttttttctctaaggtggagtcccgctctgtcgcccaggctggagtgcagtggtgcgatctcggcccactgcaacctccgcctcccaggctcaagtgaatctcctgcctcagcctcccaagttgccaagaccacagacacacaccaccacacccagctaattttttttatttaaaaaatcttttttgacagagtctccctctgtcgcccaggctggagtgcagtggctcagtctcggctcactgcaacctccgtctcccgggttcaagcaattcttctgctccagcctcccaagtagctgggactacagcacacaccaccacacccagctaatttttgtatttttagtagagctggggtttcaccatatcggccaggctggtctcgaactcctgacctcatg

SEQ ID NO: 503600 - DNA, 399 bp, Homo sapiens
  misc_feature (395)..(395): n is a, c, g, or t
ggcaagattaacaaaattaggccgggcatggtggctcacgcctgtaatcccagcactttgggaggcccaggtggcggaatcacctgaggttagaagtttgagaccagcctggccaacatggtgaaacctggcctctactaaaaatacaaaaattagccgggtgtggtggtgggtacctataatcccagctacttgggaggctgaggcaggagaatcgcttgaacctggggaggtggaggttgcagtgagcttgagatccgtgctatttgcacttccagcctggggcgacagagcaagacgccatcttcaaaaacaaaaaaacaaatttcatgtttacttaaaagacaggtagcctttttacagacattttttgcccctttttttttttaactgantttt

SEQ ID NO: 503601 - DNA, 410 bp, Homo sapiens
ggcaaaactgttatttttatggattttactaaaaggcggtaccctttcaagatttatatgtttgtataatcataagaaaattgagccattaaagccctgttattcaatcctaatagtcagttttttagaacctacttttaggggaaatgggacattatttaatattatattaaacctcctatagggtggattgtagaccaaaggaaatgggaccatttttgagaatatatgttgattttttgtggctaattccaaagttggatttgaaaggatggcctcccagttttcatttgtccataacaaacatatgggtgtgtggggggatatatatatgtggggtgccaatgtttggtttataattttaatgttaataaaaattttgagttttattggaaatgatttccttttta

SEQ ID NO: 503602 - DNA, 139 bp, Homo sapiens
ctaccagcacccccgatccctgagaatgaggggtttacgggctgtgaatggaccttcagccctgccccccctccctcccccctgctggtgagtttgtttgatgttttggttgtgtgaataaatataattcccctttgga

SEQ ID NO: 503603 - DNA, 291 bp, Homo sapiens
agccaaatgcacgagatatctatacaaaaatttaaaaattagccggacatggtggtgtgcacctgtggtcctagctacttgagaggctgaggtgggaggatcgcttgacctggggagtttgaggttgcagtaggctatgattgcaccactgcactccagcctgggcaacagagtgaaaccccatctctaccaaaaagaccaaaaattagccagttgtggtggcgaccacgtctgtggtcctctgcttctcgggaggctaggatgggagaagatcgcttgggcgtacgggga

SEQ ID NO: 503604 - DNA, 279 bp, Homo sapiens
  misc_feature (4)..(4): n is a, c, g, or t
gggnggggggggcccccccccctttttttttttcctttaaagggcgggggggggtcccctccccccgctttttttttggggggggggggggggggatttttttttccgggggggaatttttccttccggccggccttggggggtttttttttgggcccctttagggggggcccgcggggggggtttggttttttctgggggggcccccccggggggggttttttttttttttttccccccccctttttttttttttttgggggtgggggggccccccca

SEQ ID NO: 503605 - DNA, 1062 bp, Homo sapiens
cgtgtatccggtagctagtcctgtcgcctcgtccctctacccgtatcatctgtgacccttgtgttgactcgctctggtctccggaggcttccttcgtcctgtctacagtccacgagctcctgtgtgtgtgctcaggttgggggtctgagcactctacagccccctcctgcatttcggtctgtcaggtctatttatctttgatgctcatgcggacatgctttgaaacctagaaatcagtccatcaagcaccaacaggctgtgaatagacgcgtcatcatcagttaatcacttctcgaccaatgggtgctaggtgctcggagatccgagattgtcatcggctaccagaaaaggatgagaatcggaccttgcatcactgacgtgtatcctcagacgttatctggcccactctgtcatgactggtgattcccgggccgtattagaggcacacacatgggtccaggtgaatgagcgctctcctggagccttaaaaattctctcgcgatgaaaggggtcatggcaaagcactgatggatagcacatcttcctttattcgcatgactcattctgactacccagcaactcgagatctactggatggcatgggggtacaatataacatgagtggtatactgcgaaaatgtgactagatgagttcgatctttggcagaacgcgatcattcagtgttgctggtacaacatactggttgactttccgccagtttgatggtcgacctgggaaagggtataagagactgaggatggctgctgttcatatgagttagtgagagctgattggactcggatcgcaccgggatactcctagtgacagtcgcaagtggaagaaagacagggaactgtatgttcgcaagatgaatccccataattgagcccaccggtgaagtggaccatcttccagaaagcatccggatagggccacgacttaagtggccttttgacattgttggggacgcatcaagaagaaggttttgggcaccttggcaaattgggttcctgaaccggtgctgggctcaaaagaaggccgaatttgaacattttatccga

SEQ ID NO: 503606 - DNA, 180 bp, Homo sapiens
actagtcacgggttggcttcctgtcccagatcaaaaccacaatgcgataccaccttactcctacaagaatggccataatcgaaaaatcaaaaaacagaagatgttggcatggatgcggtgatcaggggagcacttctaactggctgatagtgaatgttaactagatacagccaagccgtg

SEQ ID NO: 503607 - DNA, 96 bp, Homo sapiens
  misc_feature (71)..(71): n is a, c, g, or t
  misc_feature (77)..(77): n is a, c, g, or t
aatgactgcaccaacatcatcaggaagcctgtggtgtgcggagtctcctctcttggcatcgaccacaccancctccngggggatacgttggagaag

SEQ ID NO: 503608 - DNA, 1727 bp, Homo sapiens
  misc_feature (633)..(633): n is a, c, g, or t
gaaaccattattcaagactctgcatctttgatatccgatgtctctagccgtagtagagccatattttgaaaagagctttactcaaatacaggatcataacattcagctggtgtgtaagtgtgattaacgcatttagggtgaatttacaggacgtgttcatacacaagcacagtgctgatctttagcaacatttccatcaacttccaaagatcccctggtggccagtttgtagtcctccaagccatcttcgatctatcttgtttctatgacttgccttttctggctatttcatattaaatgggatcatcatgacatgtggtgtcctatatctgagcttttttcatttaggataacgtcgttgagggtcatccaggttggtagtactccatgggcatgataaggggggctacataaatatgtccattgtatggagtattacacatatttgagttatacagtttaatgggacatttaggttatgtgtacctttttgggattaataagatgggtggtgtgaacaatcatgtataagtcctctgtgtcagagccgcactttgagtaaatcagattctaaagaatttcatcttggaagttccaactcacgcggggcacggcattgtgacctctaaccgnggggtaacaacacacacttgcgctgcatcaaggagacggaacactcgggggagagaaaacacacccggagagaacggaacagtagtgaaagacccacagagaagtgccccagacaacgggacgggggtctcaacaacacccgctagttaatgtcgaccacgccacgaacacgctccacctgttaaaccacacggcggcgctaagcatggctcatcattgagcagcaccaccgtcgtcgcgacgacgggaagacataacaaccctgtagctaacacactcaacgacgaaccacctcctaatgtcttcgttattatattttgtttatttgatatgtaatacgccacgcagccgcagacagacaaagagacgagagaaggaagaagaagagaacggaaggaagagacaaacaaacaaaccaaatcaaagaggaaagacgcacgagaagcgaccacgacaacgcgcacataacaaccgaagagactggcgaccaccacaccgacaccgacgccgccaacccgaaccagaacacccaagccgagcagggacgaggcaagcaggagaggcaccacgcgacaaccgccgacagcgcagtacagataaagcaaagcagagacacgactaagacgaagaagaagagagcagagaggcggcgcggacggatccagcaggaggacgcaaaggagagagaatgaccacaagagacagagtgacgcgacgacgaagagagcaagagggaaaataggcacacgcggaagccaggcacaaccggacgcgaaggagaaaagcagggaagggaacagaacacgaccgaaaccacacgacgaggagggcgagtagggaggcagagacaggagagagacgaagagaaggcaagcgtagagcagaaggagagcgaggacacaggaaaagtccacagagcagacaggagcggaaagcaaaaggagcccgacgggcagacaaggcggagagagggcagcaccagacgagagcaaagagagagaagagggaggatgccagaaagacacaataccacgacgcagcggagcagagaaacaacacggaaccacaacaacagacacaccaaacaacagcaa

SEQ ID NO: 503609 - DNA, 940 bp, Homo sapiens
tcgagggaccgcttggttataagtgcgggtgcctggttggccatactcccgttgccttttgtcttactcgcagcgatttcttttatcgcggtcccagtgtaatttccgaaaaatagtggcacttgcgccccttacaggtgtctgtcctctgccgaaggtttgtgggatacccagccgtgtgcgtgggccttccccaataaaggtgctttccccccgcgttggtagatctgtccatcctgggcgcaccgtgtattccctgtcgcacatcctaaacttctaactccccgtgcctactcgggggagatgttcctccttagtgccctagttgctcccacaacacggcgcttttttggagcgaacaaccaccaccagtgcgggcgctcgaaagcaacgaacccagctgatcaagagtagggccgctaaaaaacaaagagtctcccgggcagggggtgcccacaccaccgggcaagacgccaccccacttgtgggcgagcgcgaggccgggcgagactccttgacctcctacagcaagtatgacgcacaccaccctttgggccaacaaaaaagggcaacccccctctctcttcctcggggtgcacacaaaaaagtcccggcacgcctgtggggcgcgacgcgccaggaaacccacatcttcggggggggcgtagaagcagcgagcacgtcgtggccctgggggaacacagtcgccccgtgcgcgtatcggtcgtgagggcaccacaccccccaccggggccccgagaggcagcctcccttcccacaaacaaagtaaataccaggtcagaacaaaacgacaccagtacgttgctgcaaaccggtgggcaaccccggagacagccccgcagaacacaccaggacgcgtcagtctgacagcggcagcaaaaacaacatggcccgagcgggcacccccaacaaggacagc

SEQ ID NO: 503610 - DNA, 364 bp, Homo sapiens
  misc_feature (155)..(155): n is a, c, g, or t
cgggttttttaaccccccccccacacgcccctttttagggggggcccccctgtgaaggggtggggggccccccccggggggccggggttttttaaaagggaaaacccccccggggcagggggtcccccccccccggggttgggcccggggccccnaatttttggcgggccccccccccggtttcccacttttgggatttgggcccccccccccctggggggcaaaagggggccccccccctgggggggggggggggggggggggcccgggctttttgaccgccggggggggtttttggggggggggttttttaattttttttttttttcccccccccccccaaaaaaaaaagtcccgggttcca

SEQ ID NO: 503611 - DNA, 238 bp, Homo sapiens
  misc_feature (62)..(62): n is a, c, g, or t
  misc_feature (82)..(82): n is a, c, g, or t
  misc_feature (86)..(86): n is a, c, g, or t
  misc_feature (122)..(122): n is a, c, g, or t
  misc_feature (210)..(210): n is a, c, g, or t
cggacacagggttatgatgctataattaggctggggtggtggtgatcaaattatgtgttttnggagagtcatgtcagtggtngtantataattgtgggacgattagttttagcatggagtangtttaggttatgtacgtagtctaggccatatgtgtgggagattgagactagtagggctaggcctaccgctgcttcgcaggcggcaaanactagtatggcatcctcggcacgctgcg

SEQ ID NO: 503612 - DNA, 414 bp, Homo sapiens
attaattccccccaccgagatgtatttagggcctatattcaacctttgcctagtacaaataatatgaatgtaaacattatagttaaatatttgtaccatatcccttatttcccttaaatccttaaaagtgaaattattggatcaaaaaggcatttgtgttttacaggtgattgcctagatatttcccacattctgcaattcacagtgtccttcagaaagactatacccaatttatgcttcaaataacagtctttcagcctaggtgattgggtatgtggtaatactattaactgagtaaaacttcctaggagaacctggcttaggggaagatgcttggttcagactggaatattataactgaattattttcattagcccccttgatattcaaaacccttgtgtgataataacaac

SEQ ID NO: 503613 - DNA, 137 bp, Homo sapiens
tagcaggatcttaccaagcacaccagagcacctcaaagttcttacaaaagaaggagctcggcaggcacggtggctcacacctgtaatcccaacactttgggagggcgagataggagaattggttggacccgggaggt

SEQ ID NO: 503614 - DNA, 272 bp, Homo sapiens
ccatgttcttaacaagggtctgcacctgctgtggtttgaatgtgttcccgtatttcatgtgttggaaactgaatgcccaacttagcagtattgaaagatggggcctttaagaggtgattggatcctaaggcctctgccctcatgaaattgataaatccacgtgtggactaatagattaatgggttattatgagagcaggactggtggctttataagaggaagagagacctgagctagcacacccagcccccttgtcacatggccactcaata

SEQ ID NO: 503615 - DNA, 553 bp, Homo sapiens
cgtgcaagagaaaacttccgttctgtgccttgggttaagatcccctttgtactcctcgtctgtaagacctctcttatcacaacggtacccccaaaattagagactgtgcagtatccactctgtaaccctcagaagcctactgctgtacttgggcttcctacgtacgacggtggtactgactatacgtgagtgacattgttttacaagacttggcccctagagagacgactgcttacgggttcaacatcgtgatcctatcaggtacctagctggtagccttaagtaagtcacttagacattctgtgactcagtagtctcatctgttacatgggtacaatcaatacatatctctgaaggctgctgtgatgattacctgcaatcactacatggcacagtacctggtatgtaataagtacccaattaaatataacttttttcaggaagtgacagtcataggaagaactcagtatgtttgtagaatgattcttacatgatacctcttaacacaggtgattacatggctccaacacctgatccccaagattgaagatgg

SEQ ID NO: 503616 - DNA, 182 bp, Homo sapiens
gatggcggcctcagcagcgcgaggtgctgcggcgctgcgtagaaggtattcaatcagccgggttgctttttttgagaagaatttccttggacttcggcgctcgagttcaactgaaagaacactttttcacagattcggccatgttcagaaggggcatttttaccctttttacaagggagact

SEQ ID NO: 503617 - DNA, 276 bp, Homo sapiens
  misc_feature (222)..(222): n is a, c, g, or t
  misc_feature (256)..(256): n is a, c, g, or t
gctcactgcaacctccacctcccgggtttgagcgattctcttgcctcagcctcccaagtagcttggatacaggtgcccaccaccacacccagctagtttttgtatttttagtggagacggggtttcaccatgttggccaggctgatattgaactcctgacctcaggtgatccgccctcctcagcctcccaaattgttgggattacaggcgtgagcaccacgnctggtcaggaacattcttatgagaccttgaatgnctaaaagaaaccatgcccct

SEQ ID NO: 503618 - DNA, 856 bp, Homo sapiens
tgccagagaacatgtcgattgatgaaggaagattctgcagaatggacttcaaagtgagtggactgccagctcctgatgtgtcatggtatctaaatggaagaacagttcgattcaagatgattcgcacaagatgatagtgtctgagaagggtcttcattcacctcatcttgtgaacgtaggtcagagcttcagatgcaggggcgttatgcatgtgttgccaagaatagagcaggagaagccaccttcactgtgtcagctggatgtccgtgtgcggaaatgaacataaaagagcgaccaatgttgatctacaaaccacgagagcaaaaaagttttagagggagattcagtgaaagtagaaggtgccgagatctcggtataggctccaccaaagcttttctggaatacagaacataatgaaatggtacaattcaagactgatcgaataagcttatatcaagatgacactggaagagttactttactgataaacagatgtaaacaagaaagatgctgggtggtatacgtgtgtcagcagattaatgaagctggaggtgactacatgtaaccacatgattagacgtacggacgtccaaacctaaactcttccaggtcctaagcgagtagggttcgaccaacattcagcaatattagcacttatgggaaaggtttggcttgtgacacaaggtttaaagcagaaagagaattcagggttgggggtcaactggactcatgaagggacgaactctatactttaccacttggaaaaggcactcaccagttcgaaatatttgagtccttggcatacccccacggtacagacaaggcaccgggcaggaccattaaacataccgggcgc

SEQ ID NO: 503619 - DNA, 379 bp, Homo sapiens
tcactgtcttctcggagttcatgatccagagtcatgaggctgctggcaggagctgtgctgctgggcctgcgcctggtggttggcctcctcaacctggggtcccctacctgtgccgtgtcgtggcctgcctggagccgcatgactccccggtactggaggtgtacgtggccatctgcaggaagctcatcctcaagctgtgcatcctggggacactgtgctaccactggcttggggccgcatggtgagccgtacctgcagggccagtgctgggcggatattgtgggccaggagctggaccggtacctggtgaatggactatcgtcccccatgttggctggaccggccatcgttgcggggttccgaagcctcgaaatcggaa

SEQ ID NO: 503620 - DNA, 1309 bp, Homo sapiens
gcattctgctttccaactgcctgactgcttgtaagtctcactggtgtgagcttccagcaatcccctttgctcgaaatggaccccaactgctcttgagccattggtgggctccttgcacgtgagaccggctcctgcaagttgcaaagagtgcaaatgcacctctcttgcaagaagagctgctgtacctgctgccccgtggcattgtgccaagttgtgcccaggcatgcgtctgcaaaggggtgcattcgcgagaatgtgcaagctgatgtcgcttgcatgtgcggcaccaggctctctctccccagattgtaccactacgaaccaatccgtgccacaaacctgggcattcttttcacaacatattacacacatttgaccaccaatttgtggcttgcaattatcctttccgacactcccataaacatatatgctgcacttgacccaattaaaacaaaccaactttttagacgcaaaaaatacacacacactccaaccacaacacacaacaacacactaacaatacattctcaccgacacacctatagatgcccctcttaaagaacacgctatatctatacaagaacacccaattttagtaatagtgatgcgcagcacgtgaagcacccacctgtctcggcacatcacagtgaagacacaagcaatggggccacaaaaggagtgttcccccaatacagcgagagacccctcgcggtggctcacaactgcaagcgtagcgcgagaatatattccacgaccgcaacaacaaaaaagcgcgcccagagggcgagccaacgaggaccggtagtcggcaccaacaacccacgaagaacgaggaggaaaatagaagaccaacaaacgaggcgcaaccacaacacgaaggagcgcacagaaggggagggcggagcaatataaagtagcgcacggacgatgcagaggacgtacgagaaacagaagcagcgaacaaaaacagacggcgcgaagacagacagaaaggggctggcggcggtggtagcgaaagtgggggcggacggcggggaaggggggtcagaaggggagaggagcggagccatagaacagacgtccgagacaaagcaggagcaagtcaggagggaagggtgggagaaggacacgagaccggcgtggtcctcgaccgtagtgagagacggcactcgccggggacgcgtcgggagtgtggcgcatcgacacagagaaccagaatgagagtcagacctgactcgtaagggaccaggactcgcggcacggctcgaaccgacaggggaggaacgtcgaagacggagcagatcggaca

SEQ ID NO: 503621 - DNA, 377 bp, Homo sapiens
acttaaggatcccgcacgaggggtgtccagattattgacagtgcacacattcaccggctccgggaggcgggtggctgacacgaggtcataggtggtcgtgccccacaggacgagtggtgcgtgcatcgtggtcccccagtgtgacaagaatcctgtcatctggtgagaagtgccagggccagcacggtgatgctatggtggaaaatgaaatgctggcagagggcgtcagacacgttccagacgcggatctgacaaggggcggtcgtgcttgcttcgggccgaggcataggccatgacctgggccactgtggctgagggtcagcgtgtcgatctccgcagagttgccggaccagtgctgctgtgacacccctcgtgcg

SEQ ID NO: 503622 - DNA, 272 bp, Homo sapiens
ttcagaggacaagaggctaggacccagagcacagaggcagaggacaaggaggcagaggcacaagaggcagaggttgcagtggaccgagatcatgccatgcatccagctaggcaacagaagcagattccatctcaaaagaaacgacaacacaaaaccagacctggtgtggtggctcactccttgcaatgccaggacttgggaaggccacaggtgggacgatcatttgaggccagcctgggcaacatggccagatcccatctctaacaaaaaac

SEQ ID NO: 503623 - DNA, 534 bp, Homo sapiens
agcggactgcgagtatggcggcgtcaaaggtgaagcaggacatgcctccaccggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctgggaagaagaaggccttattcttaaaggagtgtgcccagatgtgagaagtgtgggagatctcgtgtgttaccacaaaacccggtgtgtgccccccgtttgatcggaggatgctgtacgggcgtggcaccacagaggaggctctccatgccagcaacggcttcatgtggtacacgtaggccctgtgccctccggccacctggatccctgaccctccccactgggacggaataaatgctctgcagacctg

SEQ ID NO: 503624 - DNA, 558 bp, Homo sapiens
ggtaaatagatatggacacctccaagacctacacatggctgattaaatgtggaagtcagcatacagaaacttttgaggttagttgaaacgatgagctgaaatgacacaaaagatggagaatttcaacagggaattgggatctacaaaaaaatcacatggatattttacactggaaaaaaatatataatatctgaatactttttttttttttttgttttttttggagatggagtcttgctctgtcacccaagctagagtgcagtggtaccatcacagctcaccgcaacctccaagttccagggtcaagcaatcctcctgctttggcctcctgagcagctgggactacaggcacacgccaccaggcccagccatatatatatatttttgtttgtttgattgtttttgccttagtagagtcaatgtctgactatgttgcccaggctgatcttaaacttctgggtttgagcagtcttcctgccccagcctcccaaagtgttgggataacaggtattgagccaccccgcccagccttacgtttttctcccatacccacacacc

SEQ ID NO: 503625 - DNA, 121 bp, Homo sapiens
ctctattggtatattcaggatgcttagagtgacatacatatctagaggcaagtatgttctccaagtgaagaatcattttcaaggcatgcaggccttttaaaactacctacccacagagttc

SEQ ID NO: 503626 - DNA, 222 bp, Homo sapiens
cgagtatatgtgcaggttcgactctaaagagatgccccatcatgggcgttcctgggatagagagaatcatagtgaaatcgataggcgcagacgtgaacaaaatgactcagtacatcacggagctctccgagatggtcgcacacattcagcgcactgtgtcggaagctcatacgagctcaccatcctctgcatggtcgtctcgcacattaagtccattacggg

SEQ ID NO: 503627 - DNA, 496 bp, Homo sapiens
  misc_feature (22)..(22): n is a, c, g, or t
  misc_feature (108)..(108): n is a, c, g, or t
  misc_feature (207)..(207): n is a, c, g, or t
  misc_feature (260)..(260): n is a, c, g, or t
  misc_feature (303)..(303): n is a, c, g, or t
  misc_feature (377)..(377): n is a, c, g, or t
  misc_feature (406)..(406): n is a, c, g, or t
  misc_feature (432)..(432): n is a, c, g, or t
  misc_feature (441)..(441): n is a, c, g, or t
  misc_feature (447)..(447): n is a, c, g, or t
  misc_feature (474)..(475): n is a, c, g, or t
gaattcggcacgaggttttttnaactttactataaagccatgcaaatgacaaaaatctatattactttctcaaaatggaccccaaagaaactttgatttactgttctnaactgcctaatcttaattacaggaactgtgcatcagctatttatgattctataagctatttcagcagaatgagatattaaatccaatgctttgattgtnctagaaagtatagtaatttgttttctaaggtggttcaagcatctactcttttnatcatttacttcaaaatgacattgctaaagactgcattatttnactactgtaatttctccacggccatagcattatgtacataggtgagtgtaccatttattatcctcaccattggnggccatgctttattatgggttttaatttnaaaattggaatgccccggtcccattnccacctggnattaantagggcctccaaccttattgccttttnnagggggaaatcatggggtagg

SEQ ID NO: 503628 - DNA, 284 bp, Homo sapiens
tattgtcacattttaagtgtgctttggaaaatgttttaaagcatcttctttgtacttgtattctacaagtagagaggctttgtagtctctctattgaagtgcatataacagctgctcaggtgaactccatctattcatcaggtgtctatgatagaattgcgttcctaagactgtttcgttcttaactcatggattatatattcacagcctgattgttggtgtgattgctccttatatcaaattcatagctcactggtggccttaataaaaggagtgtataagtt

SEQ ID NO: 503629 - DNA, 301 bp, Homo sapiens
  misc_feature (42)..(42): n is a, c, g, or t
gactcagccccatttctacagagcctgtagaatttttgcggncaaataggaaaggggcttataaaataaggtgctaaaaaatgtgagttgccaggtttccagggaagagcagataagatgaactagaacaacttgaagtatctttcattaactctaatcaagttgttaaggctcttttctgatgcagctttactatctgtaacgtgggtcaatgtccgttgccttagttattgctgaggcaggagaatggcatgaacccgggaggcggaacttgcagtgagcagagatcacgccactgcac

SEQ ID NO: 503630 - DNA, 1541 bp, Homo sapiens
  misc_feature (141)..(141): n is a, c, g, or t
  misc_feature (346)..(346): n is a, c, g, or t
  misc_feature (355)..(355): n is a, c, g, or t
  misc_feature (513)..(513): n is a, c, g, or t
ggacacttgtgtgcaattggtaatgatctggccaatatgaggaaactgggcggtggcctcgcactctgtgggattccatgtagagcgcagctgctttcgtggacatgatgttatgactccactttcagtgtaacatctagnccattggagtacattgcagtagcatgtcgagaaataaccaggtactctaaaaggaagaggcctggcaattgcatagcgaggatagcctgacagaggtcatagagtttgttagtggtagacctccatggctatgtctctacatgcaacatgcaatggcgtgagaaacaggggtaccagaatgtccctgtacaattggaatagcagntactgttgngcagacatgtcatgaatacacttagcgatgccagtgacaccagaagaatcgcaggtcactaagccaaaacttccacaccgtgaagaatcctaggaagttcctttgccttgggggcgagcatgaagcctcgtttatttgcatagaagcactctcagagntatcgcatccataacctcgcatccaaagcttgtgctcctgctgaagtgttggacgggcatgaaatggtatactgcctatgggaaattagttggataagtttggatggtaaacgccgtacgaagggccagttattggtgtagaggacagagacgtcaatataagtgccgtagctaggcctagcaagagacgtagactctctggatttgccccatgggaacggtgaaggacccgtatgaaatctatacgtctcgggagatttcgagaacttttagcgtgacctccagcgacgtacagggatcaaatttagttggggccgagggggtctcctaggtcaacatttggggggacatgttacagaccatggggcataatacagagcaaccacccgtaggtttgaccctacttaagccccaccacgggaaatccccaaggcccattagaatggccatggaggccgcattattaaagcccattgttgggcctaaaagaatgtattgtccgcgacaaggtcagttgctttacttccttgagataggtaacccgctccttctttagtttccctctaaacaagggcttgggaggccccttaaatgctcctaggaaagtcgtcttttaaaacccaagggcggcgatggagacctctttctcgcgtggacatcaggggtagttcaaaggccctccagattcgggactattacttctactaaataagagggcgaccaacaattgttgggctgtgtccccactttgagtttttgttgacacaccctttggggtgcacgctacatccccagtttgtcccccactattttttggttctagcccccagaagggggtaaataggggcatatcttaaaacgacacgaaaaatatttaattgaggggagcccgtggctagcaatataagacagagaagagcctcctatatattcggcagacaaaatagtgggccgccagaaaagtggtgttcgctcacacaacagcaaacactaatgaatgcaacacagaaagtgtgcggcgccatggt

SEQ ID NO: 503631 - DNA, 615 bp, Homo sapiens
  misc_feature (10)..(10): n is a, c, g, or t
  misc_feature (100)..(100): n is a, c, g, or t
  misc_feature (144)..(144): n is a, c, g, or t
  misc_feature (148)..(148): n is a, c, g, or t
  misc_feature (153)..(155): n is a, c, g, or t
  misc_feature (157)..(157): n is a, c, g, or t
  misc_feature (331)..(331): n is a, c, g, or t
  misc_feature (436)..(436): n is a, c, g, or t
  misc_feature (461)..(461): n is a, c, g, or t
  misc_feature (613)..(613): n is a, c, g, or t
agccaacgcngcgccgcggcggcaaaagcggggggcaaggaggggccaacgccgggcaagggcaagggaggggggagcagagaggggagaggggcggggnggggccccagccggcagggggggggggcgcccacagcgggcccnaaanagaannnangcaggaccgggacaaggcacagggggcgggggccgggaggggggaggccgggaagggaccgcagagcaaaggaagagaccgggggggggggaggcagcccagggcagggaagggaccgggggggcggggggaagccacgggccccgccggggggaaaaaagcacaacacatcanacagagggaccagaccagaagcgcgggccccaaggcgccccaaccggggcgggggaaccgccgggccaacccacaaagagagagaggagagagccggccccaccnccgcccggcccacccacccaccccngaggacggcagagagggcggggcagagagacagaggggaggaaggggacgggggggcggcccaggccccgccgggaggccggcgggggggggggggcagggcgcgggggccgcacagggcgcgcgcgccagacaaggccggggagaaggacntg

SEQ ID NO: 503632 - DNA, 465 bp, Homo sapiens
tatacagagaacaggtgtccaaagagaaatccattctcgcaaagccattctttctttcacacacagtgcctaaagcctccatagatggtgaaggctatagtgccaaaagtcagcccaaagagactacctcctgataaatcttggtttggtggagatgtgtggtcccagattttttcagggaaagtagcagtttggtggattctacatccagtacccaggctgtagatagcatctgcaaatgtaccaagaaacagtcttaaattggaaatggcaacagccaaccctcagggatgggaactgcagtgaatcactattgtgtgtgctgtctgagatggtgatatgcatgggatgtggtctaatcttgtgatccatcagaatcacttccaagccattaagaataatgtgtagcagctcaaattataataaacagtatcaggcaataaacacacaaatgacaaagaaaaa

SEQ ID NO: 503633 - DNA, 259 bp, Homo sapiens
ccagctggactacagtggagtggtccggagacgaaccagacatgggacggtcacccagcagtgccgggctgggctctgaggtgcaggtccacgggagagcaggcctccagctggaaaggccaggcctggagcttgcctcttcagtatttgtggcagttttagttttttgtttttttattattaaatcaaaaaacatttttttaacaacaaaaggcatttgaaaaatggagtggttgtgggtaataaaacagaaaaaata

SEQ ID NO: 503634 - DNA, 907 bp, Homo sapiens
cggagtgcgtgcaccaagaggcaaggaagcatgaccggcgaagccgaacagaagaaacggacagaagaaggcgaagacgaacgacgaaggacgaggcggccgacagaactaagaaaggaccgagaacgaacggacgacggacgaccgatccttgcgagaccctacagcaccggacccgaccgaccggaccacgaacggacgaccgaacgacaccgacacctcacaacgaccgaccggacgacggaagaacgacaagaaaaggacaccgacacccacccaccgcccttaactcacacggaaccacatgacaccgcaacccaccggacaccgaccacgacacaccggaccgacacaccccgaacacaccgggaaatcgaaccgccaccacacgaccggtgaccgccgaacgaccaccgaccagtcacgccaccgcccgcgcacaccgcccgacccccgacccgtggagacacccccgccccgacccgaccggcacgaccagcacaccaggcaacccaacgctacacgcacacgctaggcaaacccgcaacggcgaccccgcacccctacagtggccccagcagccgggacacgcccggattcgcccccagccaggcccacacgactcgccaacgaaccagcacgcgaccacccacattcgaacacacagtccggccacaccccccgcacaccccgcaccccagatcagaaagcccacgcatggacacgccaactacccgggccccgaacccgtcaccccccgcacgggcaagacccgccagccatgacccccccgggacggcacccgcacacccgcaggaccgtcatgcaccgcccagcagggacacgcatcggacaccggaacttaccgcgcgccgcccgcacaccccccccccgcgacgcaccgccc

SEQ ID NO: 503635 - DNA, 360 bp, Homo sapiens
gctcgaccaagagcctgtgaattcttaatattgtgaagtttgttctcaaaaaagcggagggagaggccaggctctgtggctcatgcctgtaatcccagcactttgggaggccgaggcaggtggatcacctgagatcaggagtttgagaccagcctagccaacatggcgaaaccctgtctccactttttatactaaaagtataaaaaaattagcctgacgtggtggcgggtgcctgtaatcccagctacttgggaggctgaggcaggagaatcacttgaacctggaaggcggaggttgcagtgagccaagatcacgccactgcactccatcctgggtaacaagaacaaaaaactctgtctc

SEQ ID NO: 503636 - DNA, 406 bp, Homo sapiens
  misc_feature (49)..(49): n is a, c, g, or t
  misc_feature (96)..(96): n is a, c, g, or t
  misc_feature (105)..(105): n is a, c, g, or t
  misc_feature (273)..(273): n is a, c, g, or t
  misc_feature (374)..(374): n is a, c, g, or t
  misc_feature (389)..(389): n is a, c, g, or t
  misc_feature (399)..(399): n is a, c, g, or t
gcagcaccagagggcccttccagtggatgcacaccaggcccacggcccngaagttccagacagacagcaagagggtggggtagtccaaggccacantgtaggtcntgagcacttccccaaggtagaaataggtgaagaggaacagcagcatcagtgaagacatgatcaaccagccatggatgaacttgtagcagcggaacttgtagagcacatccaagaagatggtcataaccacgatgacgctgatcatgatgagggtattcagcacggagnagaggaggcgctggcccacagagggtgtgtcctcagtgaaaaaagtgtagatgagctggccattattctctgtggagaagcgcacagacttgatggtggcnacataatacgatcangcacagaggnacaggca

SEQ ID NO: 503637 - DNA, 282 bp, Homo sapiens
ggaggcagatcgtcacaagggccggttgaagactagcctgagaaacatagggagacgtatctataaacaatttgtagaattagccaggtgtggtggcacatgcctatagtcccagctactcgggaggctgaagcagaaggattgcttgagcctagaagttcaaagctgcagtgagctatgatcgctgcattccagactaggtgacagagtgagactgtctctcaaaagaggggaaaaagaagacaaaaggcagcacatctgtgtgttctgatacggttttga

SEQ ID NO: 503638 - DNA, 1019 bp, Homo sapiens
  misc_feature (290)..(290): n is a, c, g, or t
tgacaattgacgtggacaaatcagtgtggttcacagccacagcaaagcttgggtcgtcaaatgccccatacgctgtcctccctagtgagtagttgattgtccatggaactagttggctgcgtagttacgttcagatagttgcatcatactgcccgcgagcgtcatgccgtggcgtgtacgtacagcaagattagatactagtgtatcagtatagtcattgccccggattgtttcaattagtatgtctcacacgaaatcgtgctcatggggctcaagtgatcggctccatnggccttggagccttttctatttctatattttcttcttggagagagtcctctatgttggtcacaagtgcgttgaaatgttgcatgtgtgccaccccaatcacaaacttcaacttgagaaacgcctctcaaaatgtatctcctttccgggggcctaaacaggtagaatacctaaacgccgggcgctccacggaccactcacctagagagctactcgcctgggagaatcattacaaaagacccctctgtgggacccaccacaaagggcctctgggggcatcacatcttttttacagacacgacaaatcattttgtgccacaaagacattttacgcggcgaggggtgctccagcgagggcgcgcatccatgtgttgcgcaccccagaggggttgcgggacctacagagaaggacacttccatgtgggccccactacaaacgaggtgttggaatctccaaccacccgctggtgaccccgatatgatggcgcacaatagcgggcatattcaagcgaacagggtatgggtggtatgaacagcccaccatatagcagcaaaacacagacacggacgtttatcctcctttagcgaacgccagtcgtatctaatactaaccaggaaagcatcattgcgcgtcctctagtacaggaaacagtactaacgagatatacaactgggaagggtaaaagtgtgtgcacacctcgtcgcttagaggggcgagcatatatcaactt

SEQ ID NO: 503639 - DNA, 581 bp, Homo sapiens
gcgcagagaaagacagatactctatcgccgacctcaggtgtcatgattggtcctgtgtggcaagtggtctgggctcaccccatgtacggaacatcctggcatcgtgctcctatgaccggagatgtcattatctggagagaggaaaacggcacctgtggagaagagccatggagacagtgcaggagacacgagctcctcagttgaactcaggtgtgctaggagccctcccatgactacaggacatgatcctgtgccgtgtggtgagctcggatggggccatctccctgtctgacttacaccggggaaggccaatgggaagtaaagaagatcaacaacgctcatcaccattggcgtgcaatgccgttcagctgtgagcccctgcatgttgtacctggaaagcctcagtagaccacccatcgggtgcagaaacccaacttacatcacagcaggtttgcgatcacggtggctgtgacaacctcatcaatgctgtgcgaaggaggaggaggcacggcagtggaaggaggagccgaagctagaagcgcacagtgactggtgttcgagatgtggtctggggcccccct

SEQ ID NO: 503640 - DNA, 652 bp, Homo sapiens
caggctgccggcactgccccattccctggcctggtttcctaacctcttcttcctcccctgccctgcttcccttcctccaccaccctgctctcaaaggcctcctctccagacccctggaagggaggcttccccatctttagttttccactctgcccctgggggagcacccttctactcctagccacgtcccttgtggaccggtgggactggaggaggaactggtcaccctcctcccccatggaggtttccagggtgtcccccatgtccatgaaagagggtgagccgaggatctgggtcctggggtcggaggtgatgagggcatgcaggccctcagccgggctgtgcaccctcccagccccaggcccatctgagggaccaagagctgtacgcaggccttctttccagctatagcacttcagcatcggtcttcagcagatcaaacccctcagaattgcagaggaccgtcccctccaaaagtccctggcaggttgggaccccaaactaaggaaagcaaacagtagcagctgtccatttgctgggagaatcactgtaccctgccccactccctccatgtcatcaaaactaaatctggtcatcagctcagagcagcttatgagtttgctacatccgcctctgctgctggacgagcggt

SEQ ID NO: 503641 - DNA, 447 bp, Homo sapiens
tacaaaaccggtctgcgggcaaataacaggacctgcgatgtcataacttgatgtctagtctcatagttgtcacaaaccataaattagagtcagttcatagttgctgtaattggctatcgaatccaagaatagggagacaatctaaaaaatatcttaggttggagataacagaaatatgatatgattagaagtggaaaaagaaattctgtgaatgttaattaaagtaaaatgattccctgaatggttagatattgtcacctagcaggatatgtattactttactgcaatgttatgatgggcttgcacttagtgagtattctatgtaaaaatatatatgtatataaaatatatattgcataggacagccttcggagtttaggcttagagcagtttacatctgaagtgtctaatgcattccctttggtaaggtactgacactgtcaacgt

SEQ ID NO: 503642 - DNA, 124 bp, Homo sapiens
actaggtttactcagcaaagctctactgagtaactactacgtgctggcacaggacagcacccggggtcagagaaaagttcaccctgtgttcatgaacactagttccatgctagattcagtggca

SEQ ID NO: 503643 - DNA, 1087 bp, Homo sapiens
cctgactcgccctggtgcggtccgctttttggattgtcgtttgtgtctcttccttcttcttgtctttgtactttgcctgtctttgtattgctggtctctgtccgtatctttcgtgttcttttgttcctattgtatcgcgcgtctgcgtgtctgtgttttactttatcggcttcccagtatctgccgggtcagtgtgagatttttgttgcgccgtgagtctgcccgcatctccatttgtcgtgccctagtatctctgtcttgctatcagactcagctctgcttttgttacccctccttacgtgcattgcctgtcttttcctccaagtctaagcctagagtactgtaacttcggtgctccttgctggcactaatgtgagcacttaatggcaggttagtgcctgttagatggtcgccgttattctcccgaattcctctctttacccagctcacagccccgttgtcacgctgtcccagacaattcccatctcaatgctctcggaggcatttagacattattgacacaatattcttatgttatgtagccagttgtgcactttctatctcgtgttcccgaaccccaggaaaagtttttccttatccattagtgtgttttcccagtccgcattcctcagcttcttcacaggcactcctggagatatgaaggattactctccgatatccctttcctcatcaggctcttgactacgttggaactgggcatctttatgtgtgccgcttgtttcccaatcagactgtcaagaagaggaaagcggacggaaacctagcagaggaaagtgtaattttggtctatgacctcttaaccccctagtcagacagaagcctaaaatctgtgaagacagaggttaggagtagatattgattactatcataattcagcacttaagctatgaggccaggcatcatagctaaactctcacctacattatctcacttagtcctttagtcatccttaaaacaactctgtgacatacatattatctcattttacacaaagggaagtcgggcatggtggctcatgagctgtaatctcagcactttgggaggctgaagtccgaccggatacctg

SEQ ID NO: 503644 - DNA, 150 bp, Homo sapiens
ttagaggatcctatccccggctctgggtagcgaagctcaactttagtcagcccatgggaagcaccacatttggaagggcagggctgatgggtgctctcaccatcgctcttctactatgaacccccctccccatacccaggacccgggtat

SEQ ID NO: 503645 - DNA, 768 bp, Homo sapiens
  misc_feature (368)..(368): n is a, c, g, or t
  misc_feature (424)..(424): n is a, c, g, or t
  misc_feature (768)..(768): n is a, c, g, or t
accgcgcgcgctgtgcaggtgccggccaggtcgtctggcgggacgaccttccccctgtgcggtctgcagacagtgcgactgcgctggatactgcgggtcatatggcctatggggactgtaagtaagattgcagagtagacctgaagcatggatggacgtgtatcaatcagtaggttctcgacgaatgcctcggagagtccacaagcatgttgtcgacgagtccctgccaaacacaccgtctcatgggtgtctagagcaaaccgcctatgggtcatctaagccatctacgttgcttggtgctcctggtcaacaaatggatgagtacttgtgagcgagatctatccgcagaacgcccagcgcacgaacantagattcataggcacaacggcacgtatcagcaacagagcagtcacacggcgctccnttcacaaaaactttggggtccgattttttggcgtaccgccgaaaacttggcttggtccccaaaggcggaattcggaagagcccaattggggtcccatataggcccaaaggtagtttccaaattccccctccttggggaactttggtggttttggaacctttttggcaaaaaaccttgtggaaattcttgtgggcaaggaaaatgcccccatcgcggggttaacgctgtaccgggcaaaacacgtaggcaaatcgttgtgaacgtcacatatgtgcatccaattggcgtccaattgtcgtgcggtcgcacctaacaagtggggctagatgtccttcccctgtcan

SEQ ID NO: 503646 - DNA, 974 bp, Homo sapiens
ttcttctgttcgctgtgtcttgttgtgtgtgtgtgttttttctctcttgctgttgctgctgtctcgtgtgtttgggttctttggtgtgcgttgtggttcttctgtttttgtgtggttttcgtgaggcgcccgatcggctcctcgatcttcgcagggcggggggggggggaggacacaatgtccttgcgattaggcgggtgtatttacgcgaggtgttttttacagagctgtctttgtttttccaccgacccacactgtttttgtgtcccccccaagattaaggtgctgcgcagccgttttgtttggcccctgccccccctgtgggggtataaccgcgggcacaaagtgatttcatgccgctatttccagagaactggggcatgttttccctcccccggtgtggtttttctccgggtctgtcgtggtaaccattgtttcccgagtgggccgcctcccgctgtgtgcttatggtgagcttctgtgtgtcggggccgcccctggggtctcctaaccttggccccctaccgtttcggggttttgtcccccccacgggtggtcctaacaaggggttttcccctccaagggtattccccgacgctctcactcggggcgcttttcctcccccgcgggcggtcctcttctgggtttgccccggactcctcctcaacaaaggaatagggggctagggacccccttcgttgggaaatgcgagctctcaaacattgttttggtaaacaccctgctttttctgctcccatggctttagatgaattgtctcctcgatttaccccttagtagacacccgtttctccccttttaaccccccttcctgataattcctttgtataagaggcaggcaccccttctacgaggtttagaacaaagtgtaaaaggaataatatatcattagggcggtcctcctcgctctccatagaaaaaacaactataacggccccaacaaataatcaaacaaa

SEQ ID NO: 503647 - DNA, 494 bp, Homo sapiens
cccccttaacttcaaggtcctttcctctcaccatggtctcgtattcaaacggttggggcacgtattttccttctctgggaggggccaccacaccttcagggctcctcctcctttgtttgttggagaaccagggctcttcccaggggtgtaggggactgccaggctgttccagccaggaaggccaaaatcaaggggtgagatgttgaaagttgtaaaaaagaaaaagtggggttggtgaatcggtttttccttccccaaattgggatgattgtcataaggtttttagcatgttatcttctttccccccccccccctttttttttttataaaaaaaaagaaacttcaaagttaatggggtggtcggatcccacagggggagaactccttcccccccaagcatttaatgaaaaaggtgcttttttttaaacaaacaaaccccccccagggtggggggagtttcacaaatctttcaaaataaaaagtaatgccttggg

SEQ ID NO: 503648 - DNA, 487 bp, Homo sapiens
tgaaatggggagtgtatccatcagagtaaaagaactacgaggagaaagcacatgattatcggcaatagatgcagaagaggcctttgacaaaattcaacagcattcatgctaaaaactcttaataaactaggtattgatggaacgtatctcaaaacaataagagctatttatgacaaacccacagccaatatcatactgaatgggcaaaaactggaagcattcccttcgaaaactggcacaagacatggatgccctctctcaccactcctattcaacatagtattggaagttctggctatggcaatcaggcaagagaaagaaataaagagtattcagttaggagaagaggaagtcaaatcgtccctgttcgcagatgacatgatcgcatatttagaaaaccccatcatctcagcccaaaatctccttaagtcgataagcaacttcagcaaagtctcaggatacaaaatcaatatacaaaaatcacaag

SEQ ID NO: 503649 - DNA, 1110 bp, Homo sapiens
  misc_feature (628)..(628): n is a, c, g, or t
gaccagcctggtcaacatggcgagatcctggctctactaaaaatacaaaaaaattagctgagcttggtggcgggcctctaattccagctactcgggaggctgaggcatgacaatcacttgaactcaggaggcggaggttgcaatgagccaagatcatgccactgcactccagcctgggtaatggagtgagactctgtctcaaaaaaaaaaataaaaaaatctcagggtaatggggatttcttatcccctgaaattttttgtcttctttttactacttacccaaactctttagccctcaaagctgaacaacaattttctttttcaaatttaaaaaccattcattattaaaagggcccttcttttataggctctggaacctgaaaatttcttgtgaattatttacccattacaagggaatgtgttagtctcaaattttctttcatttgtgcatttaaaaattaaaaggcgtattattcagcccgggaatgcgggtggcttcacgccctgtgttaattcccaggtgccttgtggagaaggccaggggcccgggtggcattccctttgaaggctcaagcaagttctggaagacccaggccttgtgcccaaatatatgtgcgcgtgcaaaacnccgcaattctctctatagcttaaaacaattaccaaagacaattttaggctgtggggtgtgtggagtggcgagggccattcttgtatagtctccccaaggtatactctgtggcgagaggcgctctggatacaccacgcgaaagaatctcagccttgtgtaaaccctttgtgagaagcgccgcgaaagtgttttcgccacgtttgaacccacaagcagattcggataccgcaattgtgttacttcccaggcctgtgtggacaaaccaatgaaggcagaaaggaacttgtgaggttcctcccaaaaaataatgaacgtcgttcacagcaagctctcttgtgcaaaaacccccatttttttaaaacgctggggtaattaatacgtgggcgataaatgacatgagctcaagggtagctacacagtgttatagtgatacccgaataatttctcagattactcccagtgtttagatttgtagaacatac

SEQ ID NO: 503650 - DNA, 905 bp, Homo sapiens
atgaaatggtccataacttagtggcaatctgacactggtcttatatcaatcgacaataacatccagacttcgctgatgcttgtggtgctactgaacagtaatatagaggaacataggagaaacgaggctagccagagaattaccttcagctgtatcacgatgacaagtcgttctaaagttccaaggtgctttggcacctgcctcccaggagccctcacccggttgcttcgtgttgaggctgatggcaagttaattacagggacaggaggaagagaaactaacgaatgttagcatctcggagtgtggtggggttggagcatggtgtacaagaatcaacgcgataggcgaattggtatgaggaatgctggagaaacttcaaaagctgaagagttattagcagaagaaaaagtcatgagagccaattccaattagtgccaggccagtccacaataaaggtcatgccgtgaacctgctagatgtgctcagtaccatgtaagcacggacaaagctattctgcgtcgggaaacagcgagatggtgaggttcatggagacgcacgtcagttagcatcatattttctcattgtcatgacacagaatattcaagaacaggtggtgccaaaggcagtaatgcattatgcggccaatcatgtgaccgacactcttcagagtgagctagtagtgcccggctgtataacatcatccttattgggatgatcttctgaccagaattttgaggacatggcacagcgcacggaaagcaagccggtggatatgcctacgggcgtttacaagggagccagtcgaaattaatggtcgagactcggggagaactcatctatgggtgaaagaaaatatgtaatactgagaacttcgtagaatcagaagttcggaggtactggctaac

SEQ ID NO: 503651 - DNA, 115 bp, Homo sapiens
gatcccctcccaaggaataagaaattgtagatactgacctgtaaatcatacctttatgagtaacaatacaaatgactatatgggagtagactcatgaagtgaagaatgcacaaga

SEQ ID NO: 503652 - DNA, 599 bp, Homo sapiens
taccattttccttaacatttgggggattttgattcccccaaatgttagggtttttggtaaaaaaaaaaaaaatcggggatccccatgttttaaaaaacggtgatcccaaaagaaggtatacaacaaagtatcgaagcaaaacaggatacacaatagagagaccaccgatcgaaataaaccaagaagcagacgcgacaacggaacacacacaccgaacaggaccacggcaaaaacacggaacaaacgcaggagacatccatagacaaagaggaaacacaaaaaacaggcggaagacgacaacaaaacccaggaggagaacacagaacaggcaaaacagaccacaaacggcgacacaaggaaaaaatcatatataaaacaaaagagcagccacaaaaaaagcgggagagaaaaaaatagatataaaaacgtatcattgataaacacaatgagtatattacatagtatggtgataataaaaatacaattgtgagataattaagaaatgagagaggagaaacaaaaaaagagtaatggtagaaaaataaagaaagatagaaatgaatagtagagaagaactaaattattataaatgttagtca

SEQ ID NO: 503653 - DNA, 203 bp, Homo sapiens
attaaaagtcacccgcaaggacacctacaacaagctgaaaaccaaggatgagcccagcggaaacgctaaaagacatccacttatgcgttgaactgctgtggttatggctggggcgcgtagaaacaagtttatctccagacatctgccccagagaaggacgtactctaaaaccttcaccgtgaagtcctgtccatgatgccatc

SEQ ID NO: 503654 - DNA, 1085 bp, Homo sapiens
caagaaaaaatctccttttggagcccagcttggaagccaaaagacaaactgttttagataagtatgaattacttacacagatgaagtccactttcgaaaagaagatgcaaaggcagcatgaacttagtgagagctgtagtgcaagtgcccttcaggcaagattgaaagtagctgcaccatgaagctgcaggcaagcacatctgcatacatattgccagacagcacttcttggagggcaaagcatggaacatcagcatgcattttcgtccagtcagcattcaatggcaaacagcagcacaccaatttgcccactggtcagcaagcagccaaggcaagcagaacacttcagacaggcgcatcagacaatgcaacagcacaatttacagtgctcccactaatcagcattttccctggcaaaccatgacactgcacaagagcaggcaatggagacacacaaaccaacacactgttcttatcttctatggcattgcaaacatggcatttcatcagtggctaaattcacagatatcctatatagattgtatacagaactgagactgatttggtaccgattagaatgattgctatgatctttgagaaattttactgcaatatttgcactgaaatgtttatatatggttgataaattgtatcatatagagattcactgctagattactcttagcctggattaaaatgcctatgcatgtactttttagactagatttataatattctacaacttcatctcacatttgtatgtggaacttgaagttccatccgcatcagggatggattacaatatagactctaaccccggccccagaactaatgcgcgacatggaaggaaaccctaacagcacagcaaagaggaaacacgcgtagagagcgaaaacgacaaatcacacgtaagaacaccacacggaatggtaacaccaaagacacataagccacacaccaagaacaaacaacagggcgccaacaccccagggcacaagcgacccaccccaagcccaagacacaaaaagacgcgaaaaacgccggacaaaaagaaacacaggaagaacccagacccggtgacgaac

SEQ ID NO: 503655 - DNA, 179 bp, Homo sapiens
ctaaggatcccgggatcggcaaaggcaatgtttctctccttttctctcttattacttctttcctatggcattttcacattgaaatgctttcctatggtgtaggttttattctccccctacccctccccttttctctcttattacttctttcctttggcattttcaatttgaaatgcttt

SEQ ID NO: 503656 - DNA, 413 bp, Homo sapiens
ttatattttagcaacgaggaatgccttatttcttagtggaggtttttttattgtgttgtttgttcttctgttgtgtgtttttttgtttgtgtgtttttgagacggactcttcctctgtcgcccaggctggagtgcagtggcgtgatctcggctcgctgcaatccctgcctcccaggttcaagcatgtcttctgcctcagcctcccaagtagctgggatagcaagtgtgcaccaccacgcctgattttttgtatttttagtagagacggggtttcacctcgttagccaggatggtctcgatctcctgacctcgtgatctgcccatctcggcctcccaaagtgctgggattacaggcgtgagccaccgcgcccggcccccagaatttcttaagaaggtaaaaactctgggctaaa

SEQ ID NO: 503657 - DNA, 632 bp, Homo sapiens
  misc_feature (215)..(215): n is a, c, g, or t
  misc_feature (469)..(469): n is a, c, g, or t
atgccaataacctccaccctgggcgtagttgggttccaaggccttcccaggccacccaaccaaacgaacacaagggttaccgccatgaatttcaatctcttctcgatcatcgctgcttctgctgtttccgccaccgtggacttgcctgccgccgccagcgtggaagtcaccggcaaaaaatccaatgtcacggcttatactcagaagtacctgcnacagagtgccaacttttatgcggcgctggatcacaagattcaaaactgattgtcgagggattcaaaccccaagccactcgcgagagtgccttggggtttgacgtatctagctgatggtcaatatccgacgcaaggattcattcaggtctattgcgcgcgcgcgggtgaagctgcttgagatcacgtaatagaactcgaagctgtagcctttgaactggcgcaattgttcccagtaaaacagctgcttgaccggngcaccgacgggccaggattggccaacgacttgtgtctcggtatggaggatcacctcgttcaacccttttacaagtcgaaagatccacagaatctcgtcggtggttgccgccaggcatagtaggggaggttattgcatggatcctctaggtacctcagacacgc

SEQ ID NO: 503658 - DNA, 163 bp, Homo sapiens
cacgaggatcaacaccattaatacatcatcaaggtaactcaaacgggctgtcacaaggatcctgccagatcctgatgatccaaatatcatcccctgttgggtcacctctaaggagcgccattgcagatgcccccatcgagatgccaggggatgaggtgcctgt

SEQ ID NO: 503659 - DNA, 962 bp, Homo sapiens
gataatcttctgcatagtaatacccatcataatcggaggcttaggcaactgagctagttcaccgtaataatcggtgcccccggatatggcgtttccccgcataaacaacataagcttctgactcttacctccctctctcctactcctgctcgcatctgctataggtggaggccggagcaggaacaggttgaacagtgctgacccgtcccttagcagggtaactgactccacaccctggagcgcctccgtagactcgtaaggccatctgtgcctccttacacctagacaggtgtctcctctatcttaggggccatcaatggtgcatcacagacaattgatgccaatataagaacccgcatgccataacccaataacaagcgcccctcttcgtctgatccgtcctaatcacagcagtcctacttctcctatctctcgccaggcctagctgctggcatcactatactactagagcagaccgcaatgctcaatcaccaccttcttgcgaccccgcggaggaggagacccatatctataaacaactacctattctgatggttcggtgcaccctgaagttgatatgcttatacctacaggctgtcggaataagtctcccatatggtaacttagtactccggagaacaagaaccattggatacataggtatggtctgagcatatgatattcagggcttcatagggtaaatcggtgagcacaccatgattttcacccgtaggatcgacgtagacccaggagcatatttcgctcggtaccagaaatcatcgctatcacaccgggtcaggatgagctgacgcgcaagggcaggaaacaatacaacgaaccggttgagcgccgggcccaagaacttttataacgaggggcgcgggaggataggaccaacagacggccagacgcagggagccaccagcaaaagggggagaaagaaaagtgctcggcagacaaaa

SEQ ID NO: 503660 - DNA, 458 bp, Homo sapiens
  misc_feature (12)..(12): n is a, c, g, or t
  misc_feature (84)..(84): n is a, c, g, or t
  misc_feature (193)..(193): n is a, c, g, or t
aataaagcaaanccccacccccaggttagcccccccgaagtagctgggacctataggtgcaagcccacccatgccctgcctaanttttcctaattttttttttgtaagaagacaaggttttgcccatgttgcctcagttggtctgaaaaatcccagggccaagcaatctgcacgctactcccggccttaaaancttttgtgccctggcgtggtggctcatgcctgtaacaataaggtcaggatatcgagaccagcctgaccaacatggtgaaaccccatctctactaataaagtacaaaaattagccggatgtagtggcgcgtgcgtgtaatcccagttactcgggaagagaggcaggagaattgcttgaacccgtgagatggaggttgtgatgagccaagatcacaccactgcactccagcctgggtgacagctaaactgcgtttccaaaaaaaaaa

SEQ ID NO: 503661 - DNA, 505 bp, Homo sapiens
  misc_feature (501)..(502): n is a, c, g, or t
aaactttcttttatttacaaggttcgttgcaaaaagggacttccttgtctcagacaaaataatgaattttgacctttgaatgaatgctaaaatgagttaagactttgggaactgttggaaaggcataattgtgttttaaaatgtaagaaacagaagatttgggagggaccaggggtagaatgatatagtctggctctgtgtcctcacccaaatctcatcttgaattgtaaaacaaattataatccctacatgttggggaaagacctcatgggaggtgattagatcatgggggtagttcccccaacctgttctcatgatagtaagggagtagtcatgagatctgatggttttataggggatttttcccccttcactttgcacttcttgctgttgccttgtaaaaaagaacatgtttgcttccccccccgtcaaaattgtaaatttcctgaggccttcccagccctgcaaaattgtgagccaattaaatctctttcctttttnnttt

SEQ ID NO: 503662 - DNA, 828 bp, Homo sapiens
  misc_feature (24)..(24): n is a, c, g, or t
  misc_feature (445)..(445): n is a, c, g, or t
  misc_feature (685)..(685): n is a, c, g, or t
  misc_feature (798)..(798): n is a, c, g, or t
gggtcacctgaggtcaggagtttnagaccagcatcgtcaatacggtgaaactctgtctctactaaaaatacaaaaattagccaggcatggtggtacacacttgcaatcccagctactcaggaggatgaggcaggagaatcgcttgaacctaggaggtggaggttacagtatgccgagatcgcaccactgcattccagccagagtgacagagtgagattctgtctcaaaaaacaatttaaaaaaaataaaaataaaaatcaccgtagcacacctgtaatcttagcactttgggtggccaaggcagacagatggcttgagctcaacagttcgcgaccagcctgggcaacatggcaaaatcccatctttacaaaaaaatataaaaattagccgggtgtggtggtgcacacccgtagtcccaattacttggggggctgaagcatgaggnttgctcgagcccaggaggtcaaagctgcagtgagctgtgtattgcaccactgcactccagcctgggtgacagagtaagcccctctctcaaaaaaaaaaaaaaaatagtaatatataataaagatttactaagttcagggcggggcatggtggctcatgcctgtaatcccagcacattggccaaggcaggcagatcatttgaggttaggagtttgagaacagcttgaccaacgtggtgaancctgtctctactaaaaacacaaaaattaaccgggcatggtggcatgtgcctgtaatcccagctaatagggaagctgagacaggagaatcgcttgaaaccaggaggcagaggtncagtgagctagattgtgagattgcgcacaa

SEQ ID NO: 503663 - DNA, 358 bp, Homo sapiens
tggtccctagacccctttgtatgaccgtttgcagtctgagcaggccaggggatgacagctaatgtcaggaccctcatcggtgtagcctgctggggggacccaagtgctcttggacaagtggttgagctcctatctggcctcctctatttgttatttgtcaaggaatttgtgtgcatttcttcctgcttgtattgaaaaaattcctagtatttcagtaagaatgcctgttgttagatgagcctcctgtatcttcaatgtgttcttttttgagcgctcagggagaatttagcatttttttttttcctcccacctttttgtctctgtgacagttgttaattgagtttgcaaatgctttcca

SEQ ID NO: 503664 - DNA, 258 bp, Homo sapiens
gcctgacctcaaatgatccgcccacctcagcctcccaaagtgctgggaatacaggcgtgagacccgtgcccgaccagtgtattttatatgtggctcaagacaattcttccagtgttgctcagggagccaaaatattggacatccctggaaacactgcataccttgaaattgagttttaccgcttggccatgttagagtttggaaattaaggtctacgcacgtttttctaatctctgtaatgggtaatggtgccagagg

SEQ ID NO: 503665 - DNA, 317 bp, Homo sapiens
gtatagctgaggagggaacagggaagaaaaactctaaagatgtcacctttcaacaagtttttaaggtgatacattgatgtgatagtggctaaaactaagaatggatcaattatttttacttgttttttttgtttttatttttttgagaccgagtctcactctgtccaggctggagtgcaatggcttgatctcggctcactgcaacctccgcctcccaggctcaagggattctcctgcctcagcctcccgagcagctgggattacaggcaccaccactgcgaccggctaatttttgtatttttggtagagacgggggt

SEQ ID NO: 503666 - DNA, 694 bp, Homo sapiens
  misc_feature (65)..(65): n is a, c, g, or t
  misc_feature (73)..(74): n is a, c, g, or t
  misc_feature (78)..(78): n is a, c, g, or t
  misc_feature (85)..(85): n is a, c, g, or t
  misc_feature (147)..(147): n is a, c, g, or t
  misc_feature (151)..(151): n is a, c, g, or t
  misc_feature (155)..(155): n is a, c, g, or t
  misc_feature (165)..(165): n is a, c, g, or t
  misc_feature (168)..(168): n is a, c, g, or t
  misc_feature (200)..(200): n is a, c, g, or t
  misc_feature (207)..(207): n is a, c, g, or t
  misc_feature (212)..(212): n is a, c, g, or t
  misc_feature (235)..(235): n is a, c, g, or t
  misc_feature (259)..(259): n is a, c, g, or t
  misc_feature (274)..(274): n is a, c, g, or t
  misc_feature (279)..(279): n is a, c, g, or t
  misc_feature (316)..(316): n is a, c, g, or t
  misc_feature (331)..(331): n is a, c, g, or t
  misc_feature (343)..(343): n is a, c, g, or t
  misc_feature (348)..(348): n is a, c, g, or t
  misc_feature (363)..(363): n is a, c, g, or t
  misc_feature (456)..(456): n is a, c, g, or t
  misc_feature (530)..(530): n is a, c, g, or t
  misc_feature (598)..(598): n is a, c, g, or t
ttacaatagtaattcagaatatctcaaatgttacattgatgtcatcaatattacaaaaaaggaanaaaaagtnnctangcaacantgaagagcaccagagacccagcgcacacctaaagtagaccatgcttctttccttccactgcnaggntatngtcccgggangtnccccaccccctcgctttcgtcctccgctttcnctaatcngtctngtgggggcatctacgctttgttntcgctctccttctcctcgaactcnccttgttcgttggcngtggngtcctggtactgctggtactcggacaccaggtcgttnatgttgctcttggcntcggtgaactcnatctngtccatgctctcgcncgtgtaccagtgcaggaaggccttgggcgggaacatggcggtgaactgctcggagatgcgcttgaacagctcctggatgggcgtgctgttgcngatgaaggtggccgacatcttgaggggggggggggggatgttggacaggggggtttttacgttgttggggattnactccacgaagtagctggtgttcttgttctgcacgttgagcatctgctcgttcaccttttttatgganatgcggcgccggaagatgggagccaccgttagtagcgggcgtggcgcgggttggaggcgggcatcatgttcttggagtcgaacatctgctgggtga

SEQ ID NO: 503667 - DNA, 144 bp, Homo sapiens
  misc_feature (33)..(33): n is a, c, g, or t
  misc_feature (41)..(41): n is a, c, g, or t
  misc_feature (64)..(64): n is a, c, g, or t
tgtcggtttaaggtacatggtagagcgaacttngagttacngtgcaagatttttttttcatgcngtcattggtaatatgtttggtgagaatcctggggattaaagtttgggttacaaatggttttttaaccgacaggaccatgg

SEQ ID NO: 503668 - DNA, 1248 bp, Homo sapiens
gcctcattgtacccattctaatcgcaagggcattcctaatgcttaccgaacgaagaaattctaggctatatacaactacgcaaaggccccaacgttgtacggcccctacgggctactacgaacccttcgcgtgacgccataagaacgtcttcaccgaaaggagcgcccgtaagagagcctgccacgatctaccatacaccactcttacgatcgacctgagcccgtacgcattaagcgtcgtgcagcgcactcgcgtcattgctcactatgaagccccacgctccgccaataccacaagccgccactgggtgcaagcgctcaagcgcatatgcgacctctcctattcgagtgtctacgacgcagcgctcttagacctacgccaggaatacgtcaagtaccgtcatgactcagtgggtgagcagtcagaacatcagagactacgccactgaatcggtcgcgactgcagagcagaaaggccagaagaagtctcatatgacagtcagcctagacatcatacgtaactatacaagcattactaataagtggatccattgaacctctcgacgccttatcgacaacgagcaaagagcaagctctgattacctccttgccatccatgactccattgggccataatatgatggatcgtccagcagtaagcaagaagacccgaacacgaaacacccactttcgaccgttgacccgacgggggagatccgacaataagttctcaaggacattcaagcaatcggaaatacgccgacaggacccctttcggccctatactttccattagaccgaaataacagcagacacattaattacttcaagtgacatacaggccaatcgaccgaggttagcgaaatcaataccatcagggaaccacagcatatgaccgacaagtgcttcccacgtggaaagagtcttagcaagcaacgaataagttagtggtggagcgaaggaacccgtaaccatttgcgtaagaccagtccccttggtagcagttgaatgggcaagtttcgtgaaaacaaggcagtaaaccccgcggaaggtccgaggtaacgagaccaagagtaggataacgaccatgccgtactggaaaacaacaagttatcgctaaccaagttgaaacataggcaataagagtgatagtaagaaggggtatccaagtaccctataaacaaagtctccagagaatataccacgatcgcagcgtagaaaaagagaaaaacagaggaagaaacacga

SEQ ID NO: 503669 - DNA, 345 bp, Homo sapiens
tggaaatagaaggtttcatctgcattgtttaaacttctatagtagatactttggcattgtggataacacttgtagactattatagctatgtgaataagcgtgttgcataatgccctttttcatctgtttgctcccaagccccaggatgacacacttcatgtcatagctgaaccctactctaatggattcgaggccagtgtatgcaatttaaagaagcagtattatgtttgcagatattctgagtctcttcaggatgtgtttcgtgcctaccatatatgcaggataaattctttaacagcaaactccaaaggaatgttgaagctgtttcagcgatgaggatttttt

SEQ ID NO: 503670 - DNA, 479 bp, Homo sapiens
  misc_feature (450)..(450): n is a, c, g, or t
  misc_feature (463)..(463): n is a, c, g, or t
ctctgtgtatctgggtccactggtcaccacacccagttatttacttttattttttttgtcgagatgggatctccctgtgttgcctatagtctcattcttgatgtcctgggctgcaatgcgagctctcccacctcatgctcctcctcaaagtgctttgatataaaggcatctggtcgatggtggacttgatgaatgaatcttctggcacactctggagcaactccagaacacagtcgctgagtgataactgggaatttactgataacccgtggaatggtagcctttaaggaatggaaagagtggataatatatgcctgactgttctccaaaaataaggaccttcatataggagctgattgaaatcaatgactacttgcatgttaccacttcatttgggtggaatacttcatcagaataaactattgatcttgtgctgtgtcaaagtaacantaacgcgaggggntgcagaggtagcactt

SEQ ID NO: 503671 - DNA, 1179 bp, Homo sapiens
  misc_feature (1164)..(1164): n is a, c, g, or t
  misc_feature (1179)..(1179): n is a, c, g, or t
agcggacatgacaatatcaacggactcgtcttccgggccgatggtgctagcgtgcatgcgcgccgactctagtggcggaagtaccagtgacggccatcccgcatccctggaggggcacggccctgtaagctggaaccttccaaccatacgatgatccacagccatagctctccggaaagctggtgaacgaagcatgcggcgcagcggagcacggagcagcgccttgtaccggataaatgttgggcaacgccagccaggatgcgctgctaagtgccctggtccagcggtagccttggtccatcccatgcgacagtgggctgtttagggcgcgactagctagttcgcctatggtgcgtggttgttgtgccatatcgtcttgtgcgttcttctcagtcgtgcctcaaggaatctttgagccaccgcctaagtgttgtgctttggcctattcccacctcatgtctatcgaacaccaatagtgaaacttctcttgtgctcccatggaaggccttctccatactagaacgtgcaccgcacgcgagagactacttgcgttggtacgcaacatcgtgcactttcaccccttgtggttcatgagaaccccacactgcacgtgtctcgggcgcttgtaaagtggcgtgtacgctatacgaggagtattgatgccgagttcagatagcccaagaacctaagttgcaatgaacttggaggggaggacgtcagagggggctcgcattacttgacggaaatggggaacagatatgctcgccaagtaagagcgattgtgggggcgccacccactcaaatttgctcgtatactcgaaatccacgttatctttgcgcaacacgctagacaaccttacccatttttagggccccagacttggagcgacgtaaagatgtttgcatcccctccccaatttggggcttggtggacctctccgaatttgcattcaccttccaaataaagggcctcgtgagttgaaggcaaggcggctccgtaataacgccctagtcccataaggacacaattacgggcttgaacgaatgggcgttagagacccaaaattttggtcggccaaacgaagttggcggaaatagccggccccggaaacctctttgaggttttggtggagcggagaatttaattctccttttggaaccaangccacgacccctggn

SEQ ID NO: 503672 - DNA, 90 bp, Homo sapiens
aaatgtagctttggtataacttcatgtgtatctcaaaatatcctgaacgtcaacatgatttgaatacagaaaatgtattttctacttgca

SEQ ID NO: 503673 - DNA, 102 bp, Homo sapiens
cccgctacggacgcacgaacgggcttactggttccagattccccacttgtgtcacatggcatagtgaggcttgttttccaagattgctggttttaatttgca

SEQ ID NO: 503674 - DNA, 1056 bp, Homo sapiens
  misc_feature (442)..(442): n is a, c, g, or t
  misc_feature (737)..(737): n is a, c, g, or t
gggtggcaataatgccacgcgccaaaaaataccacagagggagaaatttttcccctgatgggatctttctcaaaactgacctggaagggatttcttactcggggactttgctttaaaatggcctaactcctggaaatgaaggttccggagttatcccccccacccacggcccacgaattccattagtcttagccccccacggaacaccacgaaatgttccgtggtgaaaaagggtcccctcccgatttttcgggaactgactgcttggtagttcacgaaagaggttttggctctttccacgagggcacaatgtagagactttatgctcgaaaaaggtggcccactagaggttctgtgtggcccattggccacacggcacgagtctctctgcgcgcttaacacaaacctcccttataggagagggccttgtctctgtttgtcnggaagggcccctgtcatatatggtggttgcttctccgggttctaatcacatggagagaacatggggccaccacaaaaggccctcgtccgagagagttcttggtgttcttgggagaaacctctcgagggaccacgagggggctataaattccactgtaaagggttttgttgtgaatgtgccctcgagatgagattcccccacgccgcgaggaaccctcggttataactatactatacgcttgaacacactgctcgttgcgcccacacgctgttgtgctcaagaacacgggttttcntgggcacttccaaggtgaagattcactgctgccctcgggagaccccacactggtatagagttggcgcctatagagagcccctcgcctcgagaccacacgtgaggcacattgtggagaaccccaaagaatgaggatatctgcccacccaccccccactttcagagacacgaaagggtgggaaagccacgaggccgcctgccactgccccacgccacgtccccaccagcataaacacagggtttccttggcacgctgtattttctggaggtttggagatgttgctcttctaaagaccctttaataaaattttggaccaaga

SEQ ID NO: 503675 - DNA, 155 bp, Homo sapiens
gtgctaatcctacatctacacttggcatctattttgaagttgtcaatcatgcacaactaccccgatcccccaaggaggcagaggagccatccatgtttgtcacgcattatcagcactccagctacccagagactgcatccgcgtgaccaccatcg

SEQ ID NO: 503676 - DNA, 368 bp, Homo sapiens
caggataggcctgaaggagaagaagagattgaagcaaagacttgaaggtggccaggcgggtggctcacgctgtaatcccagcacttcgggagaccaaggtgggcagatcacctgaggttgggagttcaagaccagcctggccaagatggtgaaaccctgtctctactaaaaatacaaaaattagctgggtgtggtggcatgcacctgtaatcccagctactcgagaggctgaggcaggagaattgcttgaaccattcgggcttgaaccctggcagaggttgcagtgagccaagattgccgccactgcacgatcttgggcgacagagcaagactctgtctggaaattaaaaagaaaaaaaagtcgacgc

SEQ ID NO: 503677 - DNA, 207 bp, Homo sapiens
ctcgggcctcacgctttatcttcttcatttcatttcccggtataaggataagcgttgagagaagtataagcgttgagagaatgttaagcgttgagagaagtatgagcgttgagagaagtataagcgttagagaagtataagcgttgagagaagttaaagcgttgagagaagtataaagcgttgagagaagtataaagcgttgaggga

SEQ ID NO: 503678 - DNA, 3542 bp, Homo sapiens
cacgtggctgcagcggggccagagcagcaatggcggcgggcggcggcggtagctgcgaccccctggcccctgctggggtcccttgcgccttctccccgcacagccaggcctacttcgctttggcctctaccgacggtcacttacgagtatgggagacggccaacaaccggctgcaccaggagtacgtgccttccgcgcacctcagtggtacctgcacctgtctggcctgggcgccagcgcggctgcaggccaaggaaagtccccagaggaaaaaaaggaaatcagaagctgtaggaatgagtaaccagactgacttattggctcttggcacagcagttggtagcattttattatacagcacagtaaaaggagagttacacagtaaattaataagtggtggacatgacaacagagtcaactgcatacagtggcatcaagacagtggctgtttatatagttgttcagatgataaacatattgtggaatggaacgtacagacatgcaaagtaaagtgcaaatggaaaggggacaatagcagtgtcagttccctatgtatcagcccagatggaaagatgttgctttcagctggtcgaacaatcaaactatgggttttggagaccaaagaagtctacaggcatttcacaggacatgcaacgccagtttcgtcactgatgttcactaccatcagacctcctaatgagagccagccctttgatggaattacaggtctttatttcttatctggagcagtacatgaccggttacttaatgtctggcaggtccgatcagaaaacaaagaaaagagtgcagtgatgtcatttacagttaccgatgaacctgtctatattgacttaactttgtcagaaaacaaagaagagcctgtcaagttggctgttgtttgcagagatggtcaagtccatctttttgaacacatattaaatgggtactgcaaaaagcctttgacttcaaactgcacaattcagatagcaacacctgggaaaggcaagaagtcaacaccaaaacccatccctattctagctgctggtttttgctcagacaaaatgtcattgttgcttgtatatggcagttggtttcagcctactattgagcgagtggctttaaactccagagaacctcatatgtgtttagtaagagatatttcaaactgctgggcccccaaagtagaaacagctataacaaaggtgaggacaccagtgatgaattctgaagcaaaagttctggtgcctgggattcctggtcatcatgcagctatcaagcccgctcctccacaaaccgagcaagtagagagcaagaggaagtcagggggaaatgaggttagcattgaggaacgtctgggagcaatggatatagacacacacaaaaaaggaaaggaagacctccagacgaatagctttccagttcttcttacccagggcttagaaagtaacgattttgaaatgctaaataaagtacttcaaactaggaatgtaaaccttataaagaagactgtattaaggatgcccctgcatactattattccgttgttacaagagcttacaaagaggttacaaggacatcctaatagtgctgtgctaatggttcagtggctaaaatgtgtgttaacagttcatgcatcatacctgtccacgttgcctgacctggtaccccagctggggacactctaccagttaatggaaagcagagtcaaaacttttcagaaactttcacaccttcatggaaagcttattcttctaattacacaagtaacagcatcagagaagacaaagggagcaacttcccctggacagaaggcaaagttggtgtatgaagaagagtcttctgaagaggagtctgatgatgaaatagcagataaggattctgaagataattgggatgaagatgaggaggagagtgaaagtgaaaaagatgaggacgttgaagaggaagatgaggatgccgaaggaaaagatgaagaaaatggcgaggacagagatacagcaagtgaaaaagaattaaatggagattctgacttagatcctgaaaatgaaagtgaagaagaatgaagacagcaaagcaagccggtcaaactatataaactctggctcaccttgcccagtggtgagggctgcctctgtgccaggatgccaaggaccgctgcacatttccaaattcacagcagtggatcccatgccactttgctgtcctgagcaccccagacttgactgtgtaaataagagtgtttcattcaaatgttaataaactttacacagtatatagacacattttctgcaatgtactgacatcagtgtccaatatatggtatatttttataatataatatcctagtatgattggttatatcaagaattgacaagtgcagataaagacctttcccataggagttcaagaactggactgttgtgaagaagtcagctcttatctcaggttggtatctttcatcaaatccagatgcaaagcagcactagtgaaaatttttttaatttagtacatttaatttggtacattttcataaaatatgaagggataactacaaactggagtaaaaatgatggtaattaaaaaaaatcctcagtatccctagcttgtctattaactgtgataatctgacttgagtcagattgaatatttggagtgcttccccagaataaccacttatttttgaagctatcatgtgaagtatttttttaaaacaaaacaaaaattatggtcattaaaaaactagagaattagccatattaaggatttttcttgactgcaaattacttctaaagaatcatcagtgtatagattagaagtgctcattacctgcaacttttaaaaaaaattcagttatagctgcttttgaagaggtttccatttttatttaaattactaatggatcaaagaacaattgtttattttttctctttggttttagatattaatgataaccttgttggaattttttttccaaagaaaatatttttataattaaataatttaatgtttttcttccttttcattacctactcttggcagtgttagggtatctgtttacctttaaaatgataagtctcactcaagattttttatgtatgtataaatattttggtgtgctacaaaagcctttgcaaattatcagtagtagtttttttttttttttttttttttaaagaatgagccgatattggcttagtgctcactaggggacatgcacatggaagctcacctctaagaaagggctgggcagatggatttattttttcccacctgtgaatatgtaaaacaaaaccattatctttgagggagtttttaataccaatgacagaacagagatttgtgtgctcatcttaagagccagagccatataagcatcttgggaaagcaagtttgaaccagctgctggtgtaatgtacagttatatttgtctataaatggagctgtttatggcaatttaataccattctctttgtaaagtgaataaatattcatctttacccagtgaaaaaaaaagtcgacgggccgcgaatttagtagtagta

SEQ ID NO: 503679 - DNA, 347 bp, Homo sapiens
ggtcgacagcttcctgaccctaactacaagaaaaaaaaaaaagcctacaatttcattgcttggcttaaaataggatgtagattttaaattctttttacaggaaaagcattttttgtcccctttttaacaggtgacaattttatacactgccttatttgggcccctgtgtttttctcagcttgattttcatttttactgaagatttttcttaaagcaggtaaaaccggtttctttaaaaaaaattcattaagaaaaacactccagattgaggagcaggaaattattgcttgatagtaaggggatctcttcaaattagatgatttactcggtcctcaaagagtttctaa

SEQ ID NO: 503680 - DNA, 689 bp, Homo sapiens
  misc_feature (186)..(186): n is a, c, g, or t
  misc_feature (198)..(198): n is a, c, g, or t
  misc_feature (203)..(203): n is a, c, g, or t
  misc_feature (210)..(210): n is a, c, g, or t
tctcattatgtcatcttttgatgggcataaaattttaccaaatttttgacacctactttaaaaggatttcttgctttctaagtaattttactgttttgctcactctagggtggatacagcccaaatttcataaaatggaggtttgggaacatctttaaagtggcatatgttgtattcaacgtctanagatgttttatnaaacncaaagangtaaaattacttcagtaatgaagtaaatttactgatacccaaagactgtgcttgtctgttaagcacaagacgtaatataacatactccattcagtccctccaacccttatttttgctaaattcagtttgtagtttattgccttggtcttaaatgatttaaaggattcatttttacagacttttttttttctgtgatgtccttggtttgtcagtatgctcatcttaataatccttttattttctcacagaaagtacttcaaactaggaatgtaaaccttataaagaagactgtattaaggatgcccctgcatactattattccgttgttacaagaggtaactgactgcttttttcatttcagcatcctaatgccatgagttaaatggaaaattcagtagttagagaaatggatttgtaatacgtaaggacacatggcatttagagtgagtaatggatggaggaaagtactttagacaaaa

SEQ ID NO: 503681 - DNA, 3496 bp, Homo sapiens
cacgtggctgcagcggggccagagcagcaatggcggcgggcggcggcggtagctgcgaccccctggcccctgctggggtcccttgcgccttctccccgcacagccaggcctacttcgctttggcctctaccgacggtcacttacgagtatgggagacggccaacaaccggctgcaccaggagtacgtgccttccgcgcacctcagtggtacctgcacctgtctggcctgggcgccagcgcggctgcaggccaaggaaagtccccagaggaaaaaaaggaaatcagaagctgtaggaatgagtaaccagactgacttattggctcttggcacagcagttggtagcattttattatacagcacagtaaaaggagagttacacagtaaattaataagtggtggacatgacaacagagtcaactgcatacagtggcatcaagacagtggctgtttatatagttgttcagatgataaacatattgtggaatggaacgtacagacatgcaaagtaaagtgcaaatggaaaggggacaatagcagtgtcagttccctatgtatcagcccagatggaaagatgttgctttcagctggtcgaacaatcaaactatgggttttggagaccaaagaagtctacaggcatttcacaggacatgcaacgccagtttcgtcactgatgttcactaccatcagacctcctaatgagagccagccctttgatggaattacaggtctttatttcttatctggagcagtacatgaccggttacttaatgtctggcaggtccgatcagaaaacaaagaaaagagtgcagtgatgtcatttacagttaccgatgaacctgtctatattgacttaactttgtcagaaaacaaagaagagcctgtcaagttggctgttgtttgcagagatggtcaagtccatctttttgaacacatattaaatgggtactgcaaaaagcctttgacttcaaactgcacaattcagatagcaacacctgggaaaggcaagaagtcaacaccaaaacccatccctattctagctgctggtttttgctcagacaaaatgtcattgttgcttgtatatggcagttggtttcagcctactattgagcgagtggctttaaactccagagaacctcatatgtgtttagtaagagatatttcaaactgctgggcccccaaagtagaaacagctataacaaaggtgaggacaccagtgatgaattctgaagcaaaagttctggtgcctgggattcctggtcatcatgcagctatcaagcccgctcctccacaaaccgagcaagtagagagcaagaggaagtcagggggaaatgaggttagcattgaggaacgtctgggagcaatggatatagacacacacaaaaaaggaaaggaagacctccagacgaatagctttccagttcttcttacccagggcttagaaagtaacgattttgaaatgctaaataaagtacttcaaactaggaatgtaaaccttataaagaagactgtattaaggatgcccctgcatactattattccgttgttacaagagcttacaaagaggttacaaggacatcctaatagtgctgtgctaatggttcagtggctaaaatgtgtgttaacagttcatgcatcatacctgtccacgttgcctgacctggtaccccagctggggacactctaccagttaatggaaagcagagtcaaaacttttcagaaactttcacaccttcatggaaagcttattcttctaattacacaagtaacagcatcagagaagacaaagggagcaacttcccctggacagaaggcaaagttggtgtatgaagaagagtcttctgaagaggagtctgatgatgaaatagcagataaggattctgaagataattgggatgaagatgaggaggagagtgaaagtgaaaaagatgaggacgttgaagaggaagatgaggatgccgaaggaaaagatgaagaaaatggcgaggacagagatacagcaagtgaaaaagaattaaatggagattctgacttagatcctgaaaatgaaagtgaagaagaatgaagacagcaaagcaagccggtcaaactatataaactctggctcaccttgcccagtggtgagggctgcctctgtgccaggatgccaaggaccgctgcacatttccaaattcacagcagtggatcccatgccactttgctgtcctgagcaccccagacttgactgtgtaaataagagtgtttcattcaaatgttaataaactttacacagtatatagacacattttctgcaatgtactgacatcagtgtccaatatatggtatatttttataatataatatcctagtatgattggttatatcaagaattgacaagtgcagataaagacctttcccataggagttcaagaactggactgttgtgaagaagtcagctcttatctcaggttggtatctttcatcaaatccagatgcaaagcagcactagtgaaaatttttttaatttagtacatttaatttggtacattttcataaaatatgaagggataactacaaactggagtaaaaatgatggtaattaaaaaaaatcctcagtatccctagcttgtctattaactgtgataatctgacttgagtcagattgaatatttggagtgcttccccagaataaccacttatttttgaagctatcatgtgaagtatttttttaaaacaaaacaaaaattatggtcattaaaaaactagagaattagccatattaaggatttttcttgactgcaaattacttctaaagaatcatcagtgtatagattagaagtgctcattacctgcaacttttaaaaaaaattcagttatagctgcttttgaagaggtttccatttttatttaaattactaatggatcaaagaacaattgtttattttttctctttggttttagatattaatgataaccttgttggaattttttttccaaagaaaatatttttataattaaataatttaatgtttttcttccttttcattacctactcttggcagtgttagggtatctgtttacctttaaaatgataagtctcactcaagattttttatgtatgtataaatattttggtgtgctacaaaagcctttgcaaattatcagtagtagtttttttttttttttttttttttaaagaatgagccgatattggcttagtgctcactaggggacatgcacatggaagctcacctctaagaaagggctgggcagatggatttattttttcccacctgtgaatatgtaaaacaaaaccattatctttgagggagtttttaataccaatgacagaacagagatttgtgtgctcatcttaagagccagagccatataagcatcttgggaaagcaagtttgaaccagctgctggtgtaatgtacagttatatttgtctataaatggagctgtttatggcaatttaataccattctctttgtaaagtgaataaatattcatcttt

SEQ ID NO: 503682 - DNA, 3286 bp, Homo sapiens
caaactctccatgcataatggaagtaccagaatatcaaggccttatatttctggagaggaaaaaaaggaaatcagaagctgtaggaatgagtaaccagactgacttattggctcttggcacagcagttggtagcattttattatacagcacagtaaaaggagagttacacagtaaattaataagtggtggacatgacaacagagtcaactgcatacagtggcatcaagacagtggctgtttatatagttgttcagatgataaacatattgtggaatggaacgtacagacatgcaaagtaaagtgcaaatggaaaggggacaatagcagtgtcagttccctatgtatcagcccagatggaaagatgttgctttcagctggtcgaacaatcaaactatgggttttggagaccaaagaagtctacaggcatttcacaggacatgcaacgccagtttcgtcactgatgttcactaccatcagacctcctaatgagagccagccctttgatggaattacaggtctttatttcttatctggagcagtacatgaccggttacttaatgtctggcaggtccgatcagaaaacaaagaaaagagtgcagtgatgtcatttacagttaccgatgaacctgtctatattgacttaactttgtcagaaaacaaagaagagcctgtcaagttggctgttgtttgcagagatggtcaagtccatctttttgaacacatattaaatgggtactgcaaaaagcctttgacttcaaactgcacaattcagatagcaacacctgggaaaggcaagaagtcaacaccaaaacccatccctattctagctgctggtttttgctcagacaaaatgtcattgttgcttgtatatggcagttggtttcagcctactattgagcgagtggctttaaactccagagaacctcatatgtgtttagtaagagatatttcaaactgctgggcccccaaagtagaaacagctataacaaaggtgaggacaccagtgatgaattctgaagcaaaagttctggtgcctgggattcctggtcatcatgcagctatcaagcccgctcctccacaaaccgagcaagtagagagcaagaggaagtcagggggaaatgaggttagcattgaggaacgtctgggagcaatggatatagacacacacaaaaaaggaaaggaagacctccagacgaatagctttccagttcttcttacccagggcttagaaagtaacgattttgaaatgctaaataaagtacttcaaactaggaatgtaaaccttataaagaagactgtattaaggatgcccctgcatactattattccgttgttacaagagcttacaaagaggttacaaggacatcctaatagtgctgtgctaatggttcagtggctaaaatgtgtgttaacagttcatgcatcatacctgtccacgttgcctgacctggtaccccagctggggacactctaccagttaatggaaagcagagtcaaaacttttcagaaactttcacaccttcatggaaagcttattcttctaattacacaagtaacagcatcagagaagacaaagggagcaacttcccctggacagaaggcaaagttggtgtatgaagaagagtcttctgaagaggagtctgatgatgaaatagcagataaggattctgaagataattgggatgaagatgaggaggagagtgaaagtgaaaaagatgaggacgttgaagaggaagatgaggatgccgaaggaaaagatgaagaaaatggcgaggacagagatacagcaagtgaaaaagaattaaatggagattctgacttagatcctgaaaatgaaagtgaagaagaatgaagacagcaaagcaagccggtcaaactatataaactctggctcaccttgcccagtggtgagggctgcctctgtgccaggatgccaaggaccgctgcacatttccaaattcacagcagtggatcccatgccactttgctgtcctgagcaccccagacttgactgtgtaaataagagtgtttcattcaaatgttaataaactttacacagtatatagacacattttctgcaatgtactgacatcagtgtccaatatatggtatatttttataatataatatcctagtatgattggttatatcaagaattgacaagtgcagataaagacctttcccataggagttcaagaactggactgttgtgaagaagtcagctcttatctcaggttggtatctttcatcaaatccagatgcaaagcagcactagtgaaaatttttttaatttagtacatttaatttggtacattttcataaaatatgaagggataactacaaactggagtaaaaatgatggtaattaaaaaaaatcctcagtatccctagcttgtctattaactgtgataatctgacttgagtcagattgaatatttggagtgcttccccagaataaccacttatttttgaagctatcatgtgaagtatttttttaaaacaaaacaaaaattatggtcattaaaaaactagagaattagccatattaaggatttttcttgactgcaaattacttctaaagaatcatcagtgtatagattagaagtgctcattacctgcaacttttaaaaaaaattcagttatagctgcttttgaagaggtttccatttttatttaaattactaatggatcaaagaacaattgtttattttttctctttggttttagatattaatgataaccttgttggaattttttttccaaagaaaatatttttataattaaataatttaatgtttttcttccttttcattacctactcttggcagtgttagggtatctgtttacctttaaaatgataagtctcactcaagattttttatgtatgtataaatattttggtgtgctacaaaagcctttgcaaattatcagtagtagtttttttttttttttttttttttaaagaatgagccgatattggcttagtgctcactaggggacatgcacatggaagctcacctctaagaaagggctgggcagatggatttattttttcccacctgtgaatatgtaaaacaaaaccattatctttgagggagtttttaataccaatgacagaacagagatttgtgtgctcatcttaagagccagagccatataagcatcttgggaaagcaagtttgaaccagctgctggtgtaatgtacagttatatttgtctataaatggagctgtttatggcaatttaataccattctctttgtaaagtgaataaatattcatcttt

SEQ ID NO: 503683 - DNA, 327 bp, Homo sapiens
  misc_feature (101)..(101): n is a, c, g, or t
ctagaggattcccactcggagaagcgccaaggaacgttgggtttgagctctgggagctttaggagtggcagctatgtgagttggacagtccgacttccagngggggcccgcacagacagggcacagcttaggaggaatcccgggctgcaggcattctgaggcccagtggccaggcttttggcatatgaagcaaggtccacagggaggttttgaaggagcccctgggagatgtggcttggatgttctgaagtttttgtatgctggagacagggttttgggttgtcttacagtggaggcaggtagctgtaactcacagatgcattgtcg

SEQ ID NO: 503684 - DNA, 1000 bp, Homo sapiens
  misc_feature (533)..(533): n is a, c, g, or t
  misc_feature (782)..(782): n is a, c, g, or t
agcgggtgtgacgtcagcgccccggtcccacggcgcagtccgctgcgatcctccgtgccctgcgcctgagctggagtccccctcgtcgccgccccgtggattgccgccgcggcctatgggcgtgtcccgtggcgcgtggtgcctcgcgggcgccttgctgcttggcttgcttgctgattaggcagtcgccgcaccgaccagatcgtccgacgcctgtcctggcaccgggaatcccgttcgtccgccatccttagcatcggggtacccagctacgtatagctggctagttctgctggtgcctgcggaaccgtcgacctccgtgcccgctcgtcctcgtcgcgcgagcgctgtgcggcctggatgggcggcgctccaggagttcttctcgcttagtgactcgagcctcggttcttggatcgagtaagctttgcttcagcggttagtcttgctctgccttcctttctctcaatcagtgccggaaatattgtagcgcacgacgatgagcgtccgatagagcccgctaaatttgccancgcgctagatatctttcgatgctagtagataagcagcgccttcgctttcgcgaaatcgacctagattgtagacagggaagcgcatgacgcagcgcagagagtcgttgttgccgcgcgggcgtgcggttggcctttgtgatgccccaaggcatcctgcgggtgactccctttgagagcccagggggtgccatgatagagaacgaacacgggggttccccttggtggagaggggcttctcctatgcgggtntggtgtgctgcccccctggcattctccgcgttcctttgtgtggaaagccttcggttctctgtcgccagtcccccttgtcgtgggcgaaacttggaagccaccttcggttgcgaacaccttttccaacgccgccccaggcggcaatttgggggttcctcctcctttcccgaacgcctggggaagcggttatcttaatcttttggctgggatcttggcac

SEQ ID NO: 503685 - DNA, 138 bp, Homo sapiens
  misc_feature (105)..(105): n is a, c, g, or t
catgttacaatcgacagaacatgaggtgcaggtttgatcctggctttgctcagtgtgttaaggatctggcattgcgtgagctgtggtgtaggtcgcagatgcggntcagatcctgcgttgctgtgcgtctggcgtagg

SEQ ID NO: 503686 - DNA, 2385 bp, Homo sapiens
  misc_feature (2343)..(2343): n is a, c, g, or t
cacgtggctgcagcggggccagagcagcaatggcggcgggcggcggcggtagctgcgaccccctggcccctgctggggtcccttgcgccttctccccgcacagccaggcctacttcgctttggcctctaccgacggtcacttacgagtatgggagacggccaacaaccggctgcaccaggagtacgtgccttccgcgcacctcagtggtacctgcacctgtctggcctgggcgccagcgcggctgcaggccaaggaaagtccccagaggaaaaaaaggaaatcagaagctgtaggaatgagtaaccagactgacttattggctcttggcacagcagttggtagcattttattatacagcacagtaaaaggagagttacacagtaaattaataagtggtggacatgacaacagagtcaactgcatacagtggcatcaagacagtggctgtttatatagttgttcagatgataaacatattgtggaatggaacgtacagacatgcaaagtaaagtgcaaatggaaaggggacaatagcagtgtcagttccctatgtatcagcccagatggaaagatgttgctttcagctggtcgaacaatcaaactatgggttttggagaccaaagaagtctacaggcatttcacaggacatgcaacgccagtttcgtcactgatgttcactaccatcagacctcctaatgagagccagccctttgatggaattacaggtctttatttcttatctggagcagtacatgaccggttacttaatgtctggcaggtccgatcagaaaacaaagaaaagagtgcagtgatgtcatttacagttaccgatgaacctgtctatattgacttaactttgtcagaaaacaaagaagagcctgtcaagttggctgttgtttgcagagatggtcaagtccatctttttgaacacatattaaatgggtactgcaaaaagcctttgacttcaaactgcacaattcagatagcaacacctgggaaaggcaagaagtcaacaccaaaacccatccctattctagctgctggtttttgctcagacaaaatgtcattgttgcttgtatatggcagttggtttcagcctactattgagcgagtggctttaaactccagagaacctcatatgtgtttagtaagagatatttcaaactgctgggcccccaaagtagaaacagctataacaaaggtgaggacaccagtgatgaattctgaagcaaaagttctggtgcctgggattcctggtcatcatgcagctatcaagcccgctcctccacaaaccgagcaagtagagagcaagaggaagtcagggggaaatgaggttagcattgaggaacgtctgggagcaatggatatagacacacacaaaaaaggaaaggaagacctccagacgaatagctttccagttcttcttacccagggcttagaaagtaacgattttgaaatgctaaataaagtacttcaaactaggaatgtaaaccttataaagaagactgtattaaggatgcccctgcatactattattccgttgttacaagagcttacaaagaggttacaaggacatcctaatagtgctgtgctaatggttcagtggctaaaatgtgtgttaacagttcatgcatcatacctgtccacgttgcctgacctggtaccccagctggggacactctaccagttaatggaaagcagagtcaaaacttttcagaaactttcacaccttcatggaaagcttattcttctaattacacaagtaacagcatcagagaagacaaagggagcaacttcccctggacagaaggcaaagttggtgtatgaagaagagtcttctgaagaggagtctgatgatgaaatagcagataaggattctgaagataattgggatgaagatgaggaggagagtgaaagtgaaaaagatgaggacgttgaagaggaagatgaggatgccgaaggaaaagatgaagaaaatggcgaggacagagatacagcaagtgaaaaagaattaaatggagattctgacttagatcctgaaaatgaaagtgaagaagaatgaagacagctgcaaacacacaatgccagctgcaaacacacaatgccagctgcaaacacacaatgcagctgcaaacacacaatgcagctgcaaacacacaatgcagctgcaaacacacaatgcagctgcaaacacacaatgcagctgcaaacacacaatgcagctgcaaacacacaatgcagctgcaaacacacaatgcagctgcaaacacacaatgcagctgcaaacacacaatgcagctgcaaacacacaatgcagctgcaaacacacaatgcagctgcanacacacaatgcagctgcaaacacacaatgcagctcacaccat

SEQ ID NO: 503687 - DNA, 896 bp, Homo sapiens
  misc_feature (173)..(173): n is a, c, g, or t
ttgtgcagaaagtacggagatctcatcgataagctaagactcttacagcatgggaggatccggtggaatgggttatcctcgtatagagtggagaatggtggaggaaggtggtgatgtctgggttgtagcccagaacagaatgactttaatacaacttaaagacacggtatccntgggaaatggcgagttcgtcgtgcgtaggcagtagagtagcgtaacacagcaataaattgaagtgccctgaaaggctccaaagggaagagactgggaaatccctgtgcctgtgggtatttcagtcaactgatgaacacatggtaaaattatagcgagaactcaataaagaaaatgacaggaatttggtagctcaatggaggtcttggtggtaaattacttacaaatttcttaccattgaaaggccagaaacgaataattcaccttgatctaaaacttatagctgatgtggcctagtaggattcccaaatgctggaaaatcctctttgctaagttgtgtttctcatgcaaaacctgcaattgcgattacgcatttacaacattaaagcctgaacttggaaggataatgtacagtgatttcaaacagatatcagtagctgatcttccgggttttaatagaaggagcacatatgaacaaaggaatgggccacaaattcctccaagcatatagaaaagaactagacaactacttttggtgtgatatttctgggatttcagctttcttctcacactcaatacaggaagcttttgaaccttaaaactgttcaaagagtggaattgtacaaggaggacttcacaaaaacctggcccctggcagttataaatgggctgcccatggccaacatcagtcatgatgatggccagcccagaaacaagatacgata

SEQ ID NO: 503688 - DNA, 440 bp, Homo sapiens
agtatctctgttttaagtaagaaactaggtccggagcttttaacaggtacttagaagtgagtattgggtaatcactaagagggcatggactgcaccagaccagggctatggggagaaatgagtgactgtttgagatgtatgcgcgtgaactggcctaggatacttctcttgaggctttggaaaactgctgccttggaatttgcagtatccactccaggtctggcaccaaagatgttagtcttgagatcgcggtttcctctctcccagaaaaaaggactacaagagggtcgggggggatgctttggtggtgaagggattgcacgatggttttccttctgttcacaatggtatttacaggagaccttgtcggcagggggggtacgtgaactatctgggtgacgtttggaggtgatcagaggtgtagaaaatagaaaaaaaaa

SEQ ID NO: 503689 - DNA, 3393 bp, Homo sapiens
tccagagaaagcgagaattgaggtagggttaggatgggcttggggaggtctagccagtatggaactttcctggacattcgcgaagttcatctcctgggtcacaggatgtacaactacccattttacattcttatcactctcactcactcattttctgatacttgttgagaatctttatcccatgcctgacaaagggagattgtgctgtgttaaggaatgcaatcaatgaagcttttatcacagtagtatgtccagggttagttacctgacacaagcttttagggaatgtaattgtcacaggacctgaggcgatatttttaatgattgttcagtttgttttttttttattttctgctctgagtaaagttttctctcatgtattgagatgctttttttctcttcacaatatagcaaatggaaaggggacaatagcagtgtcagttccctatgtatcagcccagatggaaagatgttgctttcagctggtcgaacaatcaaactatgggttttggagaccaaagaagtctacaggcatttcacaggacatgcaacgccagtttcgtcactgatgttcactaccatcagacctcctaatgagagccagccctttgatggaattacaggtctttatttcttatctggagcagtacatgaccggttacttaatgtctggcaggtccgatcagaaaacaaagaaaagagtgcagtgatgtcatttacagttaccgatgaacctgtctatattgacttaactttgtcagaaaacaaagaagagcctgtcaagttggctgttgtttgcagagatggtcaagtccatctttttgaacacatattaaatgggtactgcaaaaagcctttgacttcaaactgcacaattcagatagcaacacctgggaaaggcaagaagtcaacaccaaaacccatccctattctagctgctggtttttgctcagacaaaatgtcattgttgcttgtatatggcagttggtttcagcctactattgagcgagtggctttaaactccagagaacctcatatgtgtttagtaagagatatttcaaactgctgggcccccaaagtagaaacagctataacaaaggtgaggacaccagtgatgaattctgaagcaaaagttctggtgcctgggattcctggtcatcatgcagctatcaagcccgctcctccacaaaccgagcaagtagagagcaagaggaagtcagggggaaatgaggttagcattgaggaacgtctgggagcaatggatatagacacacacaaaaaaggaaaggaagacctccagacgaatagctttccagttcttcttacccagggcttagaaagtaacgattttgaaatgctaaataaagtacttcaaactaggaatgtaaaccttataaagaagactgtattaaggatgcccctgcatactattattccgttgttacaagagcttacaaagaggttacaaggacatcctaatagtgctgtgctaatggttcagtggctaaaatgtgtgttaacagttcatgcatcatacctgtccacgttgcctgacctggtaccccagctggggacactctaccagttaatggaaagcagagtcaaaacttttcagaaactttcacaccttcatggaaagcttattcttctaattacacaagtaacagcatcagagaagacaaagggagcaacttcccctggacagaaggcaaagttggtgtatgaagaagagtcttctgaagaggagtctgatgatgaaatagcagataaggattctgaagataattgggatgaagatgaggaggagagtgaaagtgaaaaagatgaggacgttgaagaggaagatgaggatgccgaaggaaaagatgaagaaaatggcgaggacagagatacagcaagtgaaaaagaattaaatggagattctgacttagatcctgaaaatgaaagtgaagaagaatgaagacagcaaagcaagccggtcaaactatataaactctggctcaccttgcccagtggtgagggctgcctctgtgccaggatgccaaggaccgctgcacatttccaaattcacagcagtggatcccatgccactttgctgtcctgagcaccccagacttgactgtgtaaataagagtgtttcattcaaatgttaataaactttacacagtatatagacacattttctgcaatgtactgacatcagtgtccaatatatggtatatttttataatataatatcctagtatgattggttatatcaagaattgacaagtgcagataaagacctttcccataggagttcaagaactggactgttgtgaagaagtcagctcttatctcaggttggtatctttcatcaaatccagatgcaaagcagcactagtgaaaatttttttaatttagtacatttaatttggtacattttcataaaatatgaagggataactacaaactggagtaaaaatgatggtaattaaaaaaaatcctcagtatccctagcttgtctattaactgtgataatctgacttgagtcagattgaatatttggagtgcttccccagaataaccacttatttttgaagctatcatgtgaagtatttttttaaaacaaaacaaaaattatggtcattaaaaaactagagaattagccatattaaggatttttcttgactgcaaattacttctaaagaatcatcagtgtatagattagaagtgctcattacctgcaacttttaaaaaaaattcagttatagctgcttttgaagaggtttccatttttatttaaattactaatggatcaaagaacaattgtttattttttctctttggttttagatattaatgataaccttgttggaattttttttccaaagaaaatatttttataattaaataatttaatgtttttcttccttttcattacctactcttggcagtgttagggtatctgtttacctttaaaatgataagtctcactcaagattttttatgtatgtataaatattttggtgtgctacaaaagcctttgcaaattatcagtagtagtttttttttttttttttttttttaaagaatgagccgatattggcttagtgctcactaggggacatgcacatggaagctcacctctaagaaagggctgggcagatggatttattttttcccacctgtgaatatgtaaaacaaaaccattatctttgagggagtttttaataccaatgacagaacagagatttgtgtgctcatcttaagagccagagccatataagcatcttgggaaagcaagtttgaaccagctgctggtgtaatgtacagttatatttgtctataaatggagctgtttatggcaatttaataccattctctttgtaaagtgaataaatattcatcttt

SEQ ID NO: 503690 - DNA, 524 bp, Homo sapiens
  misc_feature (226)..(226): n is a, c, g, or t
ctaggtgacttagaggatcccgagtgtcttcaagacattaagttttctccagcaactccaccctgcacatcctccttctcagggatttttattaaactaagagctagagagacaaagtttatatttattcaagaatggaacaggtgtcagtctgtcaataacctgctggtaaacagcagcactgtcagaaaccatgccaattatcagtttgagttatacatatatnggaggtagcatttcaacactctggttttgtttctttggctttttttttttccaaaaaaatatactaggagatttaagacttacttcagattaaacttgttacattaagaaaacactcttggccgggagaggtggctcacgcctgtaatcccagcagtttgggaggccaaggctggcaggtcactggagatcaggagtacgagaccagccgggccaaaatgggaaaaccctgtctctactaaaagtacacaaattagccaggcctgggggcacacacctgtaatcccagctactcggga

SEQ ID NO: 503691 - DNA, 2166 bp, Homo sapiens
cacgtggctgcagcggggccagagcagcaatggcggcgggcggcggcggtagctgcgaccccctggcccctgctggggtcccttgcgccttctccccgcacagccaggcctacttcgctttggcctctaccgacggtcacttacgagtatgggagacggccaacaaccggctgcaccaggagtacgtgccttccgcgcacctcagtggtacctgcacctgtctggcctgggcgccagcgcggctgcaggccaaggaaagtccccagaggaaaaaaaggaaatcagaagctgtaggaatgagtaaccagactgacttattggctcttggcacagcagttggtagcattttattatacagcacagtaaaaggagagttacacagtaaattaataagtggtggacatgacaacagagtcaactgcatacagtggcatcaagacagtggctgtttatatagttgttcagatgataaacatattgtggaatggaacgtacagacatgcaaagtaaagtgcaaatggaaaggggacaatagcagtgtcagttccctatgtatcagcccagatggaaagatgttgctttcagctggtcgaacaatcaaactatgggttttggagaccaaagaagtctacaggcatttcacaggacatgcaacgccagtttcgtcactgatgttcactaccatcagacctcctaatgagagccagccctttgatggaattacaggtctttatttcttatctggagcagtacatgaccggttacttaatgtctggcaggtccgatcagaaaacaaagaaaagagtgcagtgatgtcatttacagttaccgatgaacctgtctatattgacttaactttgtcagaaaacaaagaagagcctgtcaagttggctgttgtttgcagagatggtcaagtccatctttttgaacacatattaaatgggtactgcaaaaagcctttgacttcaaactgcacaattcagatagcaacacctgggaaaggcaagaagtcaacaccaaaacccatccctattctagctgctggtttttgctcagacaaaatgtcattgttgcttgtatatggcagttggtttcagcctactattgagcgagtggctttaaactccagagaacctcatatgtgtttagtaagagatatttcaaactgctgggcccccaaagtagaaacagctataacaaaggtgaggacaccagtgatgaattctgaagcaaaagttctggtgcctgggattcctggtcatcatgcagctatcaagcccgctcctccacaaaccgagcaagtagagagcaagaggaagtcagggggaaatgaggttagcattgaggaacgtctgggagcaatggatatagacacacacaaaaaaggaaaggaagacctccagacgaatagctttccagttcttcttacccagggcttagaaagtaacgattttgaaatgctaaataaagtacttcaaactaggaatgtaaaccttataaagaagactgtattaaggatgcccctgcatactattattccgttgttacaagagcttacaaagaggttacaaggacatcctaatagtgctgtgctaatggttcagtggctaaaatgtgtgttaacagttcatgcatcatacctgtccacgttgcctgacctggtaccccagctggggacactctaccagttaatggaaagcagagtcaaaacttttcagaaactttcacaccttcatggaaagcttattcttctaattacacaagtaacagcatcagagaagacaaagggagcaacttcccctggacagaaggcaaagttggtgtatgaagaagagtcttctgaagaggagtctgatgatgaaatagcagataaggattctgaagataattgggatgaagatgaggaggagagtgaaagtgaaaaagatgaggacgttgaagaggaaagaaggaaatatggggaaatggagtgaatgtcaagtggatcagagagatacagtcatgggggtcaggtgtggtatccagaataatgtgggaggccagattgaagtccaggccagaaacagtggtaattgtgggagacccaaagagtgagtatagctgaaggccccggggagcagaaagtatatgcatcaggtgggaggaagaaaatagattttggaagtt

SEQ ID NO: 503692 - DNA, 457 bp, Homo sapiens
tgggtgcatagttgattcctagaggatacacctaagacattttccttgatactgtattcccttccagccactgctccatttctccactccccttcagagtgaaacgccttacaagagttgtctgtagagctgggcgcggtggctcacgcctgtagtcccagcactttgggaggccgaggcgggcagatcgcctgaggtcaggagttcgagaccggcctggccaacgtggtgaaaccccgtctctgctaaatatgcaaaaattggccaggcgtggtggcaggcgcctgtggtcccggctacttgggaggctgaggcaggagaaatgcttggatccgggaggcagaggttgcagttagccaggatcgcgccattgcactccagcgtgggcaacaagagtgagacttcatctcaaaataatagtaataataataactggtagaatgtattaccatttgta

SEQ ID NO: 503693 - DNA, 1697 bp, Homo sapiens
cacgtggctgcagcggggccagagcagcaatggcggcgggcggcggcggtagctgcgaccccctggcccctgctggggtcccttgcgccttctccccgcacagccaggcctacttcgctttggcctctaccgacggtcacttacgagtatgggagacggccaacaaccggctgcaccaggagtacgtgccttccgcgcacctcagtggtacctgcacctgtctggcctgggcgccagcgcggctgcaggccaaggaaagtccccagaggaaaaaaaggaaatcagaagctgtaggaatgagtaaccagactgacttattggctcttggcacagcagttggtagcattttattatacagcacagtaaaaggagagttacacagtaaattaataagtggtggacatgacaacagagtcaactgcatacagtggcatcaagacagtggctgtttatatagttgttcagatgataaacatattgtggaatggaacgtacagacatgcaaagtaaagtgcaaatggaaaggggacaatagcagtgtcagttccctatgtatcagcccagatggaaagatgttgctttcagctggtcgaacaatcaaactatgggttttggagaccaaagaagtctacaggcatttcacaggacatgcaacgccagtttcgtcactgatgttcactaccatcagacctcctaatgagagccagccctttgatggaattacaggtctttatttcttatctggagcagtacatgaccggttacttaatgtctggcaggtccgatcagaaaacaaagaaaagagtgcagtgatgtcatttacagttaccgatgaacctgtctatattgacttaactttgtcagaaaacaaagaagagcctgtcaagttggctgttgtttgcagagatggtcaagtccatctttttgaacacatattaaatgggtactgcaaaaagcctttgacttcaaactgcacaattcagatagcaacacctgggaaaggcaagaagtcaacaccaaaacccatccctattctagctgctggtttttgctcagacaaaatgtcattgttgcttgtatatggcagttggtttcagcctactattgagcgagtggctttaaactccagagaacctcatatgtgtttagtaagagatatttcaaactgctgggcccccaaagtagaaacagctataacaaaggtgaggacaccagtgatgaattctgaagcaaaagttctggtgcctgggattcctggtcatcatgcagctatcaagcccgctcctccacaaaccgagcaagtagagagcaagaggaagtcagggggaaatgaggttagcattgaggaacgtctgggagcaatggatatagacacacacaaaaaaggaaaggaagacctccagacgaatagctttccagttcttcttacccagggcttagaaagtaacgattttgaaatgctaaataaagtacttcaaactaggaatgtaaaccttataaagaagactgtattaaggatgcccctgcatactattattccgttgttacaagaggtaactgactgcttttttcatttcagcatcctaatgccatgagttaaatggaaaattcagtagttagagaaatggatttgtaatacgtaaggacacatggcatttagagtgagtaatggatggaggaaagtactttagacaaaa

SEQ ID NO: 503694 - DNA, 372 bp, Homo sapiens
tctccctagctggcactactaatctaacttacgtctctatggacttgcctattctggtcctttcttataaatggaacgacgcaacatgcagcccatgttttctggctgctttcactgagcataatattttcaagattcacccatgttgtaacacatatcagtgcttcattcctttttatggctgaataatactccatggcatggacagaccatatttgtcttatctgttcatcactgacagacatttgggtttgttccattttttggctgtcatgaataatgctgtcagcatgtatgtatgtacgcggtttccttagtttttatctaatgtcattttcctgttccaggatccccttcaagataccacattat

SEQ ID NO: 503695 - DNA, 1912 bp, Homo sapiens
cacgtggctgcagcggggccagagcagcaatggcggcgggcggcggcggtagctgcgaccccctggcccctgctggggtcccttgcgccttctccccgcacagccaggcctacttcgctttggcctctaccgacggtcacttacgagtatgggagacggccaacaaccggctgcaccaggagtacgtgccttccgcgcacctcagtggtacctgcacctgtctggcctgggcgccagcgcggctgcaggccaaggaaagtccccagaggaaaaaaaggaaatcagaagctgtaggaatgagtaaccagactgacttattggctcttggcacagcagttggtagcattttattatacagcacagtaaaaggagagttacacagtaaattaataagtggtggacatgacaacagagtcaactgcatacagtggcatcaagacagtggctgtttatatagttgttcagatgataaacatattgtggaatggaacgtacagacatgcaaagtaaagtgcaaatggaaaggggacaatagcagtgtcagttccctatgtatcagcccagatggaaagatgttgctttcagctggtcgaacaatcaaactatgggttttggagaccaaagaagtctacaggcatttcacaggacatgcaacgccagtttcgtcactgatgttcactaccatcagacctcctaatgagagccagccctttgatggaattacaggtctttatttcttatctggagcagtacatgaccggttacttaatgtctggcaggtccgatcagaaaacaaagaaaagagtgcagtgatgtcatttacagttaccgatgaacctgtctatattgacttaactttgtcagaaaacaaagaagagcctgtcaagttggctgttgtttgcagagatggtcaagtccatctttttgaacacatattaaatgggtactgcaaaaagcctttgacttcaaactgcacaattcagatagcaacacctgggaaaggcaagaagtcaacaccaaaacccatccctattctagctgctggtttttgctcagacaaaatgtcattgttgcttgtatatggcagttggtttcagcctactattgagcgagtggctttaaactccagagaacctcatatgtgtttagtaagagatatttcaaactgctgggcccccaaagtagaaacagctataacaaaggtgaggacaccagtgatgaattctgaagcaaaagttctggtgcctgggattcctggtcatcatgcagctatcaagcccgctcctccacaaaccgagcaagtagagagcaagaggaagtcagggggaaatgaggttagcattgaggaacgtctgggagcaatggatatagacacacacaaaaaaggaaaggaagacctccagacgaatagctttccagttcttcttacccagggcttagaaagtaacgattttgaaatgctaaatgtaagtatatagcaatttttaactaaattaacatggttaatatttcttagaaaatgattgacatagcacattcacagctgtgagccatcatgttacagagccatttggaatgtaatgttttatgagtttagtcaaacatgtatcacttggtggcattatacagacagtcaccaacctacaacgggattgcattgagttattttgaacctggaatgcattttctcatagaaatactgttctgaattattaggttattaggctttagttcataaaagcctttataaacatagtgtagctgaatgataatactcagcattctagatcacaatttatatttttttctgtaggaaaatgcgttcctgagtttttactctggattccagaaacttatttccccctggccgtgagagggggcagtgaggtggaaccttggcaatgggtaggag

SEQ ID NO: 503696 - DNA, 720 bp, Homo sapiens
agcggggcagccgcaacccgttggggtcggcttccacagtgtgggagcttaattcttttgctcttcttcacaatgactcttgctgctagtcactctttgggtctgcagtacctttatcagccgtaatactcaccgcgagagtctgtggcttcattcctgaagtcagcgagaccacgaaccccccaggaggaacaaacaactccagacgcaccacctttaagaactgtaacactcactgcaaaggtctgcagcttcactcctgaagtcagcgagaccacgaacccaccggaaggaagaaactctggacacagctaaacatctgaaggaataaactcagacacattacccgtaaaaactgtaacactcaccgcgagggtcagtggcttcgttattgaagtcagtgagaccaagaacccaccggaaggaaccaattccagacacacttgttatctaaataaaaacttgaggctgggcatggtggctgacacctgtaatcccaacattttgggaggctgaggcaggtggatcacttgagcctcggagtttcagaccagcctgggcaacatggcaaaaccccgtctctactaaaaatacaaacattagtcgggtgtggtccatgcacctatagtcccagtacttgggaggctgaggcaggagaatcacttgaatcctggaggcaaagattgcagtgagaagagatcaacacactgcactccaact

SEQ ID NO: 503697 - DNA, 137 bp, Homo sapiens
ctgcgtactctattttaaaacaccatttcacttgtaagctacttgactttgggctggtttcccttttcctctttatttggaactgtttctatctgagctcctgtgtaatttataataaaaagttagtagaatatagt

SEQ ID NO: 503698 - DNA, 175 bp, Homo sapiens
cacagcagtgacagttgttttatcaagttcttttcttattcatgactcattatatgtaaacacatcatttgtaaaatgcaaatgccatatttgacttggcttctggtcttgcatgtatttgcataagcacatgattcattcacatgtttaacagttgatgtaacactgcattggg

SEQ ID NO: 503699 - DNA, 562 bp, Homo sapiens
ggccacacagccgaggcccccagcccgggcgcaggccacccaagggggccgggagggccaggcgcgcacgctgggacctgcggcgcccacagtggactcaaacttgtcctccgaagcgcggcccgtgacctccttcctgagcttgtcccaggtgtccgggccgcagctgcccggggagggcgaagaggaggaggaaggggaggacgatggggccccgggcgacgaggccgcgtcggaggacagcgaggaggccgcgggcccggcgctcggacgctggcgtgaggacgccatcgactggcagcgcacgttcagcgtgggcgccgtggacttcgagctgctgcgctcggactggaacgacctgcgatgcaacgtttcggggaacctgcagctgccggaggcggaggccgtggacgtgaccgctcagtacatggagcggctgaacgcgcgccacggcgggcgcttcgcgcttctgcgcatcgtgaacgtggagaagcgccgggactcggcgcgagggagtcgcttcctgctggagctggagctgcaggagcgcgggggcggccgc

SEQ ID NO: 503700 - DNA, 733 bp, Homo sapiens
  misc_feature (555)..(555): n is a, c, g, or t
gggatcaggacaggagcggaactgctgcctgggggaaggggtgctgtgaaggcacgattgggggcttctcagaagaggtgacccagggcctggaagaggagtggctgggaggactggggcaaacatcccaggcaggggactcctcaggacaaaggagaggagacagtggctgtgcctgaggaggagtctgctaccccagtatgaggggaaggttgaaagccacaaaatcaaaactgcttaaggtcctagaatgccacaaaagccccttggaaccttgtcctatgggcggtggctaactcctgaaggtttctgagcaagggggtaacaggacaggcgggcatgtcataaacgtcacctgggacgtgagtggtggccaggaggcccgcgaggaggtgaggatgggcctgggctcgctggtgtgcccccagtcctgccccgaccctggagggggtggctggaaggtggacctgcctgctgggccaacctggaggggcaggtgctgtgccgcggagcccgcagcctccgccaactccaagtcggctgagtttctgtggncagggcggaccagggttgcgggcggggtgcaggctggaagccccagtaccggctgaccgctgagccttgcaggcgcttcgcgcttctgcgcatcgtgaacgtggagaagcgccgggactcggcgcgagggagtcgcttcctgctggagctggagctgcaggagcgcgggggcggccgc

SEQ ID NO: 503701 - DNA, 532 bp, Homo sapiens
ggccacacagccgaggcccccagcccgggcgcaggccacccaagggggccgggagggccaggcgcgcacgctgggacctgcggcgcccacagtggactcaaacttgtcctccgaagcgcggcccgtgacctccttcctgagcttgtcccaggtgtccgggccgcagctgcccggggagggcgaagaggaggaggaaggggaggacgatggggccccgggcgacgaggccgcgtcggaggacagcgaggaggccgcgggcccggcgctcggacgctggcgtgaggacgccatcgactggcagcgcacgttcagcgtgggcgccgtggacttcgagctgctgcgctcggactggaacgacctgcgatgcaacgtttcggggaacctgcagctgccggaggcggaggccgtggacgtgaccgctcagtacatggagcggctgaacgcgcgccacggcgggtatgggggcggccgaacgcgcgccagggcggttttggaggcggggacagccggggagatggaggtcctggccttg

SEQ ID NO: 503702 - DNA, 159 bp, Homo sapiens
ctcctggcagaggaggggactgtgtataagaactaggtattgagaagtctgaaggttgatgtaatctgttactgtccggtgaaaaaaaggaaaaaattctaattaaaaatttattagtttttttttttttgttatatttgtattttctttttattatat

SEQ ID NO: 503703 - DNA, 201 bp, Homo sapiens
atcaaaaacccttgccccccaagggttttttaaaattgcctaaaccccgttaaaacccccttaaattttttaaaccccaaaaaagagctttttaaaaggggtcccttttttaaaggggtaaattttgtaaccccaaaaattttgtttttaaaaacaggatttttttttaacctttgggatttaagggtatttttgggccct

SEQ ID NO: 503704 - DNA, 661 bp, Homo sapiens
gcggccgcgatgccgcggctcccggtgaagaagatccgtaagcagatgaagctgctgctgctgctgctgctgctgagctgcgccgcgtggctcacctacgtgcacctgggcctggtgcgccagggacgcgcgctgcgccagcgcctgggctacgggcgagatggtgagaagctgaccagtgagaccgacggccggggggtccacgctgtgccatccacacagagggctgaggactccagtgagagccgtgaagaggagcaagcgcccgaaggtcgggacctagacatgctgtttcctgggggcgctgggaggctgccactgaacttcacccatcagacacccccatggcgggaggagtacaaggggcaggtgaacctgcacgtgtttgaggactggtgtgggggcgccgtgggtgggcgccgtggacttcgagctgctgcgctcggactggaacgacctgcgatgcaacgtttcggggaacctgcagctgccggaggcggaggccgtggacgtgaccgctcagtacatggagcggctgaacgcgcgccacggcgggcgcttcgcgcttctgcgcatcgtgaacgtggagaagcgccgggactcggcgcgagggagtcgcttcctgctggagctggagctgcaggagcgcgggggcggccgc

SEQ ID NO: 503705 - DNA, 502 bp, Homo sapiens
gaacataaataccccagctccctcaccctggaacataaataccccagctccctcacctgggaacataaataccccagctctctcaccctggaacataaataccccagctgtctcaccctggaacataaatacgccagctccctcaccctggaacataaataccccagctccctcaccctggaacataaataccccagctccctcaccctggaacataaataccccagctccctcaccctggaacataaataccccagctccctcaccctggaacataaataccccagctctctcacccttggggtttgatagctttgaggtgcgggttctagactgcatcccaaagctgtgcagcagggttaagctctggtacccacagtggtaattacttgacccagtgagtccctgactggcttctcccctactctgtttcaacctctcactcagttcctggcatttccttggatcatttcccaaataaactacttgcttgaatttttga

SEQ ID NO: 503706 - DNA, 410 bp, Homo sapiens
  misc_feature (393)..(393): n is a, c, g, or t
gcggccgcgatgccgcggctcccggtgaagaagatccgtaagcagatgaagctgctgctgctgctgctgctgctgagctgcgccgcgtggctcacctacgtgcacctgggcctggtgcgccagggacgcgcgctgcgccagcgcctgggctacgggcgagatggtgagaagctgaccagtgagaccgacggccggggggtccacgctgtgccatccacacagagggctgaggactccagtgagagccgtgaagaggagcaagcgcccgaaggtcgggacctagacatgctgtttcctgggggcgctgggaggctgccactgaacttcacccatcagacacccccatggcgggaggaggtgagctggctcggcctgtaatgggctgggaggcanggcgggggctggggcgg

SEQ ID NO: 503707 - DNA, 828 bp, Homo sapiens
tagttctagatcgctgagcggctgccctattatatttttttttggtaaagacggagttttgccataaggccctgggttaggtctagaaactcctgagctcaattaatccacccatctaggcctcccaaagtcaaggatatacaggcataagccccaccacacccgtgcctgttcccaaatttcacatccaaaagcaacaggacttaacatatgccaaaacaaatctcaaaaagaactgtggtgtaccacctgggccacgcaccaaggctacacgcctgtaatcccagacacatggtggaggaccagaggcaagttgtatggctataaagctacaggagttcaacacagcctggccaacctgtgggtgcaacaccccatcttccacaaaaaatatacaaacacacgagccacacaatatttgcacgctattcactcactatctgttctccaagacacatacctccagcaaactttccataccctttacatcaccaacatagtggtcatgggcgacttcaggacaccagaaacaccggggttccaagtgggccacaaacaccagagtctctgaacacacacccccccccctactaccttttgcgcaactcatcttttgttaacccaaacatggccaccagggtcgaatacgcacgacgacaaaggggggcacgtccttttttcacaacacgttgggttaggtcaaccccagccgtgggactactcataatattgcccccaagaaaaacctgtctagtggctggtaattggacccccttttgccccccccctttcaacacccttctctttcccaatatgggccacaaagcg

SEQ ID NO: 503708 - DNA, 1579 bp, Homo sapiens
gcggccgcgatgccgcggctcccggtgaagaagatccgtaagcagatgaagctgctgctgctgctgctgctgctgagctgcgccgcgtggctcacctacgtgcacctgggcctggtgcgccagggacgcgcgctgcgccagcgcctgggctacgggcgagatggtgagaagctgaccagtgagaccgacggccggggggtccacgctgtgccatccacacagagggctgaggactccagtgagagccgtgaagaggagcaagcgcccgaaggtcgggacctagacatgctgtttcctgggggcgctgggaggctgccactgaacttcacccatcagacacccccatggcgggaggagtacaaggggcaggtgaacctgcacgtgtttgaggactggtgtgggggcgccgtgggccacctgaggaggaacctgcacttcccgctgttccctcatacgcgcaccaccgtgaagaagttggccgtgtcccccaagtggaagaactatggactccgtatttttggtttcatccacccggcgagggacggagacgtccagttttctgtggcctcagacgacaactcggagttctggctgagtctggacgagagccctgctgctgcccagcttgtggcctttgtgggcaagactggctccgagtggacagcgcctggagaattcaccaagttcagctcccaggtgtccaagcccaggcggctcatggcctcccggaggtactactttgagttgctgcacaagcaggacgaccgcggctcggaccacgtggaagtgggctggcgagctttcctgcccggcctgaagttcgaggtcatcagctctgctcacatctccctgtacacagatgagtcagccttgaagatggaccacgtggcgcacgtcccccagtctccagccagccacgtgggggggcgtccgccgcaggaggagaccagcgcagacatgctgcggccagatcccagggatacctttttcctcactccacgcatggaatcttcgagcctggagaacgtgctggagccctgcgcctacgcccccacctacgtggtcaaggacttcccgatcgccagataccagggcctgcaatttgtgtacctgtccttcgtttatcccaacgactacactcgcctcacccacatggagacggacaacaagtgcttctaccgcgagtctccgctgtatctggagaggtttgggttctataaatacatgaagatggacaaggaggagggggatgaggatgaagaagacgaggtgcagcgccgagccttcctcttcctcaacccggacgacttcctggacgacgaggacgagggggagctgctcgacagcctggagcccaccgaggcggccccgcccaggagcggcccccagatccacggttgctaaacaggatcgggcagttgcctaggcataattaagtacagacatcagctagtacgggtatccatcgtatagtaggagagaaagatgtctgtggtacacgacagaataaggacataaggcgcatgcaaaatctggaggagcaataacgtcgtagggagacaggcactgcgcacacacg

SEQ ID NO: 503709 - DNA, 1652 bp, Homo sapiens
gcggccgcgatgccgcggctcccggtgaagaagatccgtaagcagatgaagctgctgctgctgctgctgctgctgagctgcgccgcgtggctcacctacgtgcacctgggcctggtgcgccagggacgcgcgctgcgccagcgcctgggctacgggcgagatggtgagaagctgaccagtgagaccgacggccggggggtccacgctgtgccatccacacagagggctgaggactccagtgagagccgtgaagaggagcaagcgcccgaaggtcgggacctagacatgctgtttcctgggggcgctgggaggctgccactgaacttcacccatcagacacccccatggcgggaggagtacaaggggcaggtgaacctgcacgtgtttgaggactggtgtgggggcgccgtgggccacctgaggaggaacctgcacttcccgctgttccctcatacgcgcaccaccgtgaagaagttggccgtgtcccccaagtggaagaactatggactccgtatttttggtttcatccacccggcgagggacggagacgtccagttttctgtggcctcagacgacaactcggagttctggctgagtctggacgagagccctgctgctgcccagcttgtggcctttgtgggcaagactggctccgagtggacagcgcctggagaattcaccaagttcagctcccaggtgtccaagcccaggcggctcatggcctcccggaggtactactttgagttgctgcacaagcaggacgaccgcggctcggaccacgtggaagtgggctggcgagctttcctgcccggcctgaagttcgaggtcatcagctctgctcacatctccctgtacacagatgagtcagccttgaagatggaccacgtggcgcacgtcccccagtctccagccagccacgtgggggggcgtccgccgcaggaggagaccagcgcagacatgctgcggccagatcccagggatacctttttcctcagtgagagggggcccgcgcgggggcgagggcaggggtgcctgccccagccaccctgtgaccgcacctcctgcagctccacgcatggaatcttcgagcctggagaacgtgctggagccctgcgcctacgcccccacctacgtggtcaaggacttcccgatcgccagataccagggcctgcaatttgtgtacctgtccttcgtttatcccaacgactacactcgcctcacccacatggagacggacaacaagtgcttctaccgcgagtctccgctgtatctggagaggtttgggttctataaatacatgaagatggacaaggaggagggggatgaggatgaagaagacgaggtgcagcgccgagccttcctcttcctcaacccggacgacttcctggacgacgaggacgagggggagctgctcgacagcctggagcccaccgaggcggccccgcccaggagcggcccccagatccacggttgctaaacaggatcgggcagttgcctaggcataattaagtacagacatcagctagtacgggtatccatcgtatagtaggagagaaagatgtctgtggtacacgacagaataaggacataaggcgcatgcaaaatctggaggagcaataacgtcgtagggagacaggcactgcgcacacacg

SEQ ID NO: 503710 - DNA, 392 bp, Homo sapiens
gtgacctcctggggtagatactgaaactgtgacaagtgataacaaaactggcagaaatcagttggacccaatatggccaactggagtttctgcagaaagagcttgctgatatcacagcctgaatttccacgcatgtttcgtattaactgccccggaatttgatttgcacacagcacccatgaggaagcatgaagagataactgcgcatgtctgaggacttgccagacctcctctttccttccaccgatctcctgctaatcccggaacccaccctctaacccttttctaataaaattatttccttaaaggcagcacagcgagacagatttgagctggactcctgtttccgagttggtcaatttgcaatgaaaagcttttcttttctctgaaaa

SEQ ID NO: 503711 - DNA, 473 bp, Homo sapiens
tgatctcccactcagctgttaaagtgctgagatcacaggcctgagccctgctcagccctctgttttgtgtcatgtcaagtaatgtgatgacacgcaggtgggatgggggtgtgggaaaagctctgataacactttatgatcttaggatggaacttcgttgtgtcattgcaattattcgtcatggggatcgtactcccaagcagaagatgaagatggaagtgaaacacccaaggtcagaagagtgtcctaatttacataaataggtttttgtgaggaagactgcatggggggcaagtcctggaggctttgactgtctcatgccacactgaagcttctcgttacttcttcaggttttttgctctgtttgaaaaacatggtggctacaagacaggcaaattaaaactcaagcgacctgagcagctccaggtaaggtagtgaatctgaccaggaggaacagtgccatgagagagata

SEQ ID NO: 503712 - DNA, 112 bp, Homo sapiens
gtctctaaagcagagtgtgttggctgtgaaggcagagacgtatttttccctctagtactctgatttgtgagtgttcctctgctttctgaagggcagagactcttgagtatac

SEQ ID NO: 503713 - DNA, 883 bp, Homo sapiens
gaggagctgagcagacagctgagccctcacactcacaactagccaccgatggacatcgccatccagcacccctggatcacgccgcgcccattcatttcctgttccgagctcccccagccgtctcttagaccaggtgcttcgggggagcgacctgttggaagtctgaactggatgcccgacggtcttactttcccgtgatgtcccttctacgcaattcggacagcctccttcctgcgggcacccagcgtggttggacactggactctcagaggtgagtcatcacccaagataggacgggagaggtccattactggacacctccttggaaacttctcacataccagttttcctttcctacccatgcataaaacccattgacaggggcaccctggtgctgtccccaatgtgacaagacgcaactgagtgaggtggctaagatgccattcctaccccccacctcacccggttctctatgtgaatagtacctcttgtcaattccccactttaatcaccattcataatcatgccacgtggtcaagattacactccataccgcatccccttacgttctctaccaggggatacccctaaacatggtttggttcatggacaacgcctggcagggacacggacgctgccctgtcaaagcatcccgtggcatcaatccctcccagcacgtgggactctggacacgcacgctaccagcaccaggtgccacaagaccaggagacgagcccacgccccatccgagcatgctgcccccccactgggcacctctctgcatcacatgcccccgacaagaccacgagctgccacgacagacacggcgccgcacgggccacaaccacagagacacaacatcggcgccacagcaacggggcac

SEQ ID NO: 503714 - DNA, 248 bp, Homo sapiens
ctgaagttgacacagagtgggtgagggtgatggctccgggaaattggctggacagttgcacactctcctgagaggggatgactttgtacagtgtccccaaaaacatggagcgaacggcctgacaagggcctttgcaggtgtggattccttgcaacccaatgcccacggggacatgaaaccacgacaccacagaggataccaaccgtggcaacgggtgacagcggggatcggcccgcctgtcccaaacg

SEQ ID NO: 503715 - DNA, 860 bp, Homo sapiens
gctctcgccaggtgtcctcgtgaaggcccgggaccgcggatgggtgtcggcgtgaccaggcctgagctccctgtctctcctcagtgacatcgtctttaaaccctgcgtgcaatccctgacgcaccgccgtgatgcccaggaagacagggcgacctggaagtccaatacttccttaagatcatccaatattggatgattatccgaaatgtttcatgtgtgggaagcagacaatgtgggctcaagcagatgcagcagatccgatgtcccttcgtgggaaggctgtggtgctgatgggcaagaacaccatgatgcggcaaggccaatccgaggccacctgaaaaaaacccagctctgagaaactgtgcctcatatcggggggaatgtgggcttgggtgttcaccaagggaggacctcactggagatcagggacatgttgctgggccaataagtgtgccaagtgttgccgtgctggtgcattggcccatgttgaagtcacttgttgccagccagaacactgtctcgggccgaagaagacctccttttccaggctttaggtatcaccactaaaatctcccgggccccatttgaaatccttgagtggtggtgcagtgatcagaatgggcggccatgtgggagcagcgaaggcacgcttgttgacttggttcaaatttccctttttcttgggtgggcactcacgcaggggttcgccctggggcttacacccgaggtggtatcccggggacctgctttcctctggggggcgacagtgcactcttgtggtggccccgtgtggcgcccttattaagggagagccgcgctgggggacccccgagaggcgtggacagtttgcgggcccttgc

SEQ ID NO: 503716 - DNA, 443 bp, Homo sapiens
  misc_feature (23)..(23): n is a, c, g, or t
gctcatttcccaggaggagaagncctggcctgcccccaaccctaggagcccccccaggtgtgtgagtggcaagagcaagctcagaaccgtctcagcgctgggctgtgactgccagccacccttcatctagactgaaggaggttagcatttgccagtgtgttttctctcgatattcatgtacgtgtattttaaaagtaagttgcagtatcatgagactatttatccctagtgttgccctaagaggtagggccttttaccagaccagccagtgccacagccaagacagtagtcctgtcccactaacagccattgtctagtctgtacctaaagttgtctcccagcccccattctaccccattattttagtattggtattggatccaatcagggcaagaacattgtatgttattaaaaagtttctttgaaagctaaaaagttttccc

SEQ ID NO: 503717 - DNA, 319 bp, Homo sapiens
cctccgtctatgattgtcctggacccccagttgcaattcgtaggggctcatcaccgacaggtgcaaatgcctggcgcgggtgctccaggctgtaggcgccaatcacttcggcgaacggcaaggccttgtcgctgacggtggagtcgagcactccgagcttgagggtgccgcgcaattcgcctttcaacgcagcggtgtattgctcgaaaccttcgagttcgcccaacaggcgcagggtttcctgatgaaacagctcacccttgctggtcaggctgaagccgccacggccacgatggcacagcaccacgcgagtgaactt

SEQ ID NO: 503718 - DNA, 758 bp, Homo sapiens
agcggaaggggcggagctccgtggaaaccggaagtaactcttgacgggcactcggagcagttccgatgactgtccacaacctgtacctgtttgaccggaatggagtgtgtctgcactacagcgaatggcaccgcaagaagcaagcagggattcccaaggaggaggagtataagctgatgtacgggatgctcttctctatccgctcgtttgtcagcaagatgtccccgctagacatgaaggatggcttcctggccttccaaactagccgttacaaactccattactacgagacgcccactgggatcaaagttgtcatgaatactgacttgggcgtgggacccatccgagatgtgctgcaccacatctacagtgcgctgtatgtggagctggtggtgaagaatcccctgtgcccgctgggccaaactgtgcaaagtgagctctttcgctcccgactggactcctatgttcgctctctgcccttcttctccgcccgggctggctgaagcaacctacctcaagtctcaggagaattcatgtctgcctggggcccttccgaacctgtgccaactaagggcccccactgtaagcccccgcacccccaccccctgcccagagcaacagcctaaaggcctgccctgatgctctcctcctaccagagtgaagcccacagagtccctccacctccacaccaggccctctctccagttttatcccctgcctaatgctgcgagaagcacagaataaactttttgtcactc

SEQ ID NO: 503719 - DNA, 115 bp, Homo sapiens
gtacaggagcatgggccatacctgccatggtctttcccaatccagtggaactaggaatgtgctccaagccatgctcctacaaatgctagaaattgtagtgatctggagaccggct

SEQ ID NO: 503720 - DNA, 720 bp, Homo sapiens
  misc_feature (645)..(645): n is a, c, g, or t
tcgaaccacgcgtccggttccggtgagtccgtgggtggggtccccacctggttggaaggctgtgggtccgggaacccgagcccaaggagtgggggcggccccggagcgaggctcacactccctgccctgcagatgactgtccacaacctgtacctgtttgaccggaatggagtgtgtctgcactacagcgaatggcaccgcaagaagcaagcagggattcccaaggaggaggagtataagctgatgtacgggatgctcttctctatccgctcgtttgtcagcaagatgtccccgctagacatgaaggatggcttcctggccttccaaactagccgttacaaactccattactacgagacgcccactgggatcaaagttgtcatgaatactgacttgggcgtgggacccatccgagatgtgctgcaccacatctacagtgcgctgtatgtggagctggtggtgaagaatcccctgtgcccgctgggccaaactgtgcaaagtgagctctttcgctcccgactggactcctatgttcgctctctgcccttcttctccgcccgggctggctgaagcaacctacctcaagtctcaggagaattcatgtctgcctggggcccttccgaacctgtgcattaaggggcccantggtaggccccgaacccgaaccctggcagagaagcaagggctgcctgaggctctacaaagaacacagactcaaca

SEQ ID NO: 503721 - DNA, 275 bp, Homo sapiens
gacccgagttagacgggtgctggcacacgccacagggtaacacggtctgggcttgatgagagagagaacctgagatgctcacacatcaatccacctggatcgagataggccagtttctggaacgcagccgcagcatcgtgattcccatcggctccaatgagcaacacggccccaccggcctgctgggcaccgactggatgtgcccggaaatcatcgcccatgaagcgcaaaaaaacgccgacatcctgatcggcccgaccttcaatatcggcatg

SEQ ID NO: 503722 - DNA, 684 bp, Homo sapiens
taaatactgtccagattgtgaggtgttagacctatacgtctgcgggaacgggcagaaacaccacaggaactccaggacgggcccaaacatagagcctctgtactgaagggtaggcagctgagagctgcctcacttcagccctaagcatgtcacgggctctgcgtcgctcagagtttgctgatgctgatggatagtcccatgaaacgagctggcttgttaaaggtatatattcctacatagaagaatgttctgattgaagtgaatccccagatccgaattcccagaacctttgaccgcttttgtgggctcgtggataagaaagcttagaacaaagttagaatgaacttgttagtagggaagaatgggggaagacgaaaagggagcactaattgtggattcctaagcgagaaaatgggagaccaacctgattaataccacgacaaggccgttatcattttctatgtttgtggaaactccacttctgttcttgcagtagcttcctttctgagtgaaaaaggaattgaaccatcaaaatactggattgaattctgctcccagggtcaatatttagacggcgcactcgtgtagtagatttgtcctaataagtaattccatggatatatgtagtttctttaattcacctaaataccccaaagaaacaaaactacatcaacataccaaaca

SEQ ID NO: 503723 - DNA, 163 bp, Homo sapiens
acctgagggaactggactgacaccagctgggtgacagtggtgaagagtgaggtctgctactacagggactaactgtgcgctgcgacacatgcgtgctgtaggatgtacaggtgacgctgaggcgtggctgagtgttagctgagtatgcctgaggtccagaggc

SEQ ID NO: 503724 - DNA, 82 bp, Homo sapiens
actttgatctcaacacagacccctaccagctgatgaatgcagtgaacacactggacagggatgtcctcaaccagctacacgt

SEQ ID NO: 503725 - DNA, 1093 bp, Homo sapiens
  misc_feature (789)..(789): n is a, c, g, or t
  misc_feature (791)..(792): n is a, c, g, or t
agcggaaggggcggagctccgtggaaaccggaagtaactcttgacgggcactcggagcagttccgatgactgtccacaacctgtacctgtttgaccggaatggagtgtgtctgcactacagcgaatggcaccgcaagaagcaagcagggattcccaaggaggaggagtataagctgatgtacgggatgctcttctctatccgctcgtttgtcagcaagatgtccccgctagacatgaaggatggcttcctggccttccaaactagccgttacaaactccattactacgagacgcccactgggatcaaagttgtcatgaatactgacttgggcgtgggacccatccgagatgtgctgcaccacatctacagtgcgctgtatgtggagctggtggtgaagaatcccctgtgcccgctgggccaaactgtgcaaagtgagctctttcgctcccgactggactcctatgttcgctctctgcccttcttctccgcccgggctggctgaagcaacctacctcaagtctcaggagaattcatgtctgcctggggcccttccgaacctgtgccaactaagggcccccactgtaagcccccgcacccccaccccctgcccagagcaacagcctaaaggcctgccctgatgctctcctcctaccagagtgaagcccacagagtccctccacctccacaccaggccctctctccagttttatcccctgcctaatgctgcgagaagcacagaataaactttttgtcactctcaaaaaaaaagaaagacacaaacacgaaanannaaacacaacactgtgtgtggcgcgcgcgcgcctgtggcgcccccttggagagaagcgcctttcatgagaccaccttcgagttgtgggcggcgcgggggccccaggtagggggaaaagagtgagaaaaatgagtggatcaacaaatgcggtgtttcccacatgagagagacacaccgcggggcaccagagagaacaaaaggtgccgtgcgagaaattcttctccacaccatttaaaaataaagagcgcgccgcgagggaaaaaacagagaagcggtcttctacgggaaaacaaactctccag

SEQ ID NO: 503726 - DNA, 825 bp, Homo sapiens
tcgaaccacgcgtccggttccggtgagtccgtgggtggggtccccacctggttggaaggctgtgggtccgggaacccgagcccaaggagtgggggcggccccggagcgaggctcacactccctgccctgcagatgactgtccacaacctgtacctgtttgaccggaatggagtgtgtctgcactacagcgaatggcaccgcaagaagcaagcagggattcccaaggaggaggagtataagctgatgtacgggatgctcttctctatccgctcgtttgtcagcaagatgtccccgctagacatgaaggatggcttcctggccttccaaactagccgttacaaactccattactacgagacgcccactgggatcaaagttgtcatgaatactgacttgggcgtgggacccatccgagatgtgctgcaccacatctacagtgcgctgtatgtggagctggtggtgaagaatcccctgtgcccgctgggccaaactgtgcaaagtgagctctttcgctcccgactggactcctatgttcgctctctgcccttcttctccgcccgggctggctgaagcaacctacctcaagtctcaggagaattcatgtctgcctggggcccttccgaacctgtgccaactaagggcccccactgtaagcccccgcacccccaccccctgcccagagcaacagcctaaaggcctgccctgatgctctcctcctaccagagtgaagcccacagagtccctccacctccacaccaggccctctctccagttttatcccctgcctaatgctgcgagaagcacagaataaactttttgtcactc

SEQ ID NO: 503727 - DNA, 827 bp, Homo sapiens
aaacttacggctaggtacgaggcgggtgtcgcgtgggtggggtccccacctggttggaaggctgtgggtccgggaacccgagcccaaggagtgggggcggccccggagcgaggctcacactccctgccctgcagatgactgtccacaacctgtacctgtttgaccggaatggagtgtgtctgcactacagcgaatggcaccgcaagaagcaagcagggattcccaaggaggaggagtataagctgatgtacgggatgctcttctctatccgctcgtttgtcagcaagatgtccccgctagacatgaaggatggcttcctggccttccaaactagccgttacaaactccattactacgagacgcccactgggatcaaagttgtcatgaatactgacttgggcgtgggacccatccgagatgtgctgcaccacatctacagtgcgctgtatgtggagctggtggtgaagaatcccctgtgcccgctgggccaaactgtgcaaagtgagctctttcgctcccgactggactcctatgttcgctctctgcccttcttctccgcccgggctggctgaagcaacctacctcaagtctcaggagaattcatgtctgcctggggcccttccgaacctgtgccaactaagggcccccactgtaagcccccgcacccccaccccctgcccagagcaacagcctaaaggcctgccctgatgctctcctcctaccagagtgaagcccacagagtccctccacctccacaccaggccctctctccagttttatcccctgcctaatgctgcgagaagcacagaataaactttttgtcactc

SEQ ID NO: 503728 - DNA, 1160 bp, Homo sapiens
  misc_feature (856)..(856): n is a, c, g, or t
  misc_feature (858)..(859): n is a, c, g, or t
tcgaaccacgcgtccggttccggtgagtccgtgggtggggtccccacctggttggaaggctgtgggtccgggaacccgagcccaaggagtgggggcggccccggagcgaggctcacactccctgccctgcagatgactgtccacaacctgtacctgtttgaccggaatggagtgtgtctgcactacagcgaatggcaccgcaagaagcaagcagggattcccaaggaggaggagtataagctgatgtacgggatgctcttctctatccgctcgtttgtcagcaagatgtccccgctagacatgaaggatggcttcctggccttccaaactagccgttacaaactccattactacgagacgcccactgggatcaaagttgtcatgaatactgacttgggcgtgggacccatccgagatgtgctgcaccacatctacagtgcgctgtatgtggagctggtggtgaagaatcccctgtgcccgctgggccaaactgtgcaaagtgagctctttcgctcccgactggactcctatgttcgctctctgcccttcttctccgcccgggctggctgaagcaacctacctcaagtctcaggagaattcatgtctgcctggggcccttccgaacctgtgccaactaagggcccccactgtaagcccccgcacccccaccccctgcccagagcaacagcctaaaggcctgccctgatgctctcctcctaccagagtgaagcccacagagtccctccacctccacaccaggccctctctccagttttatcccctgcctaatgctgcgagaagcacagaataaactttttgtcactctcaaaaaaaaagaaagacacaaacacgaaanannaaacacaacactgtgtgtggcgcgcgcgcgcctgtggcgcccccttggagagaagcgcctttcatgagaccaccttcgagttgtgggcggcgcgggggccccaggtagggggaaaagagtgagaaaaatgagtggatcaacaaatgcggtgtttcccacatgagagagacacaccgcggggcaccagagagaacaaaaggtgccgtgcgagaaattcttctccacaccatttaaaaataaagagcgcgccgcgagggaaaaaacagagaagcggtcttctacgggaaaacaaactctccag

SEQ ID NO: 503729 - DNA, 184 bp, Homo sapiens
ggataagcagacactccatagtgaacagcctttacaggttgccaggtggacacagataatcactgctgattcggaggacccaaaatacattatcaccgtaaagcagtttgccaagtttgtggtggacctcagtgatcaggtggcactactgacattgaagaggtatgagagtgggcgtggatag

SEQ ID NO: 503730 - DNA, 158 bp, Homo sapiens
acaggatctcaccatgttgtccaggctagtcacgaactcctgggctcaagcagtcctccagcctcagcctcccaaggtgctaggattaggcatagagccaccatgcccagctggattctaacagttctgttacaagttagtatatacatgtatcatca

SEQ ID NO: 503731 - DNA, 803 bp, Homo sapiens
aaacttacggctaggtacgaggcgggtgtcgcgtgggtggggtccccacctggttggaaggctgtgggtccgggaacccgagcccaaggagtgggggcggccccggagcgaggctcacactccctgccctgcagatgactgtccacaacctgtacctgtttgaccggaatggagtgtgtctgcactacagcgaatggcaccgcaagaaggagtataagctgatgtacgggatgctcttctctatccgctcgtttgtcagcaagatgtccccgctagacatgaaggatggcttcctggccttccaaactagccgttacaaactccattactacgagacgcccactgggatcaaagttgtcatgaatactgacttgggcgtgggacccatccgagatgtgctgcaccacatctacagtgcgctgtatgtggagctggtggtgaagaatcccctgtgcccgctgggccaaactgtgcaaagtgagctctttcgctcccgactggactcctatgttcgctctctgcccttcttctccgcccgggctggctgaagcaacctacctcaagtctcaggagaattcatgtctgcctggggcccttccgaacctgtgccaactaagggcccccactgtaagcccccgcacccccaccccctgcccagagcaacagcctaaaggcctgccctgatgctctcctcctaccagagtgaagcccacagagtccctccacctccacaccaggccctctctccagttttatcccctgcctaatgctgcgagaagcacagaataaactttttgtcactc

SEQ ID NO: 503732 - DNA, 985 bp, Homo sapiens
aaacttacggctaggtacgaggcgggtgtcgcgtgggtggggtccccacctggttggaaggctgtgggtccgggaacccgagcccaaggagtgggggcggccccggagcgaggctcacactccctgccctgcagatgactgtccacaacctgtacctgtttgaccggaatggagtgtgtctgcactacagcgaatggcaccgcaagaagcaagcagggattcccaaggaggagggtgacgagagggccccggtgcagcccgggcgacctctcatctccaaacacctatagtcccaacccagcccctcctctccaaagcccagctcgttcccgagcccccagcccatctcccggatcaagccgagagctaactctggaccctctccctccaggagtataagctgatgtacgggatgctcttctctatccgctcgtttgtcagcaagatgtccccgctagacatgaaggatggcttcctggccttccaaactagccgttacaaactccattactacgagacgcccactgggatcaaagttgtcatgaatactgacttgggcgtgggacccatccgagatgtgctgcaccacatctacagtgcgctgtatgtggagctggtggtgaagaatcccctgtgcccgctgggccaaactgtgcaaagtgagctctttcgctcccgactggactcctatgttcgctctctgcccttcttctccgcccgggctggctgaagcaacctacctcaagtctcaggagaattcatgtctgcctggggcccttccgaacctgtgccaactaagggcccccactgtaagcccccgcacccccaccccctgcccagagcaacagcctaaaggcctgccctgatgctctcctcctaccagagtgaagcccacagagtccctccacctccacaccaggccctctctccagttttatcccctgcctaatgctgcgagaagcacagaataaactttttgtcactc

SEQ ID NO: 503733 - DNA, 123 bp, Homo sapiens
gagcagatcgccctcaagggcgccaagaagcagcttcagaagcttgaagcgcgggttcggactgaagaaggagcaggacaccagcgcccacctggagcgcattaagaagaacatgacagactg

SEQ ID NO: 503734 - DNA, 756 bp, Homo sapiens
aaacttacggctaggtacgaggcgggtgtcgcgtgggtggggtccccacctggttggaaggctgtgggtccgggaacccgagcccaaggagtgggggcggccccggagcgaggctcacactccctgccctgcagatgactgtccacaacctgtacctgtttgaccggaatggagtgtgtctgcactacagcgaatggcaccgcaagaagcaagcagggattcccaaggaggaggaaggatggcttcctggccttccaaactagccgttacaaactccattactacgagacgcccactgggatcaaagttgtcatgaatactgacttgggcgtgggacccatccgagatgtgctgcaccacatctacagtgcgctgtatgtggagctggtggtgaagaatcccctgtgcccgctgggccaaactgtgcaaagtgagctctttcgctcccgactggactcctatgttcgctctctgcccttcttctccgcccgggctggctgaagcaacctacctcaagtctcaggagaattcatgtctgcctggggcccttccgaacctgtgccaactaagggcccccactgtaagcccccgcacccccaccccctgcccagagcaacagcctaaaggcctgccctgatgctctcctcctaccagagtgaagcccacagagtccctccacctccacaccaggccctctctccagttttatcccctgcctaatgctgcgagaagcacagaataaactttttgtcactc

SEQ ID NO: 503735 - DNA, 144 bp, Homo sapiens
cttcaccttagaagtagattttatatttaactagtcacattttattaagtctacacagaagtacatgaaaatactgtatccatttgggtatagcacatggggcttgtatattaaaaaaacatttatctcctttcctccaatacc

SEQ ID NO: 503736 - DNA, 1091 bp, Homo sapiens
  misc_feature (787)..(787): n is a, c, g, or t
  misc_feature (789)..(790): n is a, c, g, or t
aaacttacggctaggtacgaggcgggtgtcgcgtgggtggggtccccacctggttggaaggctgtgggtccgggaacccgagcccaaggagtgggggcggccccggagcgaggctcacactccctgccctgcagatgactgtccacaacctgtacctgtttgaccggaatggagtgtgtctgcactacagcgaatggcaccgcaagaagcaagcagggattcccaaggaggaggaaggatggcttcctggccttccaaactagccgttacaaactccattactacgagacgcccactgggatcaaagttgtcatgaatactgacttgggcgtgggacccatccgagatgtgctgcaccacatctacagtgcgctgtatgtggagctggtggtgaagaatcccctgtgcccgctgggccaaactgtgcaaagtgagctctttcgctcccgactggactcctatgttcgctctctgcccttcttctccgcccgggctggctgaagcaacctacctcaagtctcaggagaattcatgtctgcctggggcccttccgaacctgtgccaactaagggcccccactgtaagcccccgcacccccaccccctgcccagagcaacagcctaaaggcctgccctgatgctctcctcctaccagagtgaagcccacagagtccctccacctccacaccaggccctctctccagttttatcccctgcctaatgctgcgagaagcacagaataaactttttgtcactctcaaaaaaaaagaaagacacaaacacgaaanannaaacacaacactgtgtgtggcgcgcgcgcgcctgtggcgcccccttggagagaagcgcctttcatgagaccaccttcgagttgtgggcggcgcgggggccccaggtagggggaaaagagtgagaaaaatgagtggatcaacaaatgcggtgtttcccacatgagagagacacaccgcggggcaccagagagaacaaaaggtgccgtgcgagaaattcttctccacaccatttaaaaataaagagcgcgccgcgagggaaaaaacagagaagcggtcttctacgggaaaacaaactctccag

SEQ ID NO: 503737 - DNA, 421 bp, Homo sapiens
gttggaggccatgattacggaatactgtttattgaagatgaccacgcgggcggagaacatctggttttcggtagagcatccgtcgacttcgctggccagctagagcaacgccggcagctcacagatgaagcgatccatcaagcggtgcgcgctcaagagtcgatcagcctggagcgctgtttgcgcaaccgagctggtgaggccgcttatccaggacgagctattctgcgtgcgacataggcgctgagtgacgagacccgcatagcgcaacgcgcaacacactgcattcgtgcggtccagagccatatgcgcctggatgacgcattcaggctaacccatatccagcgatgcgcacacctgtgccgtgcaatggctgcaatgccataacgctgcttcctacaagtcggccagcactgtgccc

SEQ ID NO: 503738 - DNA, 1048 bp, Homo sapiens
tttaaacaccgttgtcttggttttcagttgctcgcgttttgcccaaatgttgtggttttcgacatactttcgattgtgttctcccagctgttactatccaagaccgggttttgttaggtagcatacctctatgctttcactttgggtgcacttggtgccccataatctggtatttctcctgttactcctacaggggtggatatagtacatcctcaattgttggttggtaccaccgttgtcgggtttatcgcacctatatgataatgtgggtcatgctcattaatatctcgttggaactcaacggttggactcgctgacttaacgtcgctctaacttgttgccactaaactgatgctcttgtgtactctcttgtagtgggatatatcgcttccaaccagtacggctttttcgttcagtacccactatggtagcctcttgttgcgatgagtccacgttcactgctctctcttcttgtcaacactgtcctcgagtcagcctacgacacaactacagccttgcttcaatgtattcagttcgctacttacaaagatctctgcaatggatgctacttctgtactacaccacggttctgtcttcttgatactcttgtggaagctgttccagatcaactcgaatttcgccagtctagtgatgagtattctagcattaatgcatgtatgaacccagacatgatttgtaaagcgcgacagtatgtttctatgacactacactttttgatacagcgtctcttgtcttcactgtatacctggagtctccgttgtctgcttggctcccttcgagtttctagttacagacacagatctatagctgtgatatttagtttcttaatatggatatagctatcaagactgtgatacacttataattcactggtcctgcatcaggagatggagtggggaaaacatgtatgttaatacagtcttgtatctgaataatcctgtatgctttatacagtttgtcgttgttcagagaggctataaagtttgatctttgtttttctaaagattaccgccacggccccacttcg

SEQ ID NO: 503739 - DNA, 104 bp, Homo sapiens
gtgattctcaatgctgagctgacatgattgagcctgggcagagcttttgaaaaaatttggatgacccggggtcccgatgcccatgaaccaactgaaatgcaaaa

SEQ ID NO: 503740 - DNA, 287 bp, Homo sapiens
tgtgaagagagaatttcagttggggaatgatcttctgacattagtaaatggctactaatctcagtttgcagctttgtgcttttaagaggatgttaaagacagtcagaaacctccatctttagcctgtctgcaataattggactgtgacttggacctagatcctagggagaacatctggactccagtttcctatttccaaccctgactcggagttagaggctaaatgggtttgagacccaatcagcttaaaaaaggcaattcgaatatagataaatagcaacttatgc

SEQ ID NO: 503741 - DNA, 194 bp, Homo sapiens
  misc_feature (155)..(155): n is a, c, g, or t
tttcggggcagttgaacacggtggtgtgtaggtgctcggcgagcacagccatggggctccatgctctgcgaacagtgcggagccgcacctggactcaaactgcagcagttggcgcatgaagctgaagttgggagagatgatgcttcgccttctgnttcacaaactcaaagaccctcatcggtttatccaagtgg

SEQ ID NO: 503742 - DNA, 293 bp, Homo sapiens
cccccacttcacctccaggtcccagcactcagcagggcagggtctcagtgcggaaattaattggagtgaatgggcttctcaagttttaatactaggaaattcttgctgaatgcaaacactctggagccaacctacctgagtctcatcccagtgcagctgcgcgactataggcaagtcactcgaccctatgtgtgccaattaattcatctgtaaaaatggggggaagaccacctacctaatgcacatgttatgaagatgaaatgagtgaataacatgtaagtacttattggtga

SEQ ID NO: 503743 - DNA, 935 bp, Homo sapiens
gaatcctctcacgttggggtgtgtggcgtgtatgctgtgacagggtttttgttccggttctcgtgagttgcttgtgcccctttttcacggctagcgtgtgcccagttctggtggcccctttacctgtgctcggcaacacctgttgtggcccccccatgtgcatgccggtccagtttggtaaccccgcccttgccccttacgggcctttcaccctctttgccttcggcctagccattggtttcacttccagtccatacgctccgtcatactagggctacttaccatcccccgtgtccctatgcccatgatggcgccatgttacccgtgatccacattccaaggccacccacacaccacctgtcccaaaaggccttcgatacgggataatcctatttattacctcagaagtttttttcttccccggatttttctgagccttttacccctccagccttgcccctacccccccatttggagggccctggccccccacaggcatcaccccgctaatcccctagaagtcccactccttaacacatccgtattactcgcatcaggagtatccatcacctgagctccccatagtttaataggaaaccaccgaaacccaataattcaagccctgcttattaccattttactgggtcctctattttaccctcctacaagcctcagagtacttcgagtctcccttcaccatttccgacggcatttacggctcaacacttttttgtagccaccacggcttccccggacttcaccgtcacttattggctcaactttcctcacctatctgcttcatcccccacactaatattttcacctttaacactcccaacatcacctttggcttcgaagcccccgccctgatactggcattttgtagatgtggtttgactatttctgtatgtccccatctattgatgagggtctta

SEQ ID NO: 503744 - DNA, 249 bp, Homo sapiens
  misc_feature (128)..(128): n is a, c, g, or t
  misc_feature (134)..(135): n is a, c, g, or t
  misc_feature (190)..(190): n is a, c, g, or t
  misc_feature (217)..(217): n is a, c, g, or t
  misc_feature (219)..(219): n is a, c, g, or t
  misc_feature (242)..(242): n is a, c, g, or t
cccctctcctgctgcaaaatgagcagacgcttctagctttttcgtcttcttctgcggcctcccttcaagcaggcgcagcaggcttctctgggatctcatcttcagggaaaatgcctcctgccaggtcnctgcanngcttccggatcactttgtagagacgctttctgttctgagaaggggtgctctggcnggctggccatttcaaacagccctgttnancaaactgctcgtatcaactgganaacgtgg

SEQ ID NO: 503745 - DNA, 413 bp, Homo sapiens
ttcttttttttttttcaaagtctcgctcctgtcgcccaggctggattccgggtacaagcgattctcctgcctcagcctccaagtaactgggattacaggtgtccaccaccacgccggccaatttttgtatttttagtagagatggggttttgccatgctggccaggctggtcttgagctcctgacctcaggtgatccgctggccttggcctcccaaagtgctgtgattacgggcgtgagccaccgcgcctgcctagactccccatttctaagtgtacagttaattcactagtgttaagtacatttacattattgtgcaaccaatctccgtaacttttttcatcttgcaaaactgaaactctgtatccattaaataagaacttcatattcccctgtcccttctgtcgtcttctc

SEQ ID NO: 503746 - DNA, 1763 bp, Homo sapiens
  misc_feature (1)..(1): n is a, c, g, or t
  misc_feature (560)..(560): n is a, c, g, or t
  misc_feature (1430)..(1430): n is a, c, g, or t
ngccatcgtgcgggtgctggttcgtgagtgtcttgtgtgggggagtgcgtggctgctggttttgctgcctcgcgttctcggctcctgggctgggtttgagtgcggtccgacccacgcgaggtgttgcttctgggtcgctatgcctgtttgtgccgcccctcttgttgcgtccccctggaatggaccgcccgtgcttgctcgatgagcgcccgatgcgttttgtttggtgctctgtgctcggtctcgtcgatcatgtcgtgctcccgcccgctgttgtgttgttgatgtgcccgccgacggggtgtgttgttccgggagtgtgtagtgttgcccctttgatggaggtggggcgagggggatgtgtgtgtgttggttggttgtaataattagttgtgtttgtcttctcgcccccccctcgcgggatgtctgcgtttgtgtgccgccgttgccccccacgaggttggtgggacaagctttcttttttttcgcaggaagccccagggggggccctctgttggggtgtcgccaccacagcgtgattgtttgtttgtgccccgccnccgcagtggtgcgaagagagagaccacttctggtgttgcttgcccgcctccgaccgtttgggtagaattccatcgagagaccccccccaccccgcggctgtgtgttgaggcgccacagggttctcccccccgcaaggtgggagagattttcctttgcgaaggccccacagctgtgggggggtttttattctctgggggagaacttgaggacacacgcgcttctcgtgtgttgaggggaatcagccccgtttttgtggggtttgtagaagcacccctcgtagagtgaatatgatttcttccctcgtgtggccgcagcgattcacacggcgtattttctcgtgagaggttgttgggacctttattggaggtggtccaccgcgccgtctggtgtttcccccgggtagcccccccacacgccttgtgggagtgtagacacactggagacacaccgtcgggggtggtgttataaagagtgatgagggggcgcgcgtgtagtccgccctctgcccgcctcgcccccactctttggagggccccccctctggggagatgtctccctctgctctctgtttatggagacccactccgctatggggaccacactcccacctctgtgtatatttggggggatgatccccctctaggggtggtatatatttttgggggccgctcgcgagagttataaaatgattctcccaccgcggtgccccccccccagggagagagtgtttccccccctctgtatgtgtcccccgcgtgtagccccctcgcgtgtgtttccgctctctgtggttttcttgtgtgtgtgacacacctaacacgcggcgcgttttatatatataaaagaaatatagatgggcgtgttatatnttggtgtgtgtgtgttaatattgtgttgcgcgtgttttgatatacacacatataaacgtgcgccactgtgtgcccatatgtggggggagacattgcgtccaccccatatattgcgccccacctctgtccttgaatataggtgtttataacctagggagcgccattccagtgaatatattaattcaccttcttttagcacccctgtgtttacgcccatacaccacacacactctgcttagaaatattttaagacattataataaataccacatccctttgtgatgttccgtttatccctcccccaccccagattataagggttttaaaatttta

SEQ ID NO: 503747 - DNA, 171 bp, Homo sapiens
  misc_feature (53)..(53): n is a, c, g, or t
  misc_feature (89)..(89): n is a, c, g, or t
  misc_feature (122)..(122): n is a, c, g, or t
  misc_feature (140)..(140): n is a, c, g, or t
caacattttcggctgcattttttcacgcacctcggttcctcttcctaaagttnttgtgccctgctcttaagcaccatgggccttctaanacggaaggctctggaatctcccccttgtggggnaggctcttggggccagcntaaaatcatggtttagggtgatcagtgctgg

SEQ ID NO: 503748 - DNA, 270 bp, Homo sapiens
gatgagctcggtaccgtcagttgctgaactatgtgggccctgtttccccctttagtgtccacaggcgccttccatccagcctcgtactgtgctggtggtcaagttgcttgaccatttggggtctcagttgtctcatctcggacgtgggaagataagcctcccttctgtgccttgtaggaaggttacgaagctagtctccttgacccccaggggggtctgagctgctcttcgtctgtttggccatttggatgcacatagttcagcgtctga

SEQ ID NO: 503749 - DNA, 353 bp, Homo sapiens
tggttcacgcgtagagtcagactctgtcttcgtgtgttaatgattcactgtaaccttagctgcagagtgtgcttactcaagagcatctcatactaaagactttaaatgtcattacaatctctttattcctttccctcatagatcaaacttatccagagcaacaattatttccttctgggtgctaattttttcctcccatttcatggcactttcaaccaaagctagcaggcacactgcaatccttcattaactgaaaacatgcaaagtgcacaagcccttccaatggacagtgccaatgcaaaagccaaataaggtacatggcattacttgaccggacctgggacagttgggtc

SEQ ID NO: 503750 - DNA, 565 bp, Homo sapiens
agcggagcgcaggagcccggagagaagggctggaaggaggggactggacgtgcggagaattcccccctaaaaggcagaagcccccgccccacctcgagctccgctcgggcaagcgcctgactgcatgcgctgctgcgggcgcccacctcgcccagcatgccaggcccggcaccgacgcggggaagatccctttctgcgacgccaaggaagaaatccgtgccgggctcgaaagctctgagggcggcaggcggcccggcagaggccaggtcgcgctgcggcgcagccggacaagaacatcgcctggaggactgtcgtcctgatgagctcgctccacttgtggggcctgtttactccctggtgctcactccccacaagccaagaccaatcactctgactctgggcctacttctgcattcctcctggcacgctctgggtgtgacagtggtgcccatcgattgtggagccacaaggtcctaccgggccacggctgactctgaggatattcctggctgtcagacaactccatggattaccagaatgagcatccttcgagtggtccaggacc

SEQ ID NO: 503751 - DNA, 127 bp, Homo sapiens
taaggatccattagaccaggctgatgcgggaggccaggctctctgcgggagcagcgggcagctcacgagggaggacttacagcgactcccagcgtgaaaaggtttaggcagctacgggcagggtggg

SEQ ID NO: 503752 - DNA, 211 bp, Homo sapiens
  misc_feature (48)..(48): n is a, c, g, or t
  misc_feature (120)..(120): n is a, c, g, or t
  misc_feature (123)..(123): n is a, c, g, or t
  misc_feature (139)..(139): n is a, c, g, or t
aggggacaggcactcaggagggcccagtaaaggtttaaataaagtggnttgagtaaaactggaggccaaaagtcgacgtgagttcctgggagtctccaaaaatggggcctggaggcctgnagnaaggggccaggcctcncatttgtggggctccctgaatggcagcctgagcacagggtaggcccttaataaacccctgttggataagcca

SEQ ID NO: 503753 - DNA, 112 bp, Homo sapiens
  misc_feature (53)..(53): n is a, c, g, or t
  misc_feature (75)..(75): n is a, c, g, or t
  misc_feature (87)..(87): n is a, c, g, or t
ataactttgtgatcctccacgccagggcagacgaacacatcgccctgcggttncgggagaagctggaggccttgngtgcccgacggncaccttctgcgaggatttccaggtg

SEQ ID NO: 503754 - DNA, 267 bp, Homo sapiens
acgctggcccccctatggccctgaaaggggcatgctcggcttgtttcatgggctgagtggttcagtgacttgctcgggatcccaacccccgcccaggagccccccacatggcctgggctggttttcttccaactctaaaaacagccctcatttggttaacagtctttttcattttcaacccttctttcttttgaaggggggagcaaagggggatcgggtgccttttataattctcgttttcaatttccatctcttttaaaatgttga

SEQ ID NO: 503755 - DNA, 108 bp, Homo sapiens
gttgggagcatgatttcctaagaatcagggcatgggagtacaatccaagttctcgcttcctcctttgggcatctcttctgcctcccaatcaaggaagctccatgctca

SEQ ID NO: 503756 - DNA, 314 bp, Homo sapiens
ctagcagttccagcctggtgcagagtgagacttgcgttaaaaaaaaaaaggaaaaggaaaaaaaagttctactgtgggtaaaatgctatcatgctatcaaacagcatcacatgctacagagaagtcttgtgaaaggatgtcagtgtggcaaacttcattgtcttttaagaaattgccacagctatcggtaatcttcaaccaccaccaccctgatgagtcagtagccatcgtaaacgtgggcgtaagaccctccaccagcaaaaagatcgttagcattttttaagcagtgatgtatttatcaattatacataatg

SEQ ID NO: 503757 - DNA, 100 bp, Homo sapiens
agatggcggaggtgcaggtcctggtgcttgatggtcgaggccattttcctgggccgcctggcaattcgttggctaaaacaggtactgtcggccggaaggt

SEQ ID NO: 503758 - DNA, 302 bp, Homo sapiens
tatctgactcctcgcggaacacagcactctgggcgtctgctgcatggaaacaggctctgacagtgcttatccccaaccagctttcatcctgaacccttaacatttaccttctacgggaagtctgcctgtagtggactgaagagtggtccccaaaagatatgtccaagtcccaaccccaggtatctgaaagtgtacctttatttagaaatatgagatcaccctgaattagagtgggccctaaatccaatggtgtgtcctcataagagacagaaaagaagatgacatacagagtagaggtgaca

SEQ ID NO: 503759 - DNA, 578 bp, Homo sapiens
  misc_feature (578)..(578): n is a, c, g, or t
aaaaaaccggggggttgtcctttttccccccgtttttgggggccaggaacccaaaagcggttgaaaggggttttttaggaccagggcctttcccagggttttggtccaggggcgggttgaacccccccaaagggggaacgggggcggggggtttttttccaaacgggcccccccatgggtggggggggggggcctaagttccctgccccagggcccccctaaaagggccctggggggcccccggggaaaaaaaggtggttttccccagggggcccccggggggaaaaaacaaggcaggggggcccgggtttttttaaacccacccttggagggggccaaacatttttttgcctttttccctggggccccccccaccccgttgggggggggccctcccggggccggtttctcgggaagccgtttttgggtgggttttcccccgcccatgggcccaattccgggccccaccacagggccgcttctcgggaaaaaaaaaaagcctccccaaactcggcgcgggggaaaaagggcaaaaaggttcccggggaaaatggcgcccccccactggagggggcccn

SEQ ID NO: 503760 - DNA, 150 bp, Homo sapiens
  misc_feature (99)..(99): n is a, c, g, or t
cttgtccttggaaggaaataccatgctaagtaactacaagtaaagatggttataaaaacaaggtattcctgtagacgattgaaaccacactagagaganatactcgacatatgcaaatcatttggaaatgcacttaatgatgttgaggaa

SEQ ID NO: 503761 - DNA, 310 bp, Homo sapiens
ctaagaatattcaagacctcatggatcatgaagctgtccacgagggcttggatcttcacttgcggctactctaccgattgatggatatgagtccagatgccagccttattctacaattccagaatgaactagatggcattatccaagatggtgtgcacaatatcactaaattgattaaaatgtctgagacgcataagctgttgaatttggagggctttctatcagggagccagtcacgattgtcaggaaccttaaagagccaagctagaaggacacgcggcaccaaaagtttagggagtaaagctactga

SEQ ID NO: 503762 - DNA, 510 bp, Homo sapiens
gtccaagatacagactttgtgataaggctgaagttggggcatcgtcctagaaacggtggcacacggcgggttgtgacgtcggtggccttcatgctcactctcccgatcctcgtctgcaaggtgagggactccaacaggcgaaaaatgctgcctactcagtttctcttcctcctgtgtgtgttgggcatctttggactcaccttcgccttcatcatcggactggacgggagcacagggcccacacgcttcttcctctttgggatcctcttttccatctgcttctcctgcctgctggttcatgctgtcagtctgaccaagctcgtccggggaaggaagcccttttccccgttgatgattctgggtctggccgtgggctccgcctagtcccaggatgttatcgctattgaatatattgtcctgaccatgaataggaccaacgtcaatgtcttttctgagcttccggtcctcgtcgcaatgaagactttgtctcctgctcactaagtcctcttc

SEQ ID NO: 503763 - DNA, 782 bp, Homo sapiens
tcgagccacgcgtcggcatttaccatctcacttctaggaatactagtatatcgctcacacctcatatcctccctactatgcctagaaggaataatactatcgctgttcattatagactactctcataagccctcaacacccatctccctcttagccaatattgtgcctattgccagtactagtctttgccgcctgcggaatgctccggtgggcctagccctactagtctcaatctccaacacatattggcctagactacgtacataacctaaacctactccaatgctaaaactaatctgtcccaacaattatattacctaccactgacatgactttgccagtaaaacacataatttgaatcaatccatcaaccacccacagcctaacttattagacatcatccctctatctatattatttgaaagccgatgaatcaaacaacaacctatttagctgttccccagagcttttcctgccgaccccctaaaaacccacctacatattactaactagcctgactcctacccctcacaattcatggacaagcccgaactccaacttactccagtgaaaccactatcaccgaaaaaaatctctacctctctatactaatctccctacaaatctccttaccttatcatcattcacagccactaggaactactccctattataatatcttcttcgaaaccacacttatccccacccttgtctatcatcgccccgatgaggcacccagcaaaactgcctgaacgcaggacatacttcctattctagcacct

SEQ ID NO: 503764 - DNA, 838 bp, Homo sapiens
ctacgagtattttttttattttttaaggttggaggggggaatgctggagatggtaaggggtatggagacatgtcatataagtaaggctagggtgagtggtaggaagtttaatcataggaggtgtatgagtgggtcgtagcggaatcgggggtatgctgttcgaattcataagaaccagggaggtaaaaagtagggtctgggtgacaaacatatgtggtgtagagttcaggggagagtgcggtcatatgtggttcctaggaagatagtatgggagagggtgttatgataataaggtaggggtatcggatatgaagaatagggcgaaggggcctggcggcgtaatacgatggtatgaagcctagagactagtgcggactacccctaacggcaaggtcgaagggggtacggtagggactacggctaaggggggagataaatcatattatgggccaagggtcatagataggcaggagtaatcagaggggtactaggggtcgggagacaaggggtgggcaaggttacaaggagccactatatacggagaggtgagaaaagtacaaatagatcggctcagggggacctcccaaatgaagatgtgtaggggctacatgcatcgacagggcgcccgaaaacagggcgataagatgaagataagaagcacaccctgaatcgaggatggaagtaaaacggtaagaaacacggggcaaaaaaaaaagcggggccagggtagggagaccagaggacggaaggggagaggggtcacaaagaagaacagtaggaaaaacagaccgagcggacataagagacgtaaggagcaacgacgacgcgaaacacacag

SEQ ID NO: 503765 - DNA, 183 bp, Homo sapiens
aacacattaacatttagttacactggcattactcttcaaggctgacctcctgtctaatgttcagtaggtagctgcaatccgtcacagaaataatctcactgcagaaagaatgtgcactcttaaaatgaaccaggacctccctgtgattggccttgcgttgcgatttaccagttgactcttgtg

SEQ ID NO: 503766 - DNA, 364 bp, Homo sapiens
acgtgttacgaggggaaaatgcctaaagagaagagactggtgcgagaaaacaaggctgagaactgccgagaacgtgaaaagacaactaagagcatctggaagcactatagatttagcttaacatccagtgtaatgcctcaatggaatgtgacgtggtgtcagatgcggcagaagaataaagcattttgctaattttgtaattctgtacagaagttaccaatttgtgcacagtgtgggaaaacaaagtgcatgatgaagtcttcagactgtgtcataaagcatgctggtgtatacagtactgggcttgcaatggtggcttgtttctgtgatgatcatacaaggagcaaagtgtttaagcgagaaa

SEQ ID NO: 503767 - DNA, 129 bp, Homo sapiens
  misc_feature (106)..(106): n is a, c, g, or t
ggtagtgagtctcgggtggtctgaggtgtgggggcagcatgcaggcaggatgccgggcgtggaatgctgagttgccgtagtgggccacgtgttgtgcgagtcaagncagaactgtcgggctagtcgggg

SEQ ID NO: 503768 - DNA, 938 bp, Homo sapiens
  misc_feature (77)..(78): n is a, c, g, or t
  misc_feature (129)..(129): n is a, c, g, or t
  misc_feature (195)..(195): n is a, c, g, or t
  misc_feature (225)..(225): n is a, c, g, or t
  misc_feature (232)..(232): n is a, c, g, or t
  misc_feature (242)..(242): n is a, c, g, or t
  misc_feature (261)..(261): n is a, c, g, or t
  misc_feature (265)..(265): n is a, c, g, or t
  misc_feature (267)..(267): n is a, c, g, or t
  misc_feature (272)..(272): n is a, c, g, or t
  misc_feature (286)..(286): n is a, c, g, or t
  misc_feature (288)..(288): n is a, c, g, or t
  misc_feature (296)..(296): n is a, c, g, or t
  misc_feature (319)..(320): n is a, c, g, or t
  misc_feature (323)..(323): n is a, c, g, or t
  misc_feature (327)..(328): n is a, c, g, or t
  misc_feature (339)..(340): n is a, c, g, or t
  misc_feature (342)..(343): n is a, c, g, or t
  misc_feature (349)..(349): n is a, c, g, or t
  misc_feature (360)..(360): n is a, c, g, or t
  misc_feature (363)..(365): n is a, c, g, or t
  misc_feature (372)..(374): n is a, c, g, or t
  misc_feature (382)..(382): n is a, c, g, or t
  misc_feature (385)..(385): n is a, c, g, or t
  misc_feature (391)..(391): n is a, c, g, or t
  misc_feature (394)..(394): n is a, c, g, or t
  misc_feature (399)..(399): n is a, c, g, or t
  misc_feature (409)..(409): n is a, c, g, or t
  misc_feature (425)..(425): n is a, c, g, or t
  misc_feature (431)..(431): n is a, c, g, or t
  misc_feature (447)..(447): n is a, c, g, or t
  misc_feature (452)..(452): n is a, c, g, or t
  misc_feature (500)..(501): n is a, c, g, or t
  misc_feature (511)..(511): n is a, c, g, or t
  misc_feature (573)..(573): n is a, c, g, or t
  misc_feature (591)..(591): n is a, c, g, or t
  misc_feature (920)..(920): n is a, c, g, or t
gccttattgcaaatacaggtaaatgacagttttgtgtatatatatatttgtgtatatatagttgtatatatgtatanngcagtagacacaaagggagagcaatcacagatcagtggttttgtgtttgtnttgttgtgtgtgtgtcattgttatttaactcctgtaccagaccattttactgattatttcaaagangtaaatattatcaatacattttacagagcngtctgancttttatgcngaaacaagaccgggatggnaaangngaaantccatttataaatntngggcattngcctaatccaagagtatattaannggnaggnnatactactagnntnngggcgnggggggcgggnggnnngggggcnnnccacacangcnctaccnggnttcgnattgggggcnccaaggcctatgtggncaaggngtcggtgacttaggcnactcngcgggggggagacatattccctaggcttcacgggggggcggggggaanncatgatagtngcctcagatttggctctggcctcctcatcttccacagcctccctatattgttctggccagtnctgtggtcgctttctgtngagcctggccatgtactccaagactttcattttgatggtttcatggtgggctcgagggccccatagaagctcatattcaactggattagagtaggacagtggcctgcattccagatagcgctgtctcataagcttacgggtgatggaatgctttctccctacatccacactaaatcttcgaagcaagttccagacattggcctctttgacacggttgcccatcaggaagatcaaacctaggattggcattacatattcttgagtgggtctccccaggctctctagcatcacttgctcttcctctgattctggttgctggacaaggaggnagatgtgctcactggtat

SEQ ID NO: 503769 - DNA, 288 bp, Homo sapiens
caggcagtcagatgctcacatgggggtgtgggtgctgttccaggccgtccgatgctcgcctgggggtgtgggtgctgatccaagctgtcacgtgcacacctgggggtgcaggctgctgttccaggctgtcagatgctcacctgtgggtgtgggtgctgttacatgctgtcagatgctcgccatgtggtgcgggtgctgctctaggctgtcagatgctcgtctgggggtgtgggtggtgctccaggctgtcggatgctcacctgcgtgtgcagtgttatgggctcccgt

SEQ ID NO: 503770 - DNA, 1314 bp, Homo sapiens
  misc_feature (594)..(594): n is a, c, g, or t
agcggggggggagaaaacaaagcccccatgctgtcagcaaaaggaaggaggcgacgagcagccaggagacagtgtccgtgtttgcccgagaggaacagttcatttctgagcagccagggagaaagcctgagtatagcgtccaggtagtgggacatggcggtcaaattgtgtcaattaacttaccatcgatgaaccctacagaagactatgcagctagaactatgtactatccatggacatgggatttaatgaccatcatggtgatcttatgaatactacacgaaactgtggtaaacagtgtctgggtcccaggcaggcggcccgtatttgcccatcttgccaagtggcagcaatgtcctccttttcacacttgggacatggcagttgaaggtgttagcataggaagacgtgatacaaatgtcttccacctgccaaagacgacttggggaacgatagaagagttgagtccccatcacagtttctttacataccattgcctggcacgagggcaactcagtattctacatgcagagaattgcaaagcgtttcgaataaagcggaacatttcccagcttggaatggaatggcataggnttgaaaagggggacggtgtctcacggtgggacggaaccggtggaacttggtaaatcctgaaatgcgattctcaaggaacatgttctatctgactggcctaaagcttaccgcactgggggaaagggaagctttgtgaggtccctgttccggaaggtgtcacctggaccaatagggggccaaagaattgccaacaatgtacccgttcttcttccctgcaacccctgtggggggaaagcaagtgattcgtgttcaaaaagcatgattccgaaaagaaaagagtctccaaccgagtgtcggggatcttcgcgcccaaacagattgaagttgatgaggcgttaaatcacgaagtttcgcgagaaaggagcttaaaacccagggcattctcagggagcctttgttcggaagcactccattggaggcccatggaccaggggggtttgccattccaaggtgggacttccagctattcctcaaaattccgcagtcaaaagacatttacgaaaaccgccagaggtctattacgaggcttttcacttgtaaccgcggttaacacttctacttataaacgctttgtccgccttggaaacggtcgttgtgaacatagtgcgaaccagggcggatatccgcttacttataggggacaacagctggtgaacatgcaaaatccgacacggactagtacttgacacgacaaccacaggggagcacagacataatgaa

SEQ ID NO: 503771 - DNA, 198 bp, Homo sapiens
  misc_feature (193)..(193): n is a, c, g, or t
  misc_feature (196)..(198): n is a, c, g, or t
aaggaaaaaaattttttttaattatctggacacagtagcatactcctgtagtcccagctagctactggggattggggggatggggaggtaaggtgggaggatcacttcagcctgggaggttgagactgtcatgagccatgatctggcaccactgcactccagcctgggtgacagagcaagaccttctatcagnttnnn

SEQ ID NO: 503772 - DNA, 1398 bp, Homo sapiens
  misc_feature (328)..(328): n is a, c, g, or t
  misc_feature (481)..(481): n is a, c, g, or t
  misc_feature (505)..(505): n is a, c, g, or t
  misc_feature (547)..(547): n is a, c, g, or t
  misc_feature (1096)..(1096): n is a, c, g, or t
cgacccacgcgtccggtgttggcgcatcaactgtacatcccacgtctactcgtgacggctgaggcaggaaaattgctttgaacccagtgaggcagaggtatgcagctgatgcttgagatcgtgccaagcttgcatctccaggtactggtgcgacagatgcgagactccatctcaacataaaaataaaaattttaaaaacatgtaaaagatatatctatgacgcattcggatgagctcctacaacctctgatgcgatctctagagctctacttatggagcacgggctctagcatggtcgagagacgcgaatcagcatgtgaagctccgngcaaatagagcagaaaggcgttgcaaagatagacacgctaaaggagtcggatcgtccgacgctcacaatcttccaagcccctggacgttggaactagacagtgtggagaaaccactcctgttccttcctaagaacaatacgaacacagaatanatataatttaagcgccaacacttntgcagtgaacacacatgatgcaaaagggatagagtggtccancgagaaccgagggggggaagccatgaagcgcgcgtggtctggaagtctaccgtgtaggtccccgtgaggtatcatgggaccctatgcgctgggggttgatactagcaggttggacatccccccttgattcgtgcttaccatgaatagatactcctaataacatatatttaagcccaggtgggcgccgttggagccattcgcccctcgttggtgggacccccgggggctaatttgccggagcagaggaggctggaacggggccaggggcagaacacaccttgctcgggtgagaaacccccccaggggtgaaggagtccggcgaaattgcttttgtaggacacagtggtggacgccccagaagagaatgaaggcccgcccaagctgtggccactgcattcttaggtaccccgtgagggcgcgtaagaaagtagccggaaggaatcttccccggaaaggggcgggggcgagagaccatcaccgcggaaggcggtcaagggggcacgaattcccgtagccaaaccaattcaccgtgaggcgttagaactaacngaagtttgaacaaacccccccggtgtatttctttacggattaataacattaattaacatacacagagagggcgggcggccgggcagtcccataggaagggaattcacgcctcacagaagtgctgtcgcccctatgtgtgaattgcgcgaacaccccgagttctcttttttgtacacacagtcggtggcgccatataagaagagggcgtcagataacaatcaacgcaatatgagcagggattgaggcagcgatcttacatcaaagtgtcaggcaactatgggggacaacaccgcgtgtacctc

SEQ ID NO: 503773 - DNA, 160 bp, Homo sapiens
cttacacgagggaacattatgggtctcccttgcaatagagctctgcttctctactagactggcacatgtaagacgtgtctattcacctataccaccatagattgtagaggcctgccccaagccatgtaggaactagtgagtacatatcaacctactttac

SEQ ID NO: 503774 - DNA, 231 bp, Homo sapiens
  misc_feature (45)..(45): n is a, c, g, or t
tcttcaggagggtgctgtttcatggggggcagcagcttcacagtnctgcgttgcaccagcttttgacttggagagctgtgcccaacccttgaccggcaacttacttccttaggcttgaccttgcttcaggatcaaccttcttcccttgcccttcttacttcttacttgggggcccaataatggccctttggattcgcttcacatgctaagggagccacaggtgggagccag

SEQ ID NO: 503775 - DNA, 139 bp, Homo sapiens
tttgtcctcatcgctaaacttgccttgaagtttctcatcttcaacatgcgcttacatgacgaaggcatagtactcaagagaattcttggatgacaccttgaccctccgctattaatctacagcttagcacttctcagct

SEQ ID NO: 503776 - DNA, 123 bp, Homo sapiens
aagtagatcgcgtgcgggagtgtgcgagagatgcatgctcagtcctcagaacttaaagtgtgttctcaactcacagtggtagcgtgtgctagagcatgtgatgtcttgggggtgtccttcttc

SEQ ID NO: 503777 - DNA, 358 bp, Homo sapiens
tcccagctaatttttgtatttttgatagagacaggcttccaccgtgttgaccgggctggtctcgaaactcctgaccgcaaggtgatctgcttgccttggtctcccaaaatgctgggattttacagacatgagccgctgcacctagcctcattaatgctattttaaaagtgaaaaatacagtagacaacactggcttaacacaaaatttcttagtcagtgtgagactggtcaaaaaaaatgggccatgatcagaaatgtaaactttaggttctttaagtcactgttacaagagcaactcaaatttggaatatatggaagggagattataatgcaaattaatgattattttctatcctaa

SEQ ID NO: 503778 - DNA, 403 bp, Homo sapiens
ggcacgaggagaccctacacacagattacattgactatatggatgaactctcctccttcattgtggcacagcccaacatcccatggctgtttctcacagatcccacattggccatggaagtttattgtggcccttgtagtccctaccagtttaagctggtgggctccagggcagcggccacgagccagatatgccatactgacccagtgggaccggtcgctgaaacccatgcagacacgagtggtcgtgagacttcacaagccttgcttctttctccattggctgaagctctatgcaattcctattctgataatcgctcgtgtccttgtgttgacctaatcatcattctctctaggatgtctggttactgactacccagacagaggctctgctatatatattt

SEQ ID NO: 503779 - DNA, 426 bp, Homo sapiens
ggtacccgtcctctgatccagtagggtgaaatattgccaagaataaactgtattcatcatttactgacagtgattgtttgctttagcagaataggcgagcgtggagtataaaggaagttgaaatcctgggccttatgtgtgtagactggcaatgtccatttgaagattttgcatttcctcctagtgtcagcgaaaatgtgctaaaaatttcagttaaggaacagggtctgttccacaaaaaagacagtgccaatcaaggctgtgttcgaagagtttacctgaaggacaccgccacagcagagagagcatgtaatgccattgaggatgcacagtcaacgagacagcagcaaaaattgatgaagcagtcatcagtgagacttctcagaccccaattgccatcttaatcacagacctcaggggctccaa

SEQ ID NO: 503780 - DNA, 397 bp, Homo sapiens
tatataccaacatttatgtatctctttacatagtccattacatattcacacatatgtactttttagtgcacacacaaccacagtttttaatcaatggataattacactagaagatctttccttatcaaaatatacagatttttttaaggaattaaaaaatattccattgcatggatatgccataatttattaaaccaggtcactgttaaagaatactttgtttccagagttttttccttccaaaaaacgaagaccaaagaatacaaaaacatttattttatcaaccagtatttctgattctcacaagcactgcggatttcaaagcactcacagatcttaccaacagaaatcaggtttcctacatccgcagagaagggggccatgggggcccatcttt

SEQ ID NO: 503781 - DNA, 184 bp, Homo sapiens
taggaatagcgatagctgttaatagtctcattgcaatagctatagaacactcagatggtatgcactgaggtttgcagctccattgaggctaccggcgcgattcatggcgtaccactgttgcagcacccggtcgttgccaaggttggctgtcgcgcaggctgagaggcgtagtaggttgtcccag

SEQ ID NO: 503782 - DNA, 930 bp, Homo sapiens
  misc_feature (187)..(187): n is a, c, g, or t
  misc_feature (205)..(205): n is a, c, g, or t
  misc_feature (243)..(243): n is a, c, g, or t
  misc_feature (247)..(247): n is a, c, g, or t
  misc_feature (253)..(253): n is a, c, g, or t
  misc_feature (257)..(257): n is a, c, g, or t
  misc_feature (315)..(315): n is a, c, g, or t
  misc_feature (319)..(319): n is a, c, g, or t
  misc_feature (345)..(345): n is a, c, g, or t
  misc_feature (375)..(375): n is a, c, g, or t
  misc_feature (377)..(377): n is a, c, g, or t
  misc_feature (397)..(397): n is a, c, g, or t
  misc_feature (407)..(407): n is a, c, g, or t
  misc_feature (430)..(430): n is a, c, g, or t
  misc_feature (433)..(434): n is a, c, g, or t
  misc_feature (436)..(436): n is a, c, g, or t
  misc_feature (446)..(446): n is a, c, g, or t
  misc_feature (466)..(466): n is a, c, g, or t
  misc_feature (495)..(495): n is a, c, g, or t
  misc_feature (527)..(527): n is a, c, g, or t
  misc_feature (534)..(535): n is a, c, g, or t
  misc_feature (538)..(538): n is a, c, g, or t
cacccaggcgcacttctcccgggagagcggcgcggatggatccaacatggcggcgccgagcctgagccgagagaagagacctgggaaattaagtttcttgcggagtacggtggggattgcagctgctgagcagggattctggaaagcattggtacctgagcccccagcatggcgggcctaaagcggngggcaagccaggtgtggncagaagagcatggtgagcaggaacatgggctgtacagnctgnaccgcntgtntgacatcgtgggcactcatctgacacacagagatgtgcgcgtgctttctttcctcttntgtngatgtcattgatgaccacgagcgtgnactcatccgaaatggacgtgacttcttatngnacctggagcgccagggccgntgtgatgaangtactttcgccaggtgctgcagntgnngngcatcatcantcgccagactgctgccctangtcacctcaagaggagacgggctgtgtgncctgatcttgtagacaagtatctggaggaganatcaatnncgntatgtgaccccagaagccctcaggtgatccagaaccaaggctccccagcctctaaaaacagtgctccccatattctgtgggtgtgttgcccccacttcggttctcagatgtgttgcagcgtcagcccgaggagagccacatgtggggcagcgaaaacgcggagtcactgaaccagattccaagggaacggactttgactcagactggggtcggtaaatgccatgagatgtcggcgggttttttttaagacgacctgaggcattgaggtaacagacacatctagcggacgggccacgggacagttggaccacgcactgggaaaaggttaacggagtgtcaccggggagactgataggctgcgcgcagtgtggctgcacatgcggactcattcg

SEQ ID NO: 503783 - DNA, 153 bp, Homo sapiens
aaaatattagccaggcatggttacatgcaacctgttagtcccagctacttaggaggctgaagcgggaggattgcttagcctaggaggtcgaggctgcagttagctatgattgcacctttgcactctggcctggtgacagagcaagttcctctt

SEQ ID NO: 503784 - DNA, 383 bp, Homo sapiens
tcttggcaaagggattgttggtgataccaggaagagcagcttcagtggctcatggggagagaagccagattacaggagatcagcaactgagagagtgagtggagagcatcttttaagaatgtcttgagtgcgggccggctgcggtggctcacgcctgtaatctcagcactttgggaggccgaggcgggcgaatcacgaggtcaggagttcgagaccagcctggccaacatggtgaaacccgtctctactaaaattacaacaattagctgggcacggcgcagtggtgcgtgcctgtagtcccagctactcgggaggctgaggcaggagaatcacttagaccagggagtcggaagttgcagtgagctgagattgcgccactgcac

SEQ ID NO: 503785 - DNA, 388 bp, Homo sapiens
ccccttattttcccttctttattgtttaacaacatcagctgctgtcaagtctttagacttcttctctttatgtttttcttctttgtgcttttctaggtgaagcatgtttattgtaggcagtagatatttaggtttgtatttttatccattaaggtactctgtttttgattggagagttcagtccatttacatttaatgttatttctgataaggacttattgctgccattttgttttttgttttctggttgtcttgttgtcttccttcttgtcttccttattgtgaaattgattggtgatatgttttaatttcttgctttttatttttttgtctatctgtggtaggctttttgatttgtggttctcatgaggcttgcaataaagaagga

SEQ ID NO: 503786 - DNA, 717 bp, Homo sapiens
  misc_feature (452)..(452): n is a, c, g, or t
gcaggaatggcagtcacgatgatgagaagtttttaattgttcttttttatttgattttggaattcaggtgcactctattcaagtgcaaggatatcagaagtttttttttatttaaaaattttttttttcgagatggagtttcactctgttgcccaggctggagtgcaatggcagcttactgcaacctccacctcctggttcaagcgattctcctgcctcagcctcccaagtagctgggattacaggcacgcgccaccacaccgtggctaattctatttagtagaaagaacgttgccgccacgttttcttcaccatgttggtcaggctggtctcgaactcctgacctcaggtgatccacccaccttggcctcccagcgtgctggattataggcatgagcaccagccggccccaggattttatattaagccttcttgctctcaaaaaaaaaaanggttttaactattccatttccagatgaatcccatgagcgcgtgctatactgggtgtcgcaaaaaatatcaacccccccaaaaagggggggcgtctagggggcttcgggttccggtagacttgcacacgtggtctccatccaagggccttttctgaagttacagaaaacaccaacatgggagggagtctatgaagcaaaggcaaggcaacacgtcggctagcttcaggatagcaccgggagaaaatgggggctgtatgcgaatacg

SEQ ID NO: 503787 - DNA, 381 bp, Homo sapiens
gcaggaatggcagtcacgatgatgagaagtttttaattgttcttttttatttgattttggaattcaggtgcactctattcaagtgcaaggatatcagaagtttttttttatttaaaaaaaaaaaaaaaaaaaaaaattcaggaatttaaatttcggccttaaaaagggatttcacgcgatagttcaggcttactggttctactggtataatctctgtaccttttcatcttgaaaactctagttttgtacaagccagattccagcttattttactcatgcaggtagtgacagcatattgaagtattaaactggcccttccggtaaaaggctttcgaaccatcctttatcccttttgtccgaatgggaccaagtcattcagcc

SEQ ID NO: 503788 - DNA, 233 bp, Homo sapiens
  misc_feature (71)..(72): n is a, c, g, or t
gcccattctgttcctacacggatgcattaacttcttactttcaaaaaatgaatattattagcaatacactnntatgtttctgctgtctcaatcgctgtttaccaaatctatttgccctctctctggcccgattcttacacaaggacaaggtgagtaacatagtatataggggcatcactcatatagatacactctctgccctttttgagggggctctgtgacagagcacacac

SEQ ID NO: 503789 - DNA, 108 bp, Homo sapiens
tatccctcccacaccttgcacctggacactggatctccacaaggtagatgggctccatgagggctgtgctgggtggtcagcacactggcgtagatgcagcgcggtgtt

SEQ ID NO: 503790 - DNA, 838 bp, Homo sapiens
gccccttgaaaggtccggggcgccactgggttcccgaaccccccaccaggtcatttaccccacaggaccaatgccaaccggtctcccaaagaccctccggtaaacccagtcccaagcaaacctcttagaggactctctattgccttcaacttgagaaggaaccccttaggtcccagtagagtcatcacaaaccgaagttcgtcgcggattggtcccccgtggccaatggcgagataccaaccagccaatcaccgaattacagggacacagcctcagtacgggtgttttctcaaggccaacgaaggccccgtcctagccaaataggtcacgagagcatggtgtttttaagatggcgaccgatgtgtcagcgatatctgggcgcagacagaacggggcccccacaaagagggtgcacaaatcaaattcagaagacacagaaatccatggtcattttggacaccagccgacactcagagtcctcagtgctatcaacgtagtacgtccccgagagtcaaccacatgggtggacaccaagagcacgcactaggcagtaaccccatccccggtatctaccttccagatagtggcgcaagagagtggcccccaccgataactcctggccctccagaggccgacaggttcaagaccacctggggcacgcgtaccaagagtgtggacgtgtttccaagtgacaactacaacaaacataagtgggtcagtttttttgtatccgaaaactgaggtacaagatcacctgtacaccaagaaagtaggaccagtggcatctcctccttttatggatttggtacaatcatgttcttcctgctgtgattaccca

SEQ ID NO: 503791 - DNA, 481 bp, Homo sapiens
  misc_feature (397)..(397): n is a, c, g, or t
tcccttctaaccgggtgtacctcatgggaaagggggggaaaataagatgacgggagggtcgcgtgcttttaaagttctcaaattggactttccagacaagcgggtggcctgagccgtgtgccgtgtctccagatcttcacagcacagtctccggggaaggtggagccaccagcctctccttgaataccggggagatgaaccaggaagctctaatgacacacttgatcgaattatgacagacaccgaaaatcacgagtcagccccctcaagaacctctaccggtggcccgccgatcacagccggaagtgcagtgaaagattcccggggggccgggtcccaacggcccaggggggactccgaggcctcggcattggcggggggggcggcctgtgatatngggccatgggcgggtctggctcggtcccccattgtgtctggccagtctctaagtgtctcaacccggtccttcattaaaggcaag

SEQ ID NO: 503792 - DNA, 217 bp, Homo sapiens
accaccatccactacaacatacatgtgtaacagttcctgcatggtgcggcatgaagcggaggcccatcctcaccatcatcacactggaagactccagtggtaatctactgggacggaacagcttagaggtgcgtgtaagtgccttgtcctgggagagaccggcgcaccagaggaagagaatctccgcaagaaaggggagcctcagcgagagctgccc

SEQ ID NO: 503793 - DNA, 551 bp, Homo sapiens
agccgttaccagtacgacggagactctccttagacccaggacagttacggggtctaaggaggggcccgtcaatacactgagatgcagcctcaccctgaattctatggggatggtgtgggcatggcgtaggggggacaatgtgggctgaggggattcagacatccaggatcaaacatgggatgtgagacaaatttgtaaacgaatagaaaggggtttgatcacatagtggcgtgttctgaaatgatacaggaacatttgctatcagattacagaagtacctgtgcttctgataaggcagagtgttcacattggggtgtggaattgtagtgtatctactttgcattgagtgctaggaagctctattctgttcatcatagaaagtttgtaggaattcctgacatacatagtgaagagtatccttacatctggttaccacctgatcttcctgccctcgtgaaaacatcacccagatatcttcagttatcaatatgccatacaccttggtaagtcacctcagatcttcttcaaaagaagcagaccagtgagaacaa

SEQ ID NO: 503794 - DNA, 965 bp, Homo sapiens
ggtattgtggagagtccttgacaggaggtgtagcggccctgatgaagtttgtagaggagtttatctcatacaagttcagtattgggcgccagtgcgtggggccacttacccgttggttcccaacacgtgtgtacgcacccccgcgtgtgtgcgtgccctcgtgttggttccgccgcagccaaccctttgggtgacgcaccttttcagaggcctgtagcccgcctccttggttggtaatcgggcgggcccttctgtgaatagctctttggaggcatatttttacacgccccctgtggctgcgcaacaaggcctacttgcgtcgtcagagatggggtaagagcccgatggccgctgtgtggagaggcggcttgtgtggccaccgcccctacgggtttccggggggcgctcatttgtttaattgtggccccggggtttaaacctccctcgattgggtttgttgcgcgatcaccgaacgcctatggctggtgcccttgacccgtggcgcgactagacatactccttgttcacaacgaggtccgaagctatgttcccccacagataatacggttctgtgggaagctttttcacaagggcctggtatctggtgcctgtaccccctctctgttttatcaatctcgtgggagactcctttgtggtaggggacaccggcgttgtctcggtgggtccacaacaattcgtgcctcctcactatcacggggctctcacaccacctatgtcccgccgccccgcatgagagcttgctgctaaactatgtgttcaccgcacgcacaccacaccggggggtgcacaccacccgcccacccacggactgggacgcaaccaggtcaccccttctctttgtaccactcgggggagaacaccccctcgtatattttaaccccctcccccctttttccccatccccccaccccccaaccttccggggtgtttccccccaaaaaaaa

SEQ ID NO: 503795 - DNA, 672 bp, Homo sapiens
ttacatggcccgtgtggtttacaatttacaggggtctcgcggcgcgagcgctctacccggagctggagacgagagagtagcctaccctctggcctcagtttcctacatgtatgtagtaggctggagcatggcccggaccgggcccccgagaccgccccgtgcaacctcaccgacagcctgggggcctcagtcgactgggaacgggaccaaggagctcggggacttctccctgtcccccggacctggttgcgtgactgaccctcctgttcccagagcccccagcgtcaggccgggatgttcgtcctaggtggaaatggtggacaccgtccggataccccccttgggcagctttgagagcgaaagctcaacgaactccactatgccgaggcagcttgaaaccacggaaggtagggccaacacaagggtccgtagttaccaaccgtggggactctgccatttgctctgttctgactaatcacccaaaacctggagcgatggcctaatggtaattctcctgggggaattggccgcattcacaacatccaaaggtccactttgtcgcctgcgtgggctgttttcaatccagttcctagattgaggattctccattggggcaacgatcaagaggctgcatgccaggaacggacgtgcacgtctctctagagcttcttc

SEQ ID NO: 503796 - DNA, 327 bp, Homo sapiens
  misc_feature (101)..(101): n is a, c, g, or t
tgaatgcgtgtgtcctgaatgccacagaagcattaaatataggacctgaggtttggaagtctatctcaataggattggagagactggttgctgcttctccnccaaaggcgtgcccctgacaggtagaccaggctgtcaccatgcagcaggtacaaccctgcgtctgagacactgagtcgtggtacattcgatagcggaactcatcctcctgcactttttctaaaacaacgccatccacccgtgatgcatctgtccaattctccagcttcaccacagaatcctggtccagagagatgatgtatctacgtttcgctgtgttgttacctt

SEQ ID NO: 503797 - DNA, 156 bp, Homo sapiens
cggaagggtgggccaggctgccgacctctatctgaggggtgtaggctctagtagtgaagaagctacaagaaatcatgatcgatgtatctgggcgactgcattcgagctatcagctcgtgggcatctgtgtgctcgatcgtgtcgagagagtagaga

SEQ ID NO: 503798 - DNA, 679 bp, Homo sapiens
gttccttagtaacctgggcgatatctgccaaagggaaaggacagtcccagaaccagagtgaatattcaatgctgccttggtcgaggatataatcaacttggaaccaggtgaactgaagaaatgaagtctgctgagtagaacgctcatcaaggataactttcaactaaagagctctcaatataatggacctcaccaggatcccttgactagattgctgtggtaccgtgctgacgggaagcttgctttaagaccagtattacccagtatctccatgaagtcgtcacagctgattttggtgaatatggccagcttcccagaggaattggcctggattaggagtcttcagagtacctggcaatccggtcccatcgtctaccatccaactggtcgtgttccgaccttgggcaagttagcttcactctctgaggcctccatttcctcatctgctaatataacgtgtacagcttgcagctatcaaggctataacgagaacacgtggcacatgaatctgaacccacgaagtggaagggacgctaattcgggtacccattccccaattaaccagagagcacagagaaatgctggtgaatgtggccaaagagaacaccgataatgccaaagactctttacgtgaagcgttcgctaccaactcgaatgaacgagcgtgatgaaagtccca

SEQ ID NO: 503799 - DNA, 1561 bp, Homo sapiens
  misc_feature (1019)..(1019): n is a, c, g, or t
ggctcatggtagccatgcgaatcataaggggatgcctaaagtggaccgagagagtacataaattggaggctcagtcatacagctacgcgaaggtgccaaagcagtttggaggcacaccatatggggtacatacgagcgcttgcagatgactgccaataagacgtgcgtgtctagcaaagaagtcgctagaaagccggcagatctaccatatacaagccgtttgagcagtacatcgagcaccgaaactatagtctgcatcaggcatcgtctctcactacgcatagtggaacccaccactgccacgcagtacccaatgcccctgcgggcaatgtcgtcaggcctagagccatcgctacttttatagctacgacgcagacatctaagggcctgaaggcactgcttttcacattcgaagtgcccctacatgcagtgcatggggttcgacgtcaattcatagagccatgcaaagaagtagcgccctcgtgaaaggcagtgcgggcaacgtagcggacgagaagaagaaggcgcccaaagaggagaggtcttccattactgagaaagtgctcaagccccataagggccaattcgaagatgcgtgacgtaaactctatacggattgcatcgtaaaagctaatcgatgggggcgtcccttctaggaaagcacttctgcctagcccccatattattgctagaaaaatacctaaagggaaacgacgcgtacatgaaaatataaccattcccgtggcaccaagtcaaatggcaaggcacgggtggtcgcaattacacttgaagtgcattatatactgtccttcccagcaagggtgaagggcacggagagaaacagcaaaaaccctggataacgccgcgcgtctttatcgaaaccctggttggacaccggaaagggggggcggaaggtccccggaacaagccataagaacgtgcgcacagtgatcatctccacaaccaagttgcggaaaattacatggtccagaccaagggggcccgctcacatagtcggnagcgcatcaaatgtccctttcccattacggctcccggcaaataaaccaacgaaaaccgagtagcatctcacttaagatacagacgcgagagcccctagaaagccacagtgaacaacacaatcgttgtgtccgtaagggaaaccaaaggaacttcatgtgacacggcaacttccgttcacccgcgtggtaaacactcgtaggcaaggaggaataattagaggggccacgaagcaagcgcataatttcttaaagcgtcccgggattcgttcacgggaacactcgcaaccaggagagaaaccccacggaatagcggaaaagggaaccaaagtcacaaagagacttcctaaggaggaagaaacacccgtagcaatgtacaccttagaccatgccgggaagtgtaacaagggtgctcccatagccaccataaaacacacgagagaatgacgcccctcaacaaccgaagaagacacacaaagacaaacacgggagagccaacaacgggcggcgggcacgagcaggcaagcaacgagggaggcgtccaa

SEQ ID NO: 503800 - DNA, 638 bp, Homo sapiens
aataaaaacccggggctaagggacctttattgggctgggggaaggaaatgggaggagggagctacaaagggcccggccatgggggctttgactcctacaaatggccaggagctgggcaccccacccagaactgagcgatggagcgtgggtagggagggtccacagtgtccactccccgggggcgaaaattgactcggaagaacttgtctccagaaaaaaaaaaaacactctggatgggtttacagggggcgggcacaagccagtccatcctgtaaaaatcaaagttgggggctcccaagttggtctcctcactggaaaacaaggacagccacatggcgcgggatggccggcgggagtttttgttgcggccacggttgtggcctctttgggaacggaagcctttgcggttgcgacgcctaaacctttgttttttggcacaagaggggcggggtgccatgcctgagaagaaaaagcggcacacatgggtgtgtcaattgccttggaaaacgggcaaaacccgataaagaaatgggttgttggtacaaaaaggttttgcccaaagaaaaactcaaaaatcctcaaagttgccccgtgatatgggaagggttaaaaccaccgagggggttgtcttaaatctt

SEQ ID NO: 503801 - DNA, 932 bp, Homo sapiens
  misc_feature (11)..(11): n is a, c, g, or t
  misc_feature (171)..(171): n is a, c, g, or t
  misc_feature (411)..(411): n is a, c, g, or t
  misc_feature (447)..(447): n is a, c, g, or t
  misc_feature (453)..(453): n is a, c, g, or t
  misc_feature (469)..(469): n is a, c, g, or t
  misc_feature (562)..(562): n is a, c, g, or t
  misc_feature (592)..(592): n is a, c, g, or t
  misc_feature (594)..(596): n is a, c, g, or t
  misc_feature (614)..(614): n is a, c, g, or t
  misc_feature (620)..(620): n is a, c, g, or t
  misc_feature (626)..(626): n is a, c, g, or t
  misc_feature (648)..(648): n is a, c, g, or t
  misc_feature (681)..(681): n is a, c, g, or t
  misc_feature (686)..(686): n is a, c, g, or t
  misc_feature (699)..(699): n is a, c, g, or t
  misc_feature (705)..(705): n is a, c, g, or t
  misc_feature (757)..(757): n is a, c, g, or t
  misc_feature (767)..(767): n is a, c, g, or t
  misc_feature (825)..(825): n is a, c, g, or t
  misc_feature (847)..(847): n is a, c, g, or t
  misc_feature (927)..(927): n is a, c, g, or t
actcaagaggnctgggtgtgggtaacagccacctcccaacaacgtcagaggtccgggttcagaattcctcaacgcgactgagttactggctcaaataactactgtggagtaacgagagggcattttaacacaacagagactccaattcaactctcttctgttaacacagtnagagttctcttctcaatgctcttacaagttttaaaaatggagaagctataaaataattttgttagaagaaaagtaattttcttctgaaatggagttaagcaaacacatacccaaggatcttaaaaagtttttttttgtttttacagaatatatgtatgtatttgtgttttttttttttttttttttttttgtaacaaacactattaatagtatagctaaaatgttaacttcatcgcagtntctacaaagttgtggatcccagttttggtgccaaangcatanaaaaagctcaaaagcnattatgactataccatgcaaatttatatccagaaaaccttgggaaggagattgcagctctgtggagctccagggggtctctgcctttgatatntgggtacctcaactatgcatcaaaaaagtntnnnatcacttttctcccaganagaatnaatgtnacagttctgaatagtataaatnatacacttaaatagaccattgactgtttttgtncacanccatttacatttnggggtncctcttctgcatgtggacctcacacctttaattactggatatagaaaaaganacctgaagtnttgaaagggataaggtctttgcaaatgtattttttttctttaacatgaaaataatganaaggccactaaacaaggttttncccaatttgtttaacttttaggatcccccattgttacccatgggaaaaatggtcagagaaaagccaaaaccaaaaaaatncctgg

SEQ ID NO: 503802 - DNA, 520 bp, Homo sapiens
atcctggcaagtcacaactacagttttccagtgctatatttgcaaggaagcacctggaactgagaaaaagcctccacgtgggcaatatcaacatcaacctgctcttttctttttgtactacatctctattcaacatgcagtacatgcttgatttcacccaatcgtgatcgctacttacagagcacccgccacgtgtgtgccaggtagtgcataaactgcttgacgtgtgctctgtggtttccacccctccataacgatcgtacgaattagacattacctcctcctgccccacctagtaaacatggaaacaaacctaagcaaggtcacaaggctaataaacggaagaattggcattgatcacagatctgtatgactcacagtgttcatgttatgtttagcttagttaggtctgaatttttcttcatagaaagaaactgagcttcatgagagtatttgtgagagtatttgtatatgttgattttttaacaaattaactacactggatacagaaagatcggca

SEQ ID NO: 503803 - DNA, 328 bp, Homo sapiens
taggtgatggtttctgaatgcacagaagcattaaatataggacctgaggtttggaagtctatctcaataggattggagagactggttgctgcttctcgccgaaatgcgtgcccctgacaggagaccatggctgtcaccaatgcatgcggtacagcccgtgggtcttgagacctggaggtctgttacattcgatagcggaactcatcctcctgcactttttctaaaacaacgccatccacccgtgatgcatctgtccaattctccagcttcaccacagaatcctggtccagagagatgatgtatctacgtttcgctgtgttgttacctt

SEQ ID NO: 503804 - DNA, 277 bp, Homo sapiens
gcttatctgcgtgggtaatttctctcattttttatagacgatatgggatccccctatgttgcccaggctggtctcaaacgtgctgagctcaagtgatcctccctccttggcctcccgaaagtatttgaattacaggagtgagtcactgtgtaccaagccctattactttgttaaactgtttactatagtagaaatgcttgtgatgtagaaaaacggtcagtaggaaatacaaaacctcagcctttattttacttgaaaatagttcttctatttagaa

SEQ ID NO: 503805 - DNA, 393 bp, Homo sapiens
atccccacttaggtccttctgcgtatcaaacttgttttccatttatagggaccttcacctgcttcagagtgaaattgcggtgggaggcgctcatcattgtccacatcgcgccagccatttgacccaacacggcatccccggggggaatgtctctgaggcatggggccggatgtccgtgtggacgtggctggagaccttcaccggctcctccagctcctgcagggcgatgctccgctccgatctgtgcggtgctataactgtgggtgctccatgactcctgtctgaccggtcagcagcatggtcctggtagtaaaggtgctgctcccgcatttgcactctgagggcggacagatcctttacgtccggtcccactctgaacgcgcctaagggtac

SEQ ID NO: 503806 - DNA, 335 bp, Homo sapiens
tcgggttgcgtggggggtagatgagacccagggctggggaccatggcttagggtgcatgaatatgggaacccatttgggagaacggttcttagaagtccggtcatcagcttcaggaaagccagcccatatgcggaatacagatgatctctgggatgtagccaacaactgagaaacacgtaaaatagttctcaatttctaatcatttttctttctttctttttttctttttttgagacagagtcctgctctgtcacctgggctggagtgcagtggcgggatctgggctcacggcaacctccgcctccggggttcaagtgattctccggccttggcc

SEQ ID NO: 503807 - DNA, 1000 bp, Homo sapiens
aagctctgcctcctgggttcacgccattctcccgactcagtctcccgagtagctgggactacaggcacctgccaccacgcccggctaattttttgtatttttagtagagacggggtttcaccattcacaggatggtctggatctcctgacctcgtgatccgcccaccttggcctcccaaagtgctgggattacaggcgcgagccacagtgcctggcctctatgttattttcatagtgtaaacatccagaaaataaatgcttcggtaccctgaaaaaaaaaaaaaaaaaaaaaaaaaaaaaaaaaaaaaaaaaaaaaaaaaaaaaaaaaaaaaaaaaaaaaaaaaaaaaagggggggggggaaaaaaaccaccgcgcagggggggcgccaacatttgccagccgactaacacccaatgaatttgttgtcaagaaagaggggggcgcccaccataaggggggcgtgctaactaaacagcagaggcgggggggcgacgtgaaaaacaaacggccgacgaggagggaaaacaacagtcagcagtggatggacaccttgagggaggcacaaccccacatgatgggggggggggcgccacaaatattgggggcaaaccaccacacaaacaagatgataaccggccggcgggggaaacacaaacaattgacgaggggggatcttgcgggggaccccaaccagggctctattggccgtgggggcgagaacaaacagtttcaggctcgcagcgggttgctatgcctgcacgcaccatcactcacccggcgcgccccgtctcaccaacaccgggcacagcacacccaactaacgaacgagacagaatcgtaataacgcgacggttcatgatgatgacagctgcccgctactacggacgctaagagcgagcgcaggagatcgatcagagagaagcgaacacagcaagcacacagaccaagccgcaacgacagccaagaaagacgcgcgcaacgaagagcacgtaaagatcc

SEQ ID NO: 503808 - DNA, 441 bp, Homo sapiens
gtcgtgtgataggcatcagctgtgaagatcacggtatcgagattaaacctggaatcaggttctgtgctgcctctgggtacggtcagaattcaaatgttggacaataagttggtgttcgcagaattgcttgttgtacagctaactctacacatttgggtgacagagaaaagatatggaatcctggcttggactaatcgctcggtgtctgggactgggaggctctgctctcctgtacacaggctgtcacgctgcccattgtcctgtgattctaggtctcctcccagagtgagagaggatgaaaacttaaggagctctgatgacagtcccccttttgccacagatgccaccacagtattcccacccactcataaacatacccactagacattgacatgtccacacccctccccggactagacaccaccatcaggaacttcacca

SEQ ID NO: 503809 - DNA, 252 bp, Homo sapiens
actccgccaattaccctcactaaagactctcaaacataccttggtgggggtctccgctcaacctcttcttccctaggtcaaagcactattatctgatgagtttaggatgggttctgattggcagaaattaatcagctcccaatggggcccacggaactaagtaggggccaagaaaaaaaacgggaactattccacagagcttgagcattcttgccaaattccattcctcaaacctttagtgagggtaaatcc

SEQ ID NO: 503810 - DNA, 616 bp, Homo sapiens
tgatctccaacgtcggagaacagaactaagagacatattgttttttggctgccggtagtcaagggttactagacctaaggtgtttattggcagctctgaggacagagatacgctaccaaaggtgttggtgccctccagactgtgctggtagctacagatatgggggctgggcactctgagctgcccctaagctgcctgtgggatggtgcagattgggtggggatgctgcacccaggaccactaggactggcataaacaagacctactacaacaaagcagactgtgagaaactgtggcagctgggccagacatggtgccaacacccacccctaccaggaccactgcaccagctaacaccaccactctgcacagaaagtacaaacacctgctctcgtttgcctgggcctcctgctgagcttagtgtctgtctgtctgcccctcggactccctctgagccacaggggggttagactatggcagcccagagtaggagtctgtgccagagcgctaacagcagctgctcggggaagcgctcctggctgcagatggacctaacgctcctgctcctccgctggcgcaaagccacttcttgccagacgaaggctacaggtgagac

SEQ ID NO: 503811 - DNA, 158 bp, Homo sapiens
cggtgtttgcctgttgcacatccaggatctgcatatgggaagcctctccgggcagctacaggtgctgatgtgaatggagcatgcacctggctatgacctctgaccaacagccaaagggatggaacctatcctccagtccaactcctgtccctatctag

SEQ ID NO: 503812 - DNA, 158 bp, Homo sapiens
accaactcgctgtgcctaacaagaattccagaagtaaaccatccgaaaggcactggaccatgacactctccacttccaatcttaaatcttatacttcataccttgtctcagatctctacctggtaccccttccccacgcccttcgcgtgagggtacga

SEQ ID NO: 503813 - DNA, 424 bp, Homo sapiens
cggcgcagcaggcggacgctggcttctccggctgggaccctccgccccgaccgggccccgcggcctcgatgaggacacaccatgctgaccggggtgaccgacggtatcttctgttgcctgctgggcacgccccccaacgccgtggggccactggtagagcgtcgatgtccaggcgactggctacaccctttgtagaagggttcaagcccccggccccgccggttgccttggcgggggtgaaaaggctaattgccagggaaccccggccccagccgctgccccacctccaccatcatccgcatcctcggatgcagcccagggggacctctccggcttggtccgctgtcagcgccggatcaccgtgtaccgcaatgggcggttgctggtggaaaacctgggccgagcccctcgagccgacctccta

SEQ ID NO: 503814 - DNA, 483 bp, Homo sapiens
ataaatctggaaatcggagtgtctaaccccctgcgcttcctgggtgcagcgatgcccaccctgcttctccttgcctctgtgggctgtatccgactgtctaacccatcccaatgagatgaaccgggtacctcaattggaaatgcagaaatcaccccacttctgcattggtcttgctgggagctgcagaccggagctgttcctatttggtcatcttacctgggactcgatcacttttttaactcttctgatttacttcacgaatctctatcttgttcactaaactctttgtaactcgacctacattgtagctcgaccttctttatggtgtatactttaattattaacactgggacaggagggacgaaaagagaacggggccacgtagcatttttttctcaattgtgtaattattctaattcacatttgagaagtctaaatatattctagacatggagaaagtcattttaattctggcagccatta

SEQ ID NO: 503815 - DNA, 401 bp, Homo sapiens
tcacatttttgcttctgtggactgttttcctcttcctatttgctgtttcagcacaagcgatgaagaggactttcctttccacgaggaatactgatgttggttcgcttgatgagattcaagccgggtagattcctttgtccttgtgtgagactcactcctcctgaagcagattttagccacgtctctctaaaatcaacctggatgtaggctaccatttggccatgcaggatttaaatttttgtgttcatcaaggtgcagactctcacagggaaaagtgagtccagagaaactaaggtcaatggttttcactaatgagggctgagcaaatgtttctcatcaggaatgcattaccatggtaacactggagacacagagataaaacaataaaatgtaataacagt

SEQ ID NO: 503816 - DNA, 191 bp, Homo sapiens
gaactgggtgatgcggcttagatataacgcttgtgtattgcatcagcttttgccatgggtatctttatctttgtcttacctgtgaaacacaccccgagtaaaaacaagtaaagatctccgagcggcagtacacaatgggttttggttcttcaaaattgctgcccttattggaatcatggttggctctttct

SEQ ID NO: 503817 - DNA, 113 bp, Homo sapiens
atcaggtctaagggattcaggttaggggaacacacacaaaaagtcaaattcagttattcaagcacctaattagtatatgaacatctgcctggggtactcacagtacattctgg

SEQ ID NO: 503818 - DNA, 789 bp, Homo sapiens
ctccatagaccgcaatacagcatagagatctaagaaaacatggtacatagggcctagtcatctcatatgctaaggcactaacgatacagagactgtctaggcactgagcttcacaaccagtgaaggttctgtctccctagcacagctacccatgatggtgtcggaatcagtagacttcttcctggctaccatgaggcagagtcttacacacatacttatttcctagtttctaggagacagggtttcagagagaattttgtcattacaattctatgccagagttgaaactctcacaaagattgaggcattctgcatttgaattatatacagaaagtcatgaatataattccaaaagaaaagagtgcacttcatttggtcacttaatttcacaccactgggcgaggtaggataactatcttctttgacatgtgtctcgactatataaatggtgattataccgaaaagggttctaatgcattttccacattcttccagttgtgaaaattctctctgtaccatccaagtgttatgtgtactcgttctttccaaggcactttaggtctccatcctaagccatgtattcagtatgacttcagtggttatctcatgtcatagctgggtatatcataacgataatcaaccacaatattccagtatcaagactcgtgaagtaggtatctcttgatcacgctgtactagttcatgggcaagctggcagctcacaatcaacattgtctgatgttataattccacctggcttcccttttataagtacagccctaaatgctt

SEQ ID NO: 503819 - DNA, 274 bp, Homo sapiens
gctcgacgggcggtgcagtggctcacacctgtaatcccagcactttaggaggcccaggcaggcagatcacaagttcaggagattgaggccatcctggcgaacatggtgaaaccccatctctactaaaatacaaaaaaaattacccaggcatggtggcgcatgcatatgttcccagctactcgggaggctgaggcaggggaattgtttgaactcaggaggcagaggttgcagtgagctgagatcacctaccaacagagcaagactctgtcaaaga

SEQ ID NO: 503820 - DNA, 248 bp, Homo sapiens
gcacggcttcgtctgccataactcgctaggccacgctgaggtcctggttcctgaggagtgcaatggaaaccccagattgctgcaggagactacgagccctgtcgggctagtcggggactgtcgggctagtcggggactgtcgggctagtcggggactgtcgggctagtcggggactgtcgggctacgtcggggactgtcgggctaggtcgggcactgtcgggctagtcgggaacggtcgggctagtcg

SEQ ID NO: 503821 - DNA, 164 bp, Homo sapiens
gggaaaattttttttaaaaaaggaaaaaccgttttatttggggaggaccttaggggggttttttttttccttttccaggttagggcctaaaagaagtttttaaattaacctttttcctgggtttcaatttgacctgccctttataaaacaagttttggggttta

SEQ ID NO: 503822 - DNA, 422 bp, Homo sapiens
  misc_feature (360)..(360): n is a, c, g, or t
cacgaggagccagtctgatctgctggctgaccaggctgccgacgaaggccatgctcaggcccatgatcaacgcggcgaggaggaagaactgggtcgagcggttgagtccggccaggaggtgcctcaatcgctgggaccaggtgccgggtgactcgaccatggtctggtgcgcatgctcgacgaaagtctttgaatttgattcgacctttgcctctgtggccattcgccttgctccccgatgctggtgacaagcgctttgtgcaggcagccgatgcaatcagtcgacgcctgtctcaacaagctagtacaggatgcgctgcggggcggcttttatagcggttgccgcctcggctggagtancgacgatgcccgtagagcggtaccggcatcggctgaatcttagcttgacctggccccccgca

SEQ ID NO: 503823 - DNA, 383 bp, Homo sapiens
gagcagtaacttattattgctagtcctgatgtccattctcacctcaataaaagaatgggcggtggaagggggacacaccatacaaccaaacttaccataaggttatatatctttcttttctttttttttgagacaggcctcgctctgtcacccaggctggagtgcagtggtgcgatcatggctcactgcagccttgacctcccaggctcaactgatcctcccgcctatagcctcctagagtagctagggactacaggcatagcaccaccatagcccagctgatttttaattttttttgtagacactgggtcccactctcactatattgtccaggctggtcttgaactcctgggcttaagcgatcctctcacctcagcttccca

SEQ ID NO: 503824 - DNA, 180 bp, Homo sapiens
  misc_feature (8)..(8): n is a, c, g, or t
  misc_feature (46)..(46): n is a, c, g, or t
  misc_feature (74)..(74): n is a, c, g, or t
  misc_feature (111)..(111): n is a, c, g, or t
tatattancccaaactttattaagaattgtttcctaattggttatnacatttttcaatttaatagtttcaaaanaaattgttaatacaactgtataaaatgaacataattntcctcacttgtatttttgttattgagccagtttatcaaaataaattgtctactaaagaaactaaaaaaa

SEQ ID NO: 503825 - DNA, 229 bp, Homo sapiens
attctgcagctggccggcattcagctgcaccgggatctgctggatctctcctgtgttagtgatgatctgctgcatcacctgcaaggtctgtccatgtgccactctggtgcctgttggagcttgcaccctgatgcgctgagcctggactactctgcatccttgctgacccttctccaatcctgtcattgtcactcgcgttttggtcttggcccttgctgacgtctgtgcg

SEQ ID NO: 503826 - DNA, 436 bp, Homo sapiens
  misc_feature (436)..(436): n is a, c, g, or t
gagagagagagagagagagagagagagagagagagagagagagagagagagagacagagagagatagagagagactgtgtcatactgctattcaaacttgccgtgtctatatttttccgcccttagattgttgcttatcctctatatctcctcatgattgttttccccaagctttcgatgacctccttcccctctctactgactctcagtatatctttgaccatatatgagctcttatatttcttcattcattgttctaattccagggtctccctctgtggcccacgctcgagtgctgccccaagatcctacctcactgcttccttgagctcctgggttcctgcgatcctcttgcttcccttccgcgctctgattctatgtgtgtgctctctctcacacctgtccttccgtgttcttggaccatatttgtcacatn

SEQ ID NO: 503827 - DNA, 1120 bp, Homo sapiens
aggcacctgtgatcccagctacttagaggctgaggcagaagaattagctttaaccttggaggcggaggttgcattgagctgagatcatgctagtgcgctccagcctgggcaacagagcgagacttcatctcagaaaataaaaaataggggccaggcacagtggctcatacctgtaatgccagcactttgggaggccaaggcgggcagatcacgaggtcaggagtttcagaccaatatggtgaaaccccatctctactaaaattacaaaaaaaattatccaggcgtggtggtgcacgcctgtaatcccagctactcaggaggctaaggcaggagaatcacttgaacccaggaggcagaggtaggggtgagctgagatcgcgccaccgcactccagcctgggcaacagagcgagactccatctcaaacaaaaacaagaacaaaaacaaacatacagttggcacagaacaagggagcaagtctaacaaagggttccacaatgtacatgcagcacttgcatagtctaaccaacaccaacaagggcctcacaccacacttcccatgccacacatcacagagaacgcgaggacccccacggacagcaacagcacagacacgcacagacaaggcggaaacacgacacacaaccagaaaaactaccgaaacccagtggaaaacaagacaacaacacaccgcgcccacagccagacaaacagagaagaagagaaaacacagaggaagcaataaccaaacagaacacaaacaaaatcgggacaacacaccaaacaacacaacgcaagccataacaacaacaccgagccccgggaaaaaggcagccacagcggctaaccaccagcaggaacccgggaacggcgaccaaaacacctcgcgaaaacaaagcgaaagagaaacccacacgggaggcgggaagggaagcacacaggggacgacagaaagaagagagaggaaaagcaaaaggcgaaagcaaaatgaaagacgaccaacagacaaacagggagatccaaggcgcaaaagatgagggaacagaagacggaacaccaaaaaacaaaagaacacagaaggcaacgatcgacgtctgcaccagaacgacggaaagcagaag

SEQ ID NO: 503828 - DNA, 438 bp, Homo sapiens
  misc_feature (282)..(282): n is a, c, g, or t
  misc_feature (326)..(326): n is a, c, g, or t
ttgaaatgggcacagaaattctagtgataaatacctgcccaaagtcctacacctgtgagctgatggcgccagactataaacttgagtctcactcccctacacgccgtaactttctccagttcacacatcagcacttttataaagtaagcacagagctaaaaagttcacgttccagtttaaagcttccacctacaaggaagatcgagaatcaggtaattttaaaactaatttctgtgcccatttcattgaaatgggcacagaaattgagaatgtgatttgggntcatgtgatgtgtggggagactctgaaacagtcagagaatgagnacaagtcagaaaatggaagacgtgaacttttaattgcagctctgagttatgaaatgagtccctttgagaaatgaaagcagagaatgatttctgtgcccatagcaagggccga

SEQ ID NO: 503829 - DNA, 191 bp, Homo sapiens
tagagcacctatcgctgcccttttttgggggggcaggatcggtggctaacatctgtaatcccagcaacttttgggaggtcgaggcaggcggatcacgagaagtttttcttaaaatccttttttttgggggggcaggatcggtggctaacatctgtaatcccagcaactttgggaggccaaggcgggcagat

SEQ ID NO: 503830 - DNA, 893 bp, Homo sapiens
tgcgagtgtataattgtccagagcagcgttgggccgtgaaatatccgccggggagcgatatatggactgtgcccgcgagtttgtgggtcttcggaacacacaagagtgcctgtttcctgaagagcaagcgcggttccgagcaccggtgtatttacccgggctccagagccttttgagctcggctcggctgaggcgccggcttcgtaccctgtcagggagggcgtaattccttaggaaacgttcgtctctgggtggcagaacaggcagcaccagctcttcgtagtccgagcaggtttgcctgtctatgccgggggccctggccagagcgactacggttgggcccccgacgggacaagcaaagcgtgtgttatagtccctgggctccccccccgaccggggaagaatcaggacgtgacaaatgcctctctactgagacacgtgaagctccccaacgacgtcttctgtctgtgggcagggagcctgcagacatgtacagttctgcgacatagagccaacaactctggagtacatgttctggagagagtggagccatattttcactctcggtgacaggaaacaccgagggtggcttactgaaatagggctgaaccccccgagtgctcccgctagatacaataggagccactgcgaggcaggtacatggtctcttcacgaagaccatagcgagcagtgccgcgcagaggaaccctcaatggtgttgttgaaccgctaccttagtccaccggaaaaggctcatccagcgacacacgacgtatatgggctgcagagggacgatcttgagactggtgacgcacgatgtgaagcagttgggaggtaggaaatcacatatggcagcacacggggtggagtcaattcacggccaaacatgacgc

SEQ ID NO: 503831 - DNA, 395 bp, Homo sapiens
caaactatggaaaatgcctgcatgggacttgcaggctagggaatgaaaatgaaaacaggaaaaaatcatttccagagactctatacatataatatttcaaacattatgaccacagagttgaaaagtgcgcaaagaggatcttgagcacggtgattttttcataccctagaaaaagtgtgtgcttgcggagtcaccattcagttgcacattcaagcttgaatttagcaactgatgggcatgtcttcaaaaccatctactagcagcaacttagcccattgtcacttggatcttgttaaaccattacacgaattcatcaaggacagttcagaagtatggagaagcaacaagtcacagtctcataaaaaagactaaagcaagaagttgcaggaactctg

SEQ ID NO: 503832 - DNA, 179 bp, Homo sapiens
gaggcgacactagaggatcgccacaaccagtttcatcattaggactataacgagactgccaaacaagaagatatttaggacatccacaacacgatgctgcagaatggagcctagaagatggaacgtgtactaccgcaaactgaaacgtcacagattagagacatgacacaataaggatt

SEQ ID NO: 503833 - DNA, 186 bp, Homo sapiens
agtgatacttaaactaaaatacagacttttgacccgtggactatactaccctgacaaaccctagttcatcctcagctctctgacatctttccatgtcacctccttaatgagaagtatatgttttggtatatcctctcttaaatgtgtatgtgtgtgtgtgtgtgtgtgtgtgtgtgtgtgtgtgtg

SEQ ID NO: 503834 - DNA, 195 bp, Homo sapiens
ggatcagaagtgctcagagtagtctttaccattagtagccagctccagaatgaactaatttagcagtactatttctgtccagtggacagcaatttctagctattggaatattaaagaactgtgctatgtacagtagttctacatacaaatagcccatacggtcaacgtagtacgagatagaaaacggtccgtgaa

SEQ ID NO: 503835 - DNA, 342 bp, Homo sapiens
acaaacttgaggcaaatgcgactaagtgactcactgagtccaggctctgctactgctgaatacgctgaactgaagaagatggactggtcgagatatactactacatgataccgcactacgcatgcactagagtgatggatcaccttcgacccttaggcagagtaagatggtactacatggatatgtcgcgcataacaaaggccttaacagatactctgtcaagagattgtagtgatatgtgcaattcggacgctcctacacacctgatgacttgtatggcttgctgtgagacgaggaccacataggatgtcactgatacgtctgtcctacactgagcgtatg

SEQ ID NO: 503836 - DNA, 210 bp, Homo sapiens
tttaatgggcacagaaattacagtgacaaagaacagaaagaagaaatggaaaagactgaagaatgaaaagagactcgaagaattcctatctctaaaaaatgttcaaaatattgaagtacattcaccgtctgactcttctgctcccttaacactttaacagatccattactggaatttctttctagagtacgggtaacccatatttctgtg

SEQ ID NO: 503837 - DNA, 479 bp, Homo sapiens
cagactgccacccgagtgctaaagccaccaattgaagagtcacagaattttcaacaccctggtggtcaaatgccaaagccctcgtactatcatacccaatttccaaggtctttcagaccaaacatgcagaatcttagctttacagaagtctcattatatattaaataaggaccctgtcagaacgcctatgtgtaccatctgaaatagtctcaagctttaaggtcaaaaccaaacaaaaagcaaacaaaagctctcatctcgtctacttttttaactccaaaaaaaaaaaaaaattttaaggctatggcactcgtaggtatttccccaaatgagttcaacacacctgtccacacaaacatctacatgccgacgttacagcagctgtattcatgactaccagaacgtggaagcacccaaaatgccttccagtgggtgaatggataaataaactgtgtaacaatgcagtgttattcagcact

SEQ ID NO: 503838 - DNA, 1616 bp, Homo sapiens
taaagggaaaaaggaatttttttccgggagtaaactttaaagaaaaaaagggaaaaagggaaagggggggggggggcaggggggctgggagaggagaaccacatatatatccgggggtgtattttctccctcaccgcactaaaccaactttcttcctcacagagagggccccactttgtttctctcttgaggccctctccacagaggccctctcgcgagagaaagcgcgcacaaaaaagaacaccgcctctgtgtgtttcgtgggcgacagagagagagagggagaaatctctctctctctctctctgctgtggtgtgcgcgcccactctatattcccctctcttttctctatattgtgtgtgcgccccgtgtgcgccccctttgtgtggcgaacgtctctctctcatacaaaaacaacacacacaacacgcccggagcggggcgcccaaatctgtggtggtggcaggcacaaatataaagaacgctctactctctccagaggggagagagcactatgatgaggcggccactatctcccagagagtggtgtggaccctgtgccacccgcgagagagacagagagtgggctgtaaaaaactctctctgtgagagagagaaaaatagagagcgctcgccctgtgagagagtatatattttacacacccccacaagagacacacacacagtgtgtcgtgcggagagggggagtcactcagggaggtggggggaagcgcggcccccaaagagagcgggtgtggtgtcgcctcccgagatatgatacacccccaccacactgtgtgtgtggtgtgcacaatctaccagcactctatcatcaaaatgtttctgttgtgcacacccaaaagagggggggggggctcctaccccaagagaaaagctctctcgcagagggaaaggaaatcctccaatcatcttcataacaccgcccgctatgatgagttattcctactcttgcggggaagccatccaccccatatataagaaagggaattacccgcccgttcttatttttgttccccccacagagaggaggagggaggaagagcaatcaacccacaagtaggggagagaccaacactctcgagaaagaagaaggcgcgcccagcggtgttctcattcaacaccacaccacgtgctccgctgttgcacacacgcattattcaacgacagaactcaacacccacaactgacgagccagcaccagacggaggaggcaccgcacttaataacagagccagcctactaatgacgccagtgagcgcaccccacgcgggggggcacaacaaccagccgggcggaacaaaaaacattcccgctccatcgggggaacgagacagacagcagacacctaacacacccagactaagttgatggcaagaggcagacaggacagaaaatacacaccaaatcagatatggcgcaccacccaacaatactcatacaataacaaaaagtagtaggcgaccgacagcaccacaccacaatacactcgtagtcgtgagcgagacagccacagcaaacagcgtggagctcacttactgagaaagaacaccaccgacagacagcgtaacacaatgcagagcgaccttccagatca

SEQ ID NO: 503839 - DNA, 331 bp, Homo sapiens
cgtcctgcatattaaaatctagttagtattagttttaaactctagtagcagagcctatatgaatatgagtctcttttgccattctacttaaatgtagtcaagtaaaatgtaccgagagtaactttggggggaaatgaagtatttctctaaaaaatgattatgataaatagacctataaaaagaaataaccatcacatcacagactgtactagtaacatgtctgcagtttgaagaggtcagaactattaatataatggagatatagcacttactttgtgttgaaaggcagagtatttcttctgtttcactaaagtagcctataggtaaaatg

SEQ ID NO: 503840 - DNA, 359 bp, Homo sapiens
ccgctctcacccaccccacagactctgaagtcgtgtctgcagcaaagttcgagatgccagccaagatgaagagagggagtggggacaagaacaaaggaggaggcgtgagagagagagtgactctgtagtgagccacagtcagcatgccaaggggtgagaggatggagcacttaccagaactgcttatctaaaatgaggaaagtcccttagataaagcaggaacgcggtggagtaaacctgaggtgcaagactccaggttgcaggaaccccacaaagggtgtgagatggtggagaagctgtgactcaggtagcaactgtggaacactagtggccaacccaggggtgtgtggagagcggga

SEQ ID NO: 503841 - DNA, 1725 bp, Homo sapiens
  misc_feature (378)..(378): n is a, c, g, or t
  misc_feature (939)..(939): n is a, c, g, or t
tgtcattgtactcctctgttcactgctcacgactgttttttgttctcgtgttggtgggtgtgtcaccgctactggctgtctgcgtcgtatttgtacacatttgtttgttcccaagttgttggcgtctgtctgttcgttgttgattgaccttcgctcatctgtttccttccatgaggtgtgtgttgtgtggagaaagtacttgttttttgtgttcgtctcaccaccccattttctccttggtggggtggatgtgatccacccccgcggtttgtttggtttttatacactggcgcgcatcactaatgtgggcacgcacaccttgtttttgtggccccccccccgtgtgttttctccacccctgggggcgctctagttatngttttgtttgtcactccaggggctgctcaccaaagaaggtgtctgttataaatacccttctgttggcggctatatataacgaggttgttcctttactacgatagtacctccctgttttttggttgtgtggtgccggtttcccacactaatatgccgtcctctcagagaatggcgctcttttaaaatgggtgtttttatcaccgccaccactagtttctctccgtctgaaagtagggtatggtccgcacaggagagcgccggggggcggctcgcttactaatttgggttttgtcacatttcttctcccccccgctttgtttttatctaccacgggctcccacacattttgatgagcccatttgcacccccttttgtatgggtattccagtacacccacacctgtcccggatttttttagggcggcaccacacccttattatggggcactttcctgcagagagagtgccccccccaacagatgtgtggtgcaccaccagaatagacgcccacgcgcgttttgttataaccccgccggcgccccacgttatatcctatttatanccgcgtctcctatagagtgtattactcgagagcgcccccttggggttgtggcgcgaatatatctcgcgcacacacgagagcgccacaaacacatggcgcccgcgcgtttctcgcacccccccaaccctcgtgagaagagaagggcgcgccccgccgcgtgtcactctacacaagagagaaaaggtgagtgctcacacacacgcgcgcccctcgggggcacacacagagactgttccacacacgcgggacacacacggcgcgcgctgtgtggcgcgagagagagagagtgtccccgcactcttagttctccccaccgccccataaagcgctctcgcccacacacacagaatatccaccggttatatgtcacccgcacatcttggagatgagagagcgcgagaattcacagagagagagcgcgcccacgtataagagggtgatatctctccaccactcacacgcccgcacggagagagagagaggagagaagaagaaaaggagagaagaccacacatataatgttcctcgagaggtttcacgcccctggagatccacgcgagagaattatattgaaagtatagaatcccgaccacctaaaggaaaaattctgtaaagacttttggaagacttcggccacagcttctgtccacaccctctcacggtcacactcacgcctcacacacacttgggagtgagatttccacaacgccctctcggggagacctcgtttgaatttttttctgtagtgctgtaattattttccataaaattctgggcacccaccca

SEQ ID NO: 503842 - DNA, 951 bp, Homo sapiens
  misc_feature (200)..(200): n is a, c, g, or t
tccctgtcgccgcggaggggcgggggcaggaccgcgcaatccggccggagctggccgggtcgtgagccggcccgcttggtggggcgccccctcgcgtccaagaggcagacgcatcgggtgggctccgggtctccagcccggccgggaggaagggacccgggacctgcgagagcggggcaacttcgggggcccctcggcgngggtcgcgccacaaccaaggtggtggtcggccccgggcgtttgcgggggcaccttcttgccgcggtattgacccagagggctcccaggaagcgtgtcacggcgcaccgaaatatggcacaggagggccggatacaaggcaaagaaccccccgtgtggctaggcacaggagtgcacacggcgggccaacaggagtattggtggacacaccccggggagtgacacggccccccgggagtgaacggcggggaccccaccaggcgggagaagtttaatggcaccatccgggggtgttatggggagccccgcgcagagggtcgtctaaagccagcgccggggggcaagtcctaagggcagggggaactgccgccacccacagaaccgggcgtaccagaaacgtcggcagcggggatacgtagtccggcggcaacaagcgcgacagcgctgcgtcacactacgctctgaccgcccgtcggtgacatcatcagtggcaccgtggcctacggtcttaagcggggtctcaccaatcgacattcccgtggtaattcccgtggaagcagcagtggcccccaccgggcgttaaaggcagagtcaacggtgacagacgcgcgacatggtgtctcggcgccatgaggatttcggtcccaacgataagacgtttggacttacacgattgcggagctgcgttcggagcgtacacgcggcaaggcgcagtggaagactaggctgtggcagtccccgaccgagcgacac

SEQ ID NO: 503843 - DNA, 814 bp, Homo sapiens
tggccacgggggtttgtggtcttttgtgatttcgtttgggttttctggtccttcgttgtccggggttggtgtttgtatttgtgtggccgtttgcgtccagtgctcggtatctgctgttgattcccatttagctgctcttcaggtagtttcgacgctacaggtcttgtgtgagggtgcaatggagtaaactctgaggtttctttggttcgtcgatgttgtttctgtgtacatttgtttcctaagtctatggctccagggtagacccttacgtattcctcctccatccttcaattcgtcaccctccattggatcctcaagttttaatgaattccatattatacctgtacatcagcaagttagaaagaaagtactttaaaataaagcaaagggagactgtttgctctaccatcaggacactagttgtcagaagacatcatgtggttctgtgtttcctatcggatatatatagaagagcgataaatacttgcactgtaatgtcttgtggtttggagtcccctgacatagataaagagggaatatatttgcagaaagtcgcatagggttttttaaatgcagaattttgtcagaagtacaatggcgctgcatgtttttctttgagtgcaaatgtacattgctaagatttttttaagatggcatgtgctttgacctatgagagatatctgcatattcttaagagttgtaaaaatcttagtgagtgagacatattaaaaaaatcataagatgcatccttcgtttcaggagcattctgtgcagatgttttgtctcatcgtaccgggatctaacttatggacta

SEQ ID NO: 503844 - DNA, 616 bp, Homo sapiens
  misc_feature (3)..(3): n is a, c, g, or t
  misc_feature (75)..(75): n is a, c, g, or t
  misc_feature (77)..(77): n is a, c, g, or t
  misc_feature (82)..(82): n is a, c, g, or t
  misc_feature (115)..(115): n is a, c, g, or t
  misc_feature (118)..(119): n is a, c, g, or t
  misc_feature (133)..(133): n is a, c, g, or t
  misc_feature (135)..(135): n is a, c, g, or t
  misc_feature (142)..(143): n is a, c, g, or t
  misc_feature (145)..(145): n is a, c, g, or t
  misc_feature (147)..(147): n is a, c, g, or t
  misc_feature (155)..(155): n is a, c, g, or t
  misc_feature (157)..(158): n is a, c, g, or t
  misc_feature (161)..(161): n is a, c, g, or t
  misc_feature (163)..(163): n is a, c, g, or t
  misc_feature (165)..(165): n is a, c, g, or t
  misc_feature (168)..(169): n is a, c, g, or t
  misc_feature (173)..(173): n is a, c, g, or t
  misc_feature (177)..(177): n is a, c, g, or t
  misc_feature (182)..(182): n is a, c, g, or t
  misc_feature (184)..(184): n is a, c, g, or t
  misc_feature (188)..(188): n is a, c, g, or t
  misc_feature (190)..(190): n is a, c, g, or t
  misc_feature (195)..(195): n is a, c, g, or t
  misc_feature (199)..(199): n is a, c, g, or t
  misc_feature (204)..(204): n is a, c, g, or t
  misc_feature (206)..(206): n is a, c, g, or t
  misc_feature (210)..(210): n is a, c, g, or t
  misc_feature (216)..(216): n is a, c, g, or t
  misc_feature (223)..(223): n is a, c, g, or t
  misc_feature (226)..(226): n is a, c, g, or t
  misc_feature (251)..(251): n is a, c, g, or t
  misc_feature (254)..(254): n is a, c, g, or t
  misc_feature (273)..(273): n is a, c, g, or t
  misc_feature (344)..(344): n is a, c, g, or t
  misc_feature (473)..(473): n is a, c, g, or t
  misc_feature (532)..(532): n is a, c, g, or t
ggnggtgtccccgtttcccaccatgctgctcgtcctcctcttcttcctgcggtgcactgtcccatcgccctcggntncagantcgcactctgagtcggagtctgacgaactggtnttnntggtgctggttgtntngctggtnntntnggttgctntnnctntngnctnntganggtnatttntntttncnaggtntgcnatctngnggtnctcttnttttatnatntttttccatttttttgtttactttnttntccctcttaccgtcttgtnccataccacagggaagttggtgctgctggcaaaattttttttgatggcgatagttgtgtcgatatttaggncaacatgccaccagcctcctggtacaaagacagtctctcctggtttttgtaagatttccaggggtttgaattcaggtggccaggttggaagctgtgtccggggataaataacattaaaccaggtaatancttcgtcttgctggttccctccttcgtctcgggtcactttgatgagttccctgggagtnctggtaggaaacaggcaccagcgcttgttgccctgaactaaggcattccaggcactggttcccagagggtcgatgtgaatccca

SEQ ID NO: 503845 - DNA, 367 bp, Homo sapiens
tttcctggaatccacctggggacctttagggggacctaattaaaaatccccattttccggagtggggggggccattaaccctctgtggcccgggttaaaaaaaatccctccccggtgtgggcatttttggtcccgtcccaaaaccctttttcccagggattttttgggatggcccccaactgatgtttttttttttaggggctgaaaaaaaaagaagtttatggttgtccccagtttttatgaaaccggttttgtaaaaaaaattttgtggttttagtattgtccttcagggttccaaacccccccccatggccccccggtgggtttaaaaaccttttcccttttgttaaaggcccttttttgggga

SEQ ID NO: 503846 - DNA, 159 bp, Homo sapiens
tagaaggatccgggttgggtttataggccctcccctcctcacagtggccaggtagacccctttgaaggaggggaggggcctagggagccggcacctgtgtcatggtaccatcgattaaagttacccgtgaagggagcccaaaggggtacggacgctcga

SEQ ID NO: 503847 - DNA, 447 bp, Homo sapiens
gtgtacctagttaagcgagttagtgaagagattatctgaaactgctcatgcacttatgaaggggcaatgtcctgagactgtcgttgtcagctggaggcccaggagagctgatggtttctggtccagtctgagtctgaaggcccaggaacctgagaaatgctgctgcaggttccagatctgatggctgaagatccaagaagagctggcatttcattccaagcccagaggctggagaaagaccgaggtctcagctgcagctgtcacaggaggaggccctctcattcatcctttgtatctatgttagctcccaactgatgtggacagaggcccaccaccctggggagggccacccttcacatgctaatctcacttggaaacacccacagcacacccagaacgatgcttggctaaatgtctaggcacccaaggcccactcaggttgacaca

SEQ ID NO: 503848 - DNA, 346 bp, Homo sapiens
cctacgttctacgattgcgaagcggtcgtcttccaagaataaatatctatcattccccatacaccccaaccgtcctatcaccaccacgtacccactgctcgacagcttttgatacacgacaatattcagctcttgggcactcgctgagtctagtattcgcagtataaatccggaagtgtgtactagattaagtatgctcttccaccctgtatgtgagtactgtgtcttacatcttcccctccttcctccctgtgtatcaaacaggaatacatcaatggaagacaagagaccagtaagggacctatcgaattaaacaaaaaaaagacaataataaaaaaggctcatt

SEQ ID NO: 503849 - DNA, 132 bp, Homo sapiens
tctagcaggatcccctttggtctcagattagttgagcggtcatcatgttgtcttctatcattcagtagatgcatctctgaagtgcagtcgattcgatgtaatgaaaaatggtcctctgagtctcacatcgaa

SEQ ID NO: 503850 - DNA, 418 bp, Homo sapiens
gagatcctgaacacgcatctcatgactgagtataggccttagaagaatatcaatcattctatcataaagataaatgcatatgtatgttcactgcagcactattcagaagtagcaaagacatagaatcaatgtaaatgcccatcaataatggactggataaagaaaacatggcgcatacacaccacagaatactatgcagccagaaaaaagaaagaggtcacgtcctttgcagggacatggatggagctggaggacatgatcctttgcaaaccaactcaggaatagaaaaccaaatactgcatgttctcacttataagtgggagctaaacaatgagaacacatggacacagagaggggggaaaaacacactggggcctttgggagagtgcaggcgtggaaagagggagaggatcaggag

SEQ ID NO: 503851 - DNA, 159 bp, Homo sapiens
attcctgagtataccccctcttgaggtgctgacaggaattctatgtgaactcagctacctatcctggtgtagcaaaaatagttttataatagttctataactactttgaatgtgtttgatctaacggtcctctgaccctgagctgcatccttggttcat

SEQ ID NO: 503852 - DNA, 623 bp, Homo sapiens
  misc_feature (93)..(93): n is a, c, g, or t
  misc_feature (576)..(576): n is a, c, g, or t
  misc_feature (622)..(622): n is a, c, g, or t
cggacgcgtgggttttaactcttgtagtattttattgttgttaatttacaagtttaaaaatattaggtactatttttaaccattattaatagnacctaatattaataatggttaaaaatagaaaaatgcatatttttgtatgataatcaaatgtaaaatacttttatttttgctggacagttgttatatcatgattattgtgctacagtttattgtgcataatatgaaaaacaactatgacagccttcagtcgggccagggtgaagctgcttataccacctctgccgtcagagggacatgtggtgacagcagtggtgtggctgcacagggcgcactagagagagctcagcacccctgctgcccgccagcagagcccgtgctgagggaatgccgcacagatgctgatgcactgggtgaaatttctagtattgaacgtaaaggtgtcagtgtcttgctgttattttatgatggaaactgattttgaaaccaaaaatagctaactaactttatttaaggaaaggatattaatttgtctaacagagggtgaaagctgttcacatttgcaacaaaatctgnttgctgcagtagtacctcaagtggtaaaacttgtttccgagaaacnt

SEQ ID NO: 503853 - DNA, 1240 bp, Homo sapiens
atttcaaagttctctttcttttgggaaagaaaaagttggaagtttaaaaatgcctctagaacaaacctatctccacattccatcaactgtataggaggcaggaaagcatgttttatgagcaaaggctttgggagcaggaaatttccattctatgatgtactagctactgccgctgggctttagtttccttatttataaaatggaaatatcaatagcgcttgccttcacagggttggagtgagcattgcacgagataatgcatatgaagggctttagccagtgtcaggcatagagaaggatctcaataaatgttagtgatgatggtggtgatgatgataaaggatttggagtctcaaaaagttgtattgcagcgttacaacataacattttcagataagaaacgagatcacatattctgccaaggttatttgaatttgctatgtggaagggaaaattacttctctgtcacttaatggctgccatatattcttactcagttaggaggtgtgcttacacgtgtttgtgatgtcttgtgtccttgccctgatggtcagaagttttgttttagccctttaaaaaatccaatacagctttcagtattctgcagtgcatgcagtagactttctacaagtaaatgttttaattaaaaaaatcaaattatcatgcaaattatactggtagaaaagattttggccttatgaacatttacaaggcattgatttttaaagtaaaataaattagcaaataaggccttataaactacctatttctggtctatttcctagggactcacccctactcaccattgcttctcttagcactttggctgttacacaatgaaatgaagttaatggtttctaataatgaatgagccatcttcatattagaggtcttggtaccaagcaatagaaaccaactcaggctaacaagagggaatgtactgaaaggaaatgagaggacctacagaactgatgtgaggctggaggaccacacttgaggatgagcaaagagcatgagagctctggcaagttaggggcaggaaccatagccatagtctttgtagcaggaagcatctgctcagcacttggccatggggaaagaaaacccacagtctactttcttctctatgtgggtgacccactccacggtcagagtcctctgagagtgtatgactggccaagctcagataacaggctcacagccaggctataccaggagctgggggtaggggtgtagagat

SEQ ID NO: 503854 - DNA, 111 bp, Homo sapiens
gtgtgctcgtctgtctaagatcccccttctttctcgcttctctttaggaagaaagaagttttttaatttttggtctacgcttataagggcatccccaaaatctcacacatg

SEQ ID NO: 503855 - DNA, 151 bp, Homo sapiens
ataaaaaagacgcacgatgcatcgcctcggccggcgcatagcaaccaacttagaactggtacggaccaggaaatccgacagtaaaataaaaacaaagcatacgcgaaagcccagccggcgggtgtacgacgcgatagtgatacactagccc

SEQ ID NO: 503856 - DNA, 334 bp, Homo sapiens
tcagcgaaatatttgttcccacaagccaaggaagacatgccaatcacaggttccacacactggaaacacaaagattccagagccaggctgtaccacggtccctgagccaggctgtaccaaggtccctgaaccaggtagtaacaaggtccctgagaccaggatgtaccaaggtccctgaagccaggttgtaccaaggtcccatgagccaagagaatacaccaaggtcccatagccaggaagaaatcaggtccctaaccaaggctacatcaaagtttcctgagccaggtgccatcaaaagtactgagacaaggatacaacaaagttcctgtgccag

SEQ ID NO: 503857 - DNA, 469 bp, Homo sapiens
aaaactatgtggccctccagcttcagtctccctttcccatcagtcggccccgcagggagcgtccatatatggagcatcctacccgttccatagacctgtgcttcccatcccgcctgtgggactttatgccacgccagtgggatatggcatgtcccccctgtcctaaggaagaccagatcaatagactccatgatggatgcttgtttcaaagggtttcctctccctctccacgaaggcagtaccagccagtactcctgctttgctaaccctgggggcccccccctaaacggttaggctgacagggccccccgacatagctgaaatttgttctgtaggcggaggccccaagccctgttttcttggggtaattttccaaaagcccccttttcctttcccaaaaattggctctgatggtttttatggataaaaatatatatataataaaatataaaccctttttatccagcca

SEQ ID NO: 503858 - DNA, 920 bp, Homo sapiens
taatgttttcccggcgtttaaaaatcgccctttgtgaatctgggtattttctcatgctgtttacgtactttaagaagcctcggaatatcaccatgtgaagatcacgtatcaatacactgtttccactgatctattcttagatctaaggcaatactacagaagatatttttcatggggcttcagtaacgtttgtcatttttagaatcattgggccccggttacagagtgagttgtcacataaggtacttgaagagtttatgtaggttaattctatttttacagtaacccttgaagttcttctgagttgttgcatgtactctaaattcaagttaaatgctgaacatgaagagtaaaggtactttatctgacaagaagtttctgggcttaggacgatacgtaatgcaatgtagtccatttgtacatggtcttacactgttgtggatgcttctgtaaacattttcctgtatgtttaaattgtgtttcagcaggatgtaattgcccttgtgtgtagttaaaatgagtcatcatctggtcctttgtgaatactggaattcatggtattttctgtaacagttttcctgaagctgtttctggagagccacacatttaaatacagacagctttcctgatcaatgtgatttacttgtgcacctgactttttggtcgtaaaaggaattattcgccacacatatgattttacctgtattcctgttaagattttagccttgtaagttaaagctgctcttacatgatgatgtgtaaagctgtccttgtccctttactgggtttcggcggggttgttacaagatagggaatgaagaatgcaatatggtttatcgttcaaactgtccactctggatccaagcctgtactgatagtacttcccagtatgataattgtgatgtttcatacaatgcagt

SEQ ID NO: 503859 - DNA, 365 bp, Homo sapiens
  misc_feature (70)..(70): n is a, c, g, or t
tatagatatatatctttatatgttgtatagatgtttattaagtaccagaaattaagaagttcataaccgnccagtcacagtggctcatgcctgtaatcccagcactttgggaagccaaggcaggaggatcacttgaggccaggagtttgagaccagcctaggcagcatagcaagcccgccatttctacaaaaaaaaaaaattaataaaataaattagccgggcgtggtggcactgcctgtagtcccagctactagggaggtggaggtgggaggattgcttgagcccaggcctaagctatcatcaagccactgcagtccagcctgggcaacagagttagaccctgtctcaaaaaaaactaaaataa

SEQ ID NO: 503860 - DNA, 334 bp, Homo sapiens
cagtaataacaatacgagaccagtaataacaatacgagacccgtaataacaatacacaggacgagacccgtaataacaatacacaggacgagaccagtaataacaatacgagaccagtaataacaatacacaggacgagaccagtaataacaatacacaggacgagaccagtaataacaagacacaggacgagaccagtaataacaatacacaggacgagaccagtaataacaatacacaggacgagaccagtaataacaatacacaggacgagaccagtaataacaacacacaggacgagaccagtaataacgtcgacgcggccgcgaattta

SEQ ID NO: 503861 - DNA, 156 bp, Homo sapiens
aatcccgtggacatgaccacgagtcaccggcatatggcatacagattcataaagtggtttgaggttactagtatgattggtggtttttgtttgtttttttttatttctcaccgttaaggggaggatttacattggcccccaacgtgattgtcactt

SEQ ID NO: 503862 - DNA, 205 bp, Homo sapiens
cggttcaggtcgcactccatcgaccggcactgggggcaatgacggtgggcctcgcggtggtggtggcactaggcggcggaacgggtggtgagggcgagggtgagggcgacaaggacaaaaaaggctgcggcctgcctggacagcccaaatgcgctatcgacgagaccgggaccccctatggcaagtccgcctacggtgagctcaa

SEQ ID NO: 503863 - DNA, 549 bp, Homo sapiens
  misc_feature (446)..(446): n is a, c, g, or t
  misc_feature (475)..(475): n is a, c, g, or t
gcacgaggagagcagtaccccttatacgagatcactcctgcacctgcgatagcggattgagtgttattgagaacactgctcctattagcctgtgtcaacgctagagttctagcgagaaattccacaggctgagaccttgcatatggcgagccgttcattctggatgaagcactcgaacataaactttctaagactaagatcattcctatccagatgtgagtaacggttgtggaacactcactcactgcactgagagtgtctcaagacatgcgcgtaatctcgttgtatgcgaagtgttcaaccagttggaattcgcaagcaaggctgctgatctttagaaagatatctaatctttccatgtacgggactacatgtgttgagttaaacgaacatccaaccacggcattttatttgatcgaacggtgggctttcagaatttgccgttntatttcggaaccagttggtcttacctgcngagttgacattatatgactccgtcttttcttccgctggcccagggcaggagcgccactaatgggttgctggtgg

SEQ ID NO: 503864 - DNA, 334 bp, Homo sapiens
gctcacacttgacatatcactaatatctaactctcagtttaacactgagtaactattacctgtatcagctatctgtgtgtgtgcagaatgaccttatcactatcaggccgtgtgtatcctcgtggaacagatataagaggtggtagacttaacactggctactggttaaatgatacaaagcttgcatccaggctctacaatttattatgtgccttaggtgagcctctaagcctcttcatcatcctataaaattctgtatcacaaggttaccctgaagattaaatgagtgatgtgggtgaaatcaatcagctgtacatgacatagaaaatatctg

SEQ ID NO: 503865 - DNA, 1291 bp, Homo sapiens
  misc_feature (304)..(304): n is a, c, g, or t
gccgattccggagcctggggtagtcgacgccgccgccgtcggtcgtgactagaccactgcaggcatccgttgccagcgatctgacgtagttggggcttagtgaaggaagagggtcagtctcgctcggagcttcgctcgagaacgggtcttctgttgccctagcaggcctctcccactggcgtaatgacaactggatcaatcaggtgagctgggtacagcaaagccatactcgctgagcaggctgagcgatcatgatgatatggctgcaggccatgcaacggcagatcaactagcaacccagggngacatgcaacgtcctcctgaacagaagtaaccagagacactcttgctccgtcctgtgttgcacctacgaaatgacagtgctgtggtcacggcgcccccgctcgcctgtcattcccgtggccgatgtccaatcgtgccaggccacttggacgccaggagaatacccacaagtgagggaaatgagacgcaaggcaaaggcatgagctgagacaatgaggactgaaaagagaagagtgacacgctgtgagttgaagtgacttagacagtgggcatgcccaagctgaactggcgttacaacactcccctgccttaaatggggaatggttttcccgcgggcagccactgttgtagcagaggcggaaagactttttcctctgaagtttacaccacaaccactttggcattaaaccaaacgacattctcaaagggaaaaacgatcccaaggtggtggattttaccctcaaccttatggaaccatagggttggaagagatccggtaatggaactatgaattgtccttttgcggagttttactacctcttatttcttggggaacagtgcctcgtgggtattttccgtaagagaacttggaaccggcacacgagagacaccataccaccttctagcggttagcgtgcattccagaaagaaccctccaccctaagagcccaggcggtcctctaacccccgaaaggagaatgaagggctactttcttgagagacacactctatggcggtaaaaaaggagaacacacccggaaatcatttttgcgatagggacggctatatggagcgatttcgcttcggaaaaccttattaccggctcagtgggaggtcccctgtgggggccccgcccattagaatcatcgtcctctacagtttcgaatgggacatcggaattgggctatacagcctaacatatggcacgcgagcttttccctttaatataaagcttacttctcctttggacaccaaaaagagggcgcca

SEQ ID NO: 503866 - DNA, 155 bp, Homo sapiens
tcatctttatggctctccctcaattccttcagaggatctgtaacctgcgggttcttcagaaagccttccttgtaacacccatttgaaacacgtgctctcatcaaactcccaccctttcttctgctaccaacatcttcataacacttcattctcca

SEQ ID NO: 503867 - DNA, 280 bp, Homo sapiens
  misc_feature (72)..(72): n is a, c, g, or t
  misc_feature (198)..(198): n is a, c, g, or t
  misc_feature (247)..(247): n is a, c, g, or t
acacagtatttcatgtttctattgattatgaaaggaaacagacaccatgccctgctaattttttgtattttnagtagagacacggcttcgccatgttgcctaggctggtctcaaactcctggactcaagcaattagcctgcctcagtctcccaaagtgctgggatacaggtgtgcaccaccatgtccagctaattttngtattttttgtagagatggggttttcccatgttgcccaggctggttttnaacttctgggctcaagcaatcctcctgttctgg

SEQ ID NO: 503868 - DNA, 380 bp, Homo sapiens
aaggggcaacatttcatgggcgacttcctttattcacaaacacctttcccactcactagcaagaagcaaggatctatttagaacttgccagaatctctgtattatcaatagcctagggtgagaatgatagtcttattcatgcagtgtgggctctgacattcctaatgttaatttagatactacatagagtaggcttctggtcacaactaaggtatcccctttggggtctaaaagacatctccaactcaaggtgtctgcacacagttattgagctattctttattgtagaatcttcctctactgacagcatccttcatgatgttcattgtacttaacttctcagcttgtagggtcattcctagttctcttcctgtcgacgc

SEQ ID NO: 503869 - DNA, 922 bp, Homo sapiens
  misc_feature (405)..(405): n is a, c, g, or t
gctggttgtggggacatgtagtgaatctgtatgcaggagagttgtgttgtgctggatgtgggcgtggtggtcaggtaggaggcgtcggcaacttctggaagaaatcatgtctgaggtgtcgttgatgtgatcatgacagataggtgaagatcggcaagtgctagggaagatgggcttgataggcaaactggaattatcaggagtaccgtggtgagaggagtcagggttgatcgctaataggtaacaaagaggttgtgtttggggttgttgcagattgattgagaaagttatgctgtacgtgttttccagtattagcattgaggtctgggtgaccatttgggagatgccttgcgttataagagcctcggagggatttctactcatgtgcttcccctctcttgcctngcagactctgaggcaagcaattgtggtgtctcctagttagactgtcagtgcgagggagagctgctgcttgactgagctgcagtagagaatttggttcgcaggaggaagatggcacagagaaagcgagtcggaaggaagaccaattgccggtgatgggccaaggacaatagacctgttgggggctgagaaaacacgccatgaaatatgctgccgaataatgaggcctgactccagcagaagggcgtggtacctggaggcttccgacatgagatgtaccaaacagacaaggacgcaagagaaggggtccacctcaagacccatgacagccggacattggcaaactacccacccaggcggtacaagtcagaattgccgcacccggcgcaaaatgccggacataggaggggaacagagggaagggcatacaggccgcaagcaacacggggagacaaagacggtaaaaaaaaacagcgcaccagcaatgcgcacacctagaacaccacggcgacaaccacgg

SEQ ID NO: 503870 - DNA, 202 bp, Homo sapiens
gcggatgtcacgcagggctcgaggaaggcagttggtgggaatgtccagcttgggtccctgagagactgtgagaaggagatgcggctgctgctggcccagtgtcttgacgggagcatatggccctgagcccatgagaatgcgtggaatgcgtgccgaaaacaggagcaaatggctgttttataaagttattttttttgaaagt

SEQ ID NO: 503871 - DNA, 296 bp, Homo sapiens
tccccgggttgtggaagccccaagttgagaacaataatgaacaattattgtatgaacaattgttagagacagctaatcacaaacaacctgcgggcacaatgacctcattccacacgtagcacccttcagcaggaccctataaaactttcatccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 503872 - DNA, 787 bp, Homo sapiens
  misc_feature (609)..(609): n is a, c, g, or t
tagacccccttgttctccaaacattgtcccctttcttttggtcaaacaaccgggagttattcccaaatttctccctccccccctcctcatgcgacgagcttccccatacacccccctcaaggcaacacccattctttgcaccacccgggggccccccacatattcactatgctgagggcctacctgttctctaaagaacactttccccgtcccctctaagggtcccaaacacaccaccatgtttcgtccccacaagggcgtgctcctccctcaagggtcacacctgctcggttggatacttcttaatgcttaatcaacacggggtcgccacaccaacaatgggggcggtctctcacaacggtgtaagtacccctccgggtgtgccctcctccgcacgatagtcttgcgtatacatatcatctcccacttcttgtttaaaggtttctacccccacagctgccgatgttatgtaattagacctgtcctagatttttgtctgagaccggggacataatcaaattcgtttcatcactgctgttagccgcttgttggagaacaaactacctccgctttcgccgtactccatgaccccgctttgaccaccccgcnatagggaataatactcacgccacgtctatcaccgcctccctctctcctcttgctcctccccgtgccccgactccccctcttcttctgtcttttcctagtggagactgaagacccgccctttagcttcgtccccctcgccataatcaacgccccttttaaccagacacaacatatccaa

SEQ ID NO: 503873 - DNA, 665 bp, Homo sapiens
ggaatcgaccttaaggccgggcaggacatcctggccaactgggagaaccccaatgtgctaaaaaacgaattagctgcgtgtggtggctgatgcttgaaatcccaggtgctcaagaatctggtgcaggaaaatcactgggacccaggaagcaagtggtgcgggggagccaagattgggccgttgggctggcaggctagggacaaagagggaactgtaggtgagagagacggggggcgaggagtaagcaaggcggacgaggaaggggagcggcgagggacggaggggggcgtgaggggggggggggggggcgaggggcgaggggggggggaggtggaggggggggggctgggggaggcgggaggggggggaggggcggggggggtgaggggaggggggaggctgttagcgtagattgttatgacgcttgtcgtatgcgttggattctagtaattgtataaaggtacgaggggtgtgagatcgaggaggtgtgctgagtataacttgtaggagagaggcgcgatgtgggggagggcggggcggttcacgagggccgctcaacaaactataggacacactcagcagtaaagcgcatgtgtgttggccgtatgtgagattagcactccgtataattttctgtgcacggcacggtaaggaggcttagtgtg

SEQ ID NO: 503874 - DNA, 213 bp, Homo sapiens
ggaatcagaaattacctagaaggcaccatgtttttttctatgaccttttaagtccttaaggtcaatttaaggtccctgcagggggttagtaagaaagggtatactttgtgggtatgtttgctttcctaataggggacatgaaggaaaccccgcaatttgctgttatgtgaatggcctttggagcagagtcaagagcggtgtgctttccccact

SEQ ID NO: 503875 - DNA, 876 bp, Homo sapiens
  misc_feature (876)..(876): n is a, c, g, or t
gaaatactatcaccaacatccccatatccccccccttccccgtttcgcctcccccgtccgtcgccccgtctcctatcactctcccgccctctaactcaccacccgcagaccagctctcgagactactgggcacacagacacgggcattgaagacatctacctgcttctcctttgccttgcatcatgactgacagttgtctgaggtctcccagccacgtgtcctgtccagcctgtgtaactactttaaagaagaatcacaaaatggacactgggattggacgcagagatccgacggccaaattacggactgccaatgacgctcacatccctatcgataccccccgctgcagcctagaggtggaccatacaacaaaaaaagaaacagcagcatgccctctctagcgagcatccgctcataaagggaagggaaaagcgggatactggataccaatgcgcggcctttgtaactccgcaacacgggcttcttgacggcgcttgcgacggccgccaccaactcacgtacgcacgcgtctccctccgcgctcgttaaccgcgttcctttatcgaacctcctccccgtgttagcctatagagatctagagaggttccaggtgcggcagactccgcagcaggggcccatagggataagcggctcgtgaggcttggccacggagcctacctggcatcccttctgcaatgcagcggtcgtgcacgggtgaaacacccgtgatggggactagcacgacgccgcggggctacgccccgcgaggggagggcctgccggggaaacacaggcaaggggcagctccaggtggggggcattacagcatcaccagttccggcaagaaaaacacgacacgatcgtcggagataggn

SEQ ID NO: 503876 - DNA, 218 bp, Homo sapiens
  misc_feature (7)..(7): n is a, c, g, or t
cagtaantggatactacccagccataaaaaagaacaaaataatgccattgatacaacatggatggaactagagactctcatactcagtgaggtaactcagaaagacaaagacaaatatcatatgatatcatttataactggaatctaacatatggcacacatgaacttttacacaggtgggaaaaaaaaaactcagggactgggagaacagaccgctc

SEQ ID NO: 503877 - DNA, 543 bp, Homo sapiens
gcacgagctgagtttgcgcaaacacgtgtggctgatgagagagctgagaatagtgacaaatcactttataccctttttggagacacattatgcacacgtgcgactcttcgtgaaacctatggggaaatggctgactggtgtgcaaaacaagaacctgagagaaatgaaagcgttttgcgacaccaagatgaccacccaaaccttccccgaatggtgagacacacaagttgaagggataggcactggttttcatggcacatggagagacatttttgagaaaaatacctatatgaaattggcacaagacatacttacttttatgccccggaactccttttctttggttaaaggtgtaaagctggttttacacgaatgtgggccagctgttgagaaagctgtctgtctgttgccaaagctctatgaactctgggatgaaaggaaaggtttggctgtcaaaacagactctatgtgccacacttcctttggagaagagctctcaaagcatgggagtctcgcctgagacccagatttccggtggtttgc

SEQ ID NO: 503878 - DNA, 455 bp, Homo sapiens
cgaggattccgggaggccatatattaaacttgattcatcacatgaaatagcattgtgcacagtcactcataagagagccatgatatatgcagaagcaaaggtgcaggcatcatgcaatagtttcgtaccagatttcaagatacccagtatcaaggaaacacaatgaaattgacggctgaggtgaagtacaggcataaggcaaggaaagcagaacattcaagatgtacctatatacaccagttcttaaaacacgcaaatcatttccaataaggcactggctcatgtatttctgtagaggcagaagtcaatcttaggatgtggtctgtacatatctgcagataagattcacaaaagctgaattcagagtaatcagatccttcattcagatgcttcatctatgcattatcaattgctttcctgtgatataacttatctttatctcgggctcccggggt

SEQ ID NO: 503879 - DNA, 674 bp, Homo sapiens
  misc_feature (3)..(3): n is a, c, g, or t
  misc_feature (20)..(20): n is a, c, g, or t
  misc_feature (72)..(72): n is a, c, g, or t
  misc_feature (89)..(89): n is a, c, g, or t
  misc_feature (97)..(97): n is a, c, g, or t
  misc_feature (104)..(104): n is a, c, g, or t
  misc_feature (107)..(107): n is a, c, g, or t
  misc_feature (111)..(111): n is a, c, g, or t
  misc_feature (119)..(119): n is a, c, g, or t
  misc_feature (150)..(150): n is a, c, g, or t
  misc_feature (155)..(155): n is a, c, g, or t
  misc_feature (158)..(158): n is a, c, g, or t
  misc_feature (164)..(164): n is a, c, g, or t
  misc_feature (201)..(201): n is a, c, g, or t
  misc_feature (204)..(204): n is a, c, g, or t
  misc_feature (209)..(209): n is a, c, g, or t
  misc_feature (248)..(249): n is a, c, g, or t
  misc_feature (255)..(255): n is a, c, g, or t
  misc_feature (257)..(257): n is a, c, g, or t
  misc_feature (267)..(267): n is a, c, g, or t
  misc_feature (276)..(276): n is a, c, g, or t
  misc_feature (288)..(288): n is a, c, g, or t
  misc_feature (291)..(291): n is a, c, g, or t
  misc_feature (301)..(301): n is a, c, g, or t
  misc_feature (314)..(314): n is a, c, g, or t
  misc_feature (321)..(321): n is a, c, g, or t
  misc_feature (339)..(340): n is a, c, g, or t
  misc_feature (345)..(346): n is a, c, g, or t
  misc_feature (349)..(349): n is a, c, g, or t
  misc_feature (352)..(352): n is a, c, g, or t
  misc_feature (355)..(355): n is a, c, g, or t
  misc_feature (363)..(364): n is a, c, g, or t
  misc_feature (366)..(366): n is a, c, g, or t
  misc_feature (374)..(374): n is a, c, g, or t
  misc_feature (379)..(379): n is a, c, g, or t
  misc_feature (382)..(382): n is a, c, g, or t
  misc_feature (387)..(389): n is a, c, g, or t
  misc_feature (394)..(394): n is a, c, g, or t
  misc_feature (445)..(445): n is a, c, g, or t
  misc_feature (460)..(460): n is a, c, g, or t
  misc_feature (468)..(468): n is a, c, g, or t
  misc_feature (490)..(490): n is a, c, g, or t
  misc_feature (492)..(492): n is a, c, g, or t
  misc_feature (495)..(495): n is a, c, g, or t
  misc_feature (570)..(570): n is a, c, g, or t
  misc_feature (588)..(588): n is a, c, g, or t
  misc_feature (590)..(590): n is a, c, g, or t
  misc_feature (592)..(592): n is a, c, g, or t
  misc_feature (599)..(599): n is a, c, g, or t
  misc_feature (603)..(603): n is a, c, g, or t
  misc_feature (605)..(605): n is a, c, g, or t
  misc_feature (611)..(611): n is a, c, g, or t
  misc_feature (613)..(613): n is a, c, g, or t
  misc_feature (620)..(620): n is a, c, g, or t
tcncatttaacttttttaangggtctcaaaattctgtgaaaaatttttgggcaagttgtttccattaaaaantactgattttaaaaacnaaaaaccnaaaaccnccncacncaaaaaanaaaaccaaagtgggccacaaaacattccccnttccntcngaaggntttacgatgcattgttatcattaaccagtcttttacnacnaaacntaaatggccaattgaaacaaacagtcccgagaccgtccnncccccncngattaagagngggggggcngggattaggganaanattcatttanccccccgagcctnccgggcngacttggggaccttgccnnccccnnccnccntcntgtccccnncnttgatganacccnccncaacnnnctgtntcaaatcacgaacagcaaagcgacccaaagggggatagtctgagaagcccncaacacacatgggcntcccaggnaccaaaacaacaatggcagccncnccngacttcaagaatttagggccatcttccagctttttaccagaacggcgatcaatcttttccttcagcccagcaaanttgcatgcaatgtgagcngngngggaatncaananaggggnanagccggngcttatttggcctggatggttcaggataatcacctgagccgttaagccagccgc

SEQ ID NO: 503880 - DNA, 867 bp, Homo sapiens
  misc_feature (76)..(76): n is a, c, g, or t
  misc_feature (121)..(121): n is a, c, g, or t
  misc_feature (290)..(290): n is a, c, g, or t
agcaggcggcgtcggtgtcgggacgctctgtgggggcgggcgcaagggaggtttcgagccccggaggtccgcgccnagagctaacgggagtcccaggttaaacactttaagatgagaaaantgatctctgtctgagctctgaaggtccgagtgatttagctacatcagtgatgaaaacacccactgaaatatcattgatggatcagaacgtttgacacacagaatgttcccaggatcatattgttccacaaacatgtaaggattgaaaggcttgtaatccaaagttactntggtaagcaaatcttacattaattttttttttttttttggggggccccgggataagggcgataatatttaaggtttaatttatccttacattttttccacagggcaagaagggattattttgtaaccttggggcaaaacatatagttttccttaataggcaggggaattccaggttaaatggcgggggtagaaagggagggggataatgagggtaaatggcctggagctcagtgggccctctctcaaacggcaactttcagaaacctttccaaagcacttattattttccatggcaattcactattgtaaacggtcttgggcaaagggccctatagaggaacttagagattccagctggctaaaacattatcccagtgacttcttaatccaaaatccattggcccgggagctcattggccaaattcctggtggacaactcggatacccccgatctatcccactggatagctcgaaattcttcttatcacctaggggcattccccaaggactaaggcgggataattccccgggggaccttcttctaactcctatcattaccgatacatgtactcgaga

SEQ ID NO: 503881 - DNA, 306 bp, Homo sapiens
  misc_feature (76)..(76): n is a, c, g, or t
  misc_feature (121)..(121): n is a, c, g, or t
agcaggcggcgtcggtgtcgggacgctctgtgggggcgggcgcaagggaggtttcgagccccggaggtccgcgccnagagctaacgggagtcccaggttaaacactttaagatgagaaaantgatctctgtctgagctctgaaggtccgagtgatttagctacatcagtgatgaaaacacccactgaaatatcattgatggatcagaacgtttgacacacagaatgttcccaggatcatattgttccacaacagtagatgaagctgtatcaagtacttgtcagcctagatgaaagacgtaaggcat

SEQ ID NO: 503882 - DNA, 990 bp, Homo sapiens
gcatcggatgctcgatcttctgtaagtgtaactcttctatgggtggctgtgtcctatatttttaagtcattgccatgtcccccatgttatctgagtaactcacagtcatgtcgacttgtggactcacctccttgagtttacatccagtggctgcctttgggcccaggtgcccccatcagcaggatagtgtgattgagtggtaatcatggagccaggcccgccccctccgtgtgttcaactgtatgcggtctcggtgtgggggccgtggcgcgctcgtgtgacgacgcgtttgccctctgcactaggcccacgtggaagccggaagatgtgatagagagtcgcttctggggcatgctccgagggaagccggcagtggccgcctgggtgacctgactgacctgcccacgtatgagcacatccagaccggcctgtcgagtaaggacgggcgcctgcccaggactgtaccggctcttccggtagaaccgctccccgtgcctgacagacccagggagctgcagctggagcccgttcccgtgcgtgtagtttggacacgaattgagtctaaaaaagctgtctggttgtataaacggtgcatacaattgtctgccacaggaccaccgcggtttgcattctttcggaactcaatgtgccgatcagtggagtcagtatcgagcctgacacgcaagccaggaagcaggtgaagtgcccagcgctggagtgcagcgtgcacgaagaggcggtggtgctaccctctcggctgtgggacatgggggccgaggttctggaggagcctggactggaggcagaaggtgaccataaagctccggagcccggctggtaccggacactgaagaggaagtagggccgaacaccagagcgcccacggggacaattcggaagacggttataaaaaaaaaacaaggggaaatacagcagacacattaagcagaaaaaaggcacgaaaatagacagaaaaacatctgaataaga

SEQ ID NO: 503883 - DNA, 103 bp, Homo sapiens
tgtatcgatccctgctgccggtgaactctccgtgaacagtagatggcttgcggtgggggcttggggagctcgcgctggaagtccaggggccagattatcaacg

SEQ ID NO: 503884 - DNA, 463 bp, Homo sapiens
gtaattccaaactgttagaaaagcgtatactaatccagtatttctgtttaaattcagtatgaacagactcacatctatcattagggaaattctgaaatcacttgagaaaaaagtttcctttatgttgtgaatggaaaacaatacacagtattaaataatataataagatctcaactgtatgacaataggaggaacaaaagcaccataaggaaatgaaccaaaatgttcattttctttagttctcatgacacagagaatttattttcctctgcttttctgtattttccagtattatttcttataaaaagaaacatattaattttaaaaatgcccttctttggcctggtgcagtggctcacacctgtaatcccagcactttgggaggctgaggcgggcggatcacatgaggccagggatttgagaccaggctggctaacatggagaaaccccatctctactggag

SEQ ID NO: 503885 - DNA, 729 bp, Homo sapiens
gtcgcacttgtgagtggtctcgcctgcagtggaaggagccaccgaccccgcccgaccatgtggctgaggagctggtcttagagaggtgtgatctggagctggagaccaatggccgagaccaccacacgggcgacctgtgcctgggagaatgctggtgtgtgctgacgtgggccagcccttctggctgaccctgcactttgagtggccgcaactactgaggccagtgtagacagtctcaccttcagatgtcgtgacctggcccagcccctagccaggaggccgggaccaaggcccgttttccactaagagatgctgtggagtgagggtgactggacagccaccgtggtggaccagcaagactgcacccatctcgcatgcatgctcaccacccctggcaactgcccccatcggcctgtatcgcactcagcctggagggcctccaactggctaccagggatccagcttaggtgctgggcccacttcattttgctctttcaaacgccatggtgcccagcggatgctggtagtaccttggactcgggaagaaggagcggcaggagtatgtcctcacccaggaagggctttatctaccagggctcggccaagttcatcaagaacataccttggaattttgggcagtatgacagatgggatcctagacgatctggctgatccgttctagatgtcaaccccagagtcctggcaggaacgccggcctgtgagtgagtc

SEQ ID NO: 503886 - DNA, 380 bp, Homo sapiens
  misc_feature (28)..(28): n is a, c, g, or t
gaggattttaatggactgcacacccaantgatggaatggtcctctccagctgattcaatcaccgtaaatatttaagcttcttttttaaagtcactgccctggtcccctctctttgcagtgtaacctttgagcctttttaaccatgagagtggaaaaacattgaaccaaaagagaagccaagtgtttttattactgcaagcccaaaggattacatcgttgttgttttttgtcgctgttttttttccgcctccatacaaagtaatagcagtgcactgattcacagttgttttgaaagcttccatgagcaaatggccagtgcactgtaaaatgatgcttttggtgagaaaataaagcagttctaatagtggacttgttcacta

SEQ ID NO: 503887 - DNA, 109 bp, Homo sapiens
ccttccaacatctcatggctatagggaggcgccatgggatgttggaaggagggatgagatgttggaaggcgcaatgagatgttgaaaggagggatgagatgttggaagg

SEQ ID NO: 503888 - DNA, 514 bp, Homo sapiens
gtgtacatcaaataggatgaaatgagtatcaaatcatgtatagaaacgatgtgtgcaagtcaccattctgcctacctaaggcaggagacctgatggatctggggagggtacatggggccttcagttgtgttttctttgttttaaactaaaaattgatgcagaggggtcacaatgttaagattcaaccagggtagtgtggtgggtactatttaactgtttgcttaaagtgtatcaaagtaaaaatattgcttaagcatagtctctgacatctaatgacttaatagacatccctgccaggtacatgatgttacttagagtgagccacctaatctttcaaggcttccatttcctcacctgcaaaaattgggagtgtcagaggcgtatgaaccagagtgactccatctagaatagggaactgggtaaaataaggctgagacctactgggctgcattcccaggaggtaaggcattccaagtcatgggatgagataggaggttataggcagggtaccgag

SEQ ID NO: 503889 - DNA, 898 bp, Homo sapiens
  misc_feature (4)..(4): n is a, c, g, or t
  misc_feature (14)..(14): n is a, c, g, or t
  misc_feature (18)..(19): n is a, c, g, or t
  misc_feature (26)..(27): n is a, c, g, or t
  misc_feature (37)..(37): n is a, c, g, or t
  misc_feature (39)..(39): n is a, c, g, or t
  misc_feature (55)..(56): n is a, c, g, or t
  misc_feature (61)..(61): n is a, c, g, or t
  misc_feature (71)..(71): n is a, c, g, or t
  misc_feature (89)..(89): n is a, c, g, or t
  misc_feature (92)..(92): n is a, c, g, or t
  misc_feature (110)..(111): n is a, c, g, or t
  misc_feature (125)..(125): n is a, c, g, or t
  misc_feature (137)..(137): n is a, c, g, or t
  misc_feature (143)..(143): n is a, c, g, or t
  misc_feature (164)..(164): n is a, c, g, or t
  misc_feature (168)..(169): n is a, c, g, or t
  misc_feature (176)..(176): n is a, c, g, or t
  misc_feature (181)..(181): n is a, c, g, or t
  misc_feature (185)..(185): n is a, c, g, or t
  misc_feature (202)..(203): n is a, c, g, or t
  misc_feature (295)..(295): n is a, c, g, or t
  misc_feature (506)..(507): n is a, c, g, or t
  misc_feature (511)..(511): n is a, c, g, or t
  misc_feature (528)..(528): n is a, c, g, or t
atanacataaatcntagnnaaactgnnctgtaaaatngntagaataagactgatnnactgnagcctgacantggatggctcacacctgntanatcccagacaactttgannaggctgaagcaggnaggatcccttgnggcccnggagtttgagaccagcctggncaannatgacanaagcnccantctctccaaaaatacannggttggccgggcatggtggtgcacacttgtagtcccagtaattagggggctgagacaggaggatcgcttcagcctatgagtttgaggctgcngtgagctgtgattgcgccactacactccagcctggatgacaggacgaaacctgtctcaaaaacaccaaaaaacaaaaaccggtctcctggggtcatggtagcacaaacgcacatgactgagtgctcaggggttctgaggcttgtccgctgacctggggctctggccctgggagatctgggggacctgctgtcctatatgtgatgctttganngacnggggcatcattccaagncaagaggccccagagagggcaccgtgcggtgttcaggcttctgtgaggcccagtgagatcctgtggctgtgccccatcactccaccactctgccctcccactagcttgccaactggatgaatcaacgccttggcagagttatccagcagggccttgccagagagtgtgtgtgacctgtgtgcgcactgccttgagcgaccggttaccgagtaagcttgaacattcaagcgtgagcctattgtcctgttggcagttcagggccaaaccaggaatccattaggcgacccatgggcaacctttctgaccaacaactgtggctgcatgggaccgcgataagcgcccatgccctacgcacaccccgacacaaccc

SEQ ID NO: 503890 - DNA, 108 bp, Homo sapiens
cacgaggagaacctgcagtcctttaacgagatcactgctatgaccggcgatggagtgaacgacgcaccagccctgaagaaagcagagatcggcatcgccatgggctca

SEQ ID NO: 503891 - DNA, 224 bp, Homo sapiens
acaggctctcaaggagtttaaactttactccgactaataggtttttgatgacttctagcaaggcttgctaaccgggccttactctcgactattaacctactgggagaactatctgtgctagtaaccacgatggacggatcaaatatgactctactacttacaggactcaacatactagtaacagtcctatactccctttacatatttaccacaagacaatgagg

SEQ ID NO: 503892 - DNA, 870 bp, Homo sapiens
ctacttctctggcatatgctatctcctctcttcagtttcctttttttttgtaccattggccgaaagatggaaaaacagtctgacctgaaagaaagaagactgcaatcaagtgagagctaaacaaaagaaaacctaaactaatgtcattggaaacaaaagcttgaaagaaacacatcgcatctacatttgtaacatgagaaggaaaacaatttttttttttttttttttggaaacggagtcctcgcctctttcgcccaggcttggatttgcaggggccgcaatcctcggcctccacgtgtaatcctccgccctccggggtccagagggattccttccgtgcctaagcctcccaagtatgctggggactacgggcacacgccaccacacccagataattttgggttcattttaagaaacaggccgggggttcccccatgttacgccaggagggtctccatctcctgacctcgtagatccgaccgctttgtcctccaaagtgcggggataacaggcatagagccatggggcgcggccagataagcttcaaggggtcccttcttggcttaagccttcctgacaaacggtctatctgggccacgtcaagacaaggagtaatagcccgcggttatgggttacgtatttaccccaaatagcgctaacaattcaacttccaggtaccctaagttttttacatacagaattcggcattgtgccactaataatttccagattctaataacgccggggtaatccggctaaactctgtcagctcacaatttttacattcaacacaacgttgaaacttaccctgcttggatcaactttcggactgcaatataacgcttataggccggaggtaatgtgtcccca

SEQ ID NO: 503893 - DNA, 595 bp, Homo sapiens
  misc_feature (336)..(336): n is a, c, g, or t
gatgtgcagctgatcaagactggagaccaagtgggagcccagcgaagccacgctgctgaacaagctcaacatctcccccttctcctttgggctggtcatccagcaggtgttcgaccaatggcagcatcctacaaccctgaagtgcttgatatcccagaggaaactctgcattctcgcttcctggagggtgtccgccaatagttgcccagtgtctgtctgcagattggctacacccactgttgcatcagtacccccattctatcatcaacgggtgaccaaacgagtcctggccttgtctgtggaagagcggagttacaccctcgtctccacacattngcctgtagaaaagggtgcaaaggcctctctttggctgagatccacatctgcctttgtggctgctgcccctgtggctgctgccacccaccacagctgctcctgctgctgctgcaagccccacagctaaaggttgaaagccaggaagagtcggaggaatcggacgaggatatgggatttggtctctttgactaatcacccaaaagccacccacttagcccgttttatttgccaaacaaggaaataaaggcttacttcttta

SEQ ID NO: 503894 - DNA, 728 bp, Homo sapiens
cgcagggggcacccccccggggtaacccagaacaggggtaaaccgggcgccccagagaacccggtgagaagagccgcgccataggccgcccaaaaaagggaaaaaccctgcgcagaaatccaccaccgctgccgggtaaaagaagcgaccctcccaatgagatgagcggacttttgcaaccgatcaaggccaactacggcaaaccctcagcgtcaaatacttcgtggccaatactatatgcctttgcccataagctcaggaaagaagacaaaggatgtctattcgttgtcatttctaacaacactgtactggaggttctaccagaattaataagcagagacaataaagacatccagattgcacagaaaccgtgaaactatctctagtcacagatgacagtgagttctataaatagaaaatctaaaggaatgccaccccccacaaattagaactaattaacaccttcagccaaactgaaggatatagggaccatatactaaaagcaactgtaggctgggggcagtggctcaggcctgtaatctcagcactttgggaggccaaggcaggtggattccttgagttcaggagttcgagaccagcctgaccaacatggtgaaacctcgtctctactaaaaataccaaaacttgctgggcgtagtgagctgagatctcgccactgcactccagcctgggcggggcaacgcaagcgagactctgtccataaaaaa

SEQ ID NO: 503895 - DNA, 349 bp, Homo sapiens
atacagctaggagtctgcatctaggatacatccatgcctctgtgtggcttgatggctcacttctctatttaatcactgaatattattccatcgtacggatgtaccatatctgttcacccactgaaagacatttggttttcggcgattaggaataaagctgctataaacatttgtgtgcatgtttttgtggggacatacatttttaaatcagttgggtaaatatctaggagtatgactgctggattgtatatcagactatgtttagctttgtaagaaactgccaaactttcttccagagtgtctgtagcattttgcattcccagctgcaatgaacaagagctccttctgc

SEQ ID NO: 503896 - DNA, 859 bp, Homo sapiens
gcccccaccacctatgcctcctggggctgcatggacatggacccccatcggctaggaaccccagggcaggacatcctggtcatggacactcacatcctcacccattcccaccgggttgggatgccccatccaggatgtctcagatgcagcttgcacaccatggccctcatggcttaggacatccccacgctggtaccccgctaggctctgggggccagccatcccgcccgagcacccattctggtaatgcctcatcgctggagctcctccattgtgggctatgccctccccgagggctctccattcggatctcccatgtggttcactcgcaggtcctatgtcctccgtcgatggtatgcgtggagctcctccagtgatgcgggcccatgcatactgtcggccctcctatgagccccctgccctaatggactcaccgctgcgtgcgccctgctcccatgcacatgctggaccccacttgccacgcgttgtcacccagtctacccgcttgcgggggcctcccgcggtcgagcagtcgcgggaacaaccgttggtgaagtcgacccattgggcagaatcggctaccgattctcgctagatggtccttgtggacgcagcctgtgactggatccccataggtgtccctgcttctgaccgtgagtcccgcgtatctcctagctagtcatacaatccccaactgcagggctcccgtcgacactgagtcatctggactgggaaggacccgtctttctgggctgggtgtgaccacgcagggttctgggccaggccccatgggagaagcagcaaaagccggtcttcacatcctgccagcccaacagtcagcttcttgctccctagcccc

SEQ ID NO: 503897 - DNA, 343 bp, Homo sapiens
ccaactttccagataaagtattgtaattatatacagactttgatccggtaatttccattctcccttgtctcaatagtcagatgtttaagcagtgatttatataacagataaaatatatacatagaatatatcattcaatactttaagtgttcacaaactttgtaatcgtttatttctcaaagcaacagtgtgttagattatatggatgaggagactaaggcatatcctgtcaaggcaacatagttttggaatcaggcttataacactttccaggccagctacagtcattttagtcactacgctactttgcttcaattctactcatcacagtgtctctatatag

SEQ ID NO: 503898 - DNA, 155 bp, Homo sapiens
ccattaagtcctgtgacgggtaacagaatggaaacaggcctatcaaaaataatcacgtacagagaaaacgtactcagcactacaattgggcaatggccctctgatcttgaattccagctaccagaaattcaaggacagcagccggctcccccaca

SEQ ID NO: 503899 - DNA, 217 bp, Homo sapiens
ttcccttttttttccccaattttctcctggtttttgggcccccaaggaaaaaggggggggggccccaaaaccaaaccaagcccccccctttttttcccccccccggggggttttttggaaggcctggggccccctaagggaaaggccatttaaggtttttttttttttttttccagggaaaagggggtccaaaaaaattttctggttttggctttta

SEQ ID NO: 503900 - DNA, 134 bp, Homo sapiens
cgcactcgacactaccccccagcaggtcctccgactcccactatagtgtgtgtgtgtgtgtgtgtgtgtgttggggcaatgtgcaaaatcagcatgtggcacacccatcagtttccttcagcaccaagcagtca

SEQ ID NO: 503901 - DNA, 976 bp, Homo sapiens
  misc_feature (728)..(728): n is a, c, g, or t
ggcgtcccccacatggaatctgtcattacaaacaggacgggattcatttgcctggaacctctaaaaaaatggctacaggagaaacgttatcgccaagagaccttgctatctagatataggcgcccatcaaaatatacgtaactatctgttaaatatgaaaatataggaaaatttattagttaatctgagatgggcctaagacggggttttttggctgttttttgaccaatttgaattcaggtttaaattcctactcgctccagctcgtcctagcaaacgagcacatgtgcagagaagccagctgaatatgagcactcgtatttccaacgactcaacatatgctgagtgcgatatcgagatctgtgcgcaaccttcgaccggaccccatcaatacataaatcgtattcttcgtctcaaacaggcacccatgagtgaaagaaacagccaacgtggttcttacccaattaccatgtggaaaacgacctttactatcttggataacagtcaaagcgtaaaccagagcaggggttagccccctgtcagtaatggcttttcgctgacgcgttgatacttcgatatccaatattgcccaatcagcaacaagacaataggcacgggaaggaaaatgtagggtggcgagcgccacggcatcggcgtcagcgagtgggcacccgtttatcttctcgcctgcggaaagcagtgaggtaaaccctgccaaattcattcgntcctccggccgatctgtaatccgacttgagcgagaaccgtgtatcagcatagctcgcaactgattacctagttccgatgccgacgaatagcaacagggtcatatcccaccttgcttctctactctcgctttaagtcgctgaaggggatgatttctgttggcggcgtcaccgtaccaagtggtttgcgccagtaacccacgctatgccattggccgtgtttgtacccaacctcagggtaagtaccgata

SEQ ID NO: 503902 - DNA, 1213 bp, Homo sapiens
gatctgagaactcagtgttgaggaaacttcaggcaatctcgggaggttacagccgagagcagtaagtctacatgggtgcgtcctagcatgtcatttcttaaacgacatgattgcgtgtaatctgcactcatgttcctcctcgatctcatattcgcgcgattttatgcgctgcataagtctgttacgtcgagcgaacatatccgcatcgttatccggtgattgtcatcgtctcttaggctagcatagggcagcgtgatgcgttgcgcacttagtagagcacgcagggaagctgtttgcatggacaagtgcgaggcaatgtcacttgtgtcatttgcatttcgatggctatctgtgacttctagagtcgtaaacattgtccgtgaggataatttagggctttagcaaaaggttatatcatgcaaggtgctagattgagtttcgatattccccaatgctgtctttatacatcgacaccttgcgcacgatagcatctctgcatattgctcgcaaatatctaaatttaattggtatcgaagttgaatgcttggactatgcattcctgcgtcctggcgccacacattggaatctggcgtcgcaacgccttggcaaggaacgcgaaaaatgcgcgaggcgaaatatggggtggcgtgcaacaaccatggtaccttgggaaactccaacgtctacaacagtcgtaagcagcgtcaattaattctatgggacgtccgagtgggataaaactggccccttaagaattaacggagtgcctttggaactaatatggcacgtcggtgtgcacactctttttccggccttacctctgggatatattacgattccacatccccgttcgctctcctctgcaaatttaatagcaaccttttccacgcaaggaaggacccccaacataaatcaagtggcatatacttacactttcttgacccagcgacgcatatgcgtggcgccagcactgggtatcaagccatcggcacttttcatgttggcaagacaatttggacgtttggctcacacataatcacaatttgacgggccgagtccggccacttctgtcttaaaaaattacacccctcggtggacttccaacaaccagagcgggcagggctggctttgcaagcacgaacaaggcagtttttatcgcaagtcgcagtaccttgcacaaccgcaatagccacgtatcaggtcgaattcggac

SEQ ID NO: 503903 - DNA, 338 bp, Homo sapiens
  misc_feature (47)..(47): n is a, c, g, or t
  misc_feature (136)..(136): n is a, c, g, or t
  misc_feature (146)..(146): n is a, c, g, or t
  misc_feature (161)..(161): n is a, c, g, or t
  misc_feature (277)..(277): n is a, c, g, or t
  misc_feature (293)..(293): n is a, c, g, or t
  misc_feature (309)..(310): n is a, c, g, or t
  misc_feature (318)..(319): n is a, c, g, or t
  misc_feature (323)..(323): n is a, c, g, or t
  misc_feature (326)..(326): n is a, c, g, or t
ttcaacattaatcaaaaaattcctccatctacaaaaatcaacctatnccattaaatacaaccaaaatcataaaatacaaatttcattatttctacttaatcttgaaattcattcactaaaatacacaaggaaaaanaaaaattttncccttttaaaaaatnttttttattttttaaaaaaacttcttaaaacctcaaacatcttttatttttctaatatcctttacaaagttattttatacaatctatactgattcaactaaaatttaacaagcagntggctggcactagtcnccgctcggggtagcanngtattatnnttcnaantacagtttaacc

SEQ ID NO: 503904 - DNA, 112 bp, Homo sapiens
acacacaacgggaaagaagaggggttaacgggaaaagaaccagaagcccaagcttgaccgaaagaagaagaaaaaggcggctgccctgctcctgaggaggagatggatgaat

SEQ ID NO: 503905 - DNA, 431 bp, Homo sapiens
  misc_feature (420)..(420): n is a, c, g, or t
ggacaagcaccttttgtattcacacactttactatacatatcacagtcatcaaattacatacttttataattacaggttaatgtaaaagattaaaatcttgaaactataaagtatatcattctttctttctgttcccagcacttagcatagtatctaacccagtatatctcaaactggctgtacattagaatcatccaggaagctttatgaaaaatactgatccccaaatactaccacaaaccaactgcatcaaaatctctggaaggtggacccaaataccagtatgttttcaaagcttctccttgactctaatgtgtaaccaggttgagaaccaatggtttaaatcagagcaggtgctcaatacatgtttactggatggatggagggaggaagagagaaagggagaatgatgaaggcangatctagaagg

SEQ ID NO: 503906 - DNA, 389 bp, Homo sapiens
  misc_feature (39)..(39): n is a, c, g, or t
cctaaggcaggactcctaatcctgattgtgggtcaaaanacccgattcccagaggggtccttataggaaggcatgcccacacagagaggcccaagaaaagtctgaggctgggcaacagatgtcacgccctgtaatccccagcacttagggaggccaaggcgggcagatcacgaggtcagaagttcgagaccaccctggccaatatggtgaaaccccatctctactgaaaatacaaaaagattagctgggcatggtgacatgtgcctgtggtcccagctattcgggaggctgaggcaggagaatggcgtgaacccgggaggcagaggttgcagagagccgagattgtgccactgccctccagcctggacgacagagcaagactctgtctc

SEQ ID NO: 503907 - DNA, 339 bp, Homo sapiens
taccatcaagccatgtagccttgtgcagatcacttcagcatactgaaactttagtacgttatgctataaaatggggacgaagactcgcccaagctgcctcaggggtatactgcaattaaggaaggttacttagaccataatcatcagaagaacttaggaactcgattgaaatgcacattcttcagccacatactagacttacaggatcagaaactctgatgactgagggtagcacattgtgtagtaccaagccctccaaccgaagctgatgcaagcttaagaatggtgccaaggtcacgtgaaaccccctgtacaactacaaagaggtactgacatgag

SEQ ID NO: 503908 - DNA, 269 bp, Homo sapiens
ccgcactgccctcctgacgggacagacgcctggcacccactaccagctggatgtgcagctctaccactagggagctcctgggcccggcctcgccccctgcacacgtgattgtgggccccagtgcgccttcagccctccgacagctatacgcgctgaggcgtcttagactccgagatacagctgacatggaagcacccggaggctctgcctgggccaatatccaagtacgaggatggatgtgcacgtggctgagggtgcaggagacccac

SEQ ID NO: 503909 - DNA, 122 bp, Homo sapiens
taggctaatgcactcggtcacttcacgtttgtcatgtcattacctgtgtatacttctctccagaactgttttaaaaagcaaggtggggccggctttggtggctcacacctgtaatcccagcg

SEQ ID NO: 503910 - DNA, 256 bp, Homo sapiens
caggccagggggggattttaaaggaatttttatattaatggatttgttttaatgtgaaaaccaaaaaaaaaagcccgggttttttcccgtccaaccaggaaacccctttggaaaaaaaccccgagttccggttgggggcttaaaccgggttttgttatcccccaaaaaccgaaaatgttaaaatcccccggttgggtttgggtttagaaagggctttttttcctcccccttaaaaaaggggggtttgggtttttta

SEQ ID NO: 503911 - DNA, 403 bp, Homo sapiens
tttttccccggagtataaaagagaaaagtcatccttccttaccatgggcatatatgggcaaaagtgggttgtccttctctcttcgtcaatgttcctaaaacctgaaaaagccaaggaaatatttagttggcaaagttccagagaattttcctaagtgtatatggatgaattttgtcctggtcaacatgatgcagagatcacacactttatttttatttttattttcactttcactatttattacagcagggaaatatgtaagtatcagtgtttgaggtgatatttctcctactgaaataccaagtactatagaggaacacaaatacaagtttaaatcaatgcttataccagtaactagtaacaacaacaataacaaaatctctgcaaaaggggatttcaacca

SEQ ID NO: 503912 - DNA, 1073 bp, Homo sapiens
gatcggggtggctgcaggggcgtgagcggcggccgccatgaacaacagctccactcgcgccggacacagggagcagcgagcacgcgtatcccgcaatccgataccatcggacaggattcgtaccgcctcagtgccgaagcaggggagatctcatggaaacgatgggcatacagaacatgttaatggaaatggtactgaaggagcccatggatactgacgttcgtgcagttatcacgattctaggaaaattttcatgactattgcttgatgctggtgttaccagagaaagttgctgaaaaagtagatgaaatttacgttgaagggctaggttgcacatagtgactgtaagatgaaagagctattgaagactttaaaagaacttcgaggtgatgacggtgcacttggcaggtcgtgcaagacgcttttcatacgacagctgagtgctctctcaatgttcagagacaatagagatgcctggtagatggtgggaagtccactgcaaggactgtcacaggctagcagaaggagaataacgacacgggaccaaaggtacgcagcatgtcgtagtgagaaggagccacgatgacgggcgaaacaaattacagggtctaactctctgtgaaaacgaaaccatggctaaggcagcaagcatggaattagtggaactcacatgcgaaccagaagggaacacgctcactgggacagagaatcgacgctgccgagcaattccacagtgaagaatatccacggctgcagacaggtcctatccttggagaagggctaacgtaagagcaagtgaactctacggcgggggcggaacacaggcacctgccccactcacggatcgcactccctaacattacggaaggaggagaatgcacaagcccgctgccggcacccagtggcactccgtgcaacggaacacacaggcgtggccaatgccagaccaatggggggcacaacactgtaccgcgcgcgcaaaacccgagagggcggaacaccgcggacgtgtccagccacgggggtcacatcacagacacgtgcacgggtgtacaccgccggattaagattcc

SEQ ID NO: 503913 - DNA, 225 bp, Homo sapiens
ccattgagcgatgaacctgggaggcagagcttgcagtaagccgagatcacaccactgcactccagcctgagtgacagaacaagactccgtctcaaaaaaaaaaaaaaaaaaaaaaaaaaaatttccccaagggggggggttttttgggcccggggttttgaacgcccccttagacaagatgggagtggcccctaatatggacccctcttcttctttttaaaaacc

SEQ ID NO: 503914 - DNA, 180 bp, Homo sapiens
catggatttgctggtgcagtacaactaggcttaatagggacatggtggtgtgcacctgtaatcccagctacttgggaggctgaggcaggagaatcacttgaaccgcggaggcggaggttgcagtgccgagatcaagacactgtgctccagtctgggcaacaagagcgaaactccgtctca

SEQ ID NO: 503915 - DNA, 450 bp, Homo sapiens
aagacaataaatatccccaacgctttctcttaatcatgtagaagaagatcgagaggttaaagtattatggggaagaatgatttacagcttagacacatcaagagacctgaggggcgcaagccgagcgacgtggcgcacaagagcatcggggctagctggtggttcggctagcagaagcagaacggtctgagcctgggccatagcacgtgtcgggaagaggtcttcgtggaggcctcgtcaggcacagaggacattgacagtctagaagatgctgtgcgtgccccgggctctgtatgaggagctgctgagcaactaccagcagtaacaggaatgagatgcgccacctccagcaggagctggagcggactcggaggcagctggtacaacaggccaagatgctcaagaagtacggggcacttgtgtctgaaatgcaggagctccgtgacctta

SEQ ID NO: 503916 - DNA, 573 bp, Homo sapiens
ggccgggcgcggtggctcacgcctgtaatcccagctctcagggaggctaagaggcgggaggatagcttgagcccaggagttcgagacctgcctgggcaatatagcgagaccccgttctccaaaaaaaaaaaaaaaaaaaaaaaaaaaaagtgtggggggcgcgaccgggccccggaaaagattttaaacaccaagcggggggggcgcgcgggggccccaaggggacagggaaccggggccaaaacgcgggtcccaaaggaaaacccggggcaagacacaaagggcgggggtttctccacccaattaaaaaacgcgccgggggggcacacccggagcggttctggacaaaatctccaaagggagccgggaggagacaaaaaacggggggacctcctatctcacacgagggaggcccaaagcggaaaagccccaagaattctccaaaatttaccgcccgcggaccgggggggaagcaccaaataaccaataacagaacacaaccacaacacacacacacacaccagacacacaaaaaaacaaaaaaacaaacaccctacacacaaaaacaaaagc

SEQ ID NO: 503917 - DNA, 290 bp, Homo sapiens
ggctgatcaaagcgtatgctatatcaagaaaactggaaaaggacataagcagatctataaccaatagcacagctaacagtagacccccgtgtcaccctgaaggctggtggtaccctgctagtacagtgtaggctctctcatatggaaaatggtggatgcaagatacaaggaaatacgagaagagtacagagggctcaaggtaccaggtaggcagaaggatatagctaacccaaactacaactagaagcgggcccatacactaatatgctagagcatatccagcaaatcca

SEQ ID NO: 503918 - DNA, 218 bp, Homo sapiens
ggtcaggcactgaagcctggtcaggcactgaagcctttaccctgggcctggtggtgtactgagtgctttggggctgttaactcctttaatcctggctggtgcagtggctcacacctgtaatctaagaactttgggaggccgaggcaggaggatcgattgagcccaggagttccagaccagcatgggcaacacagaggcttcagtgctgaccagggggt

SEQ ID NO: 503919 - DNA, 538 bp, Homo sapiens
tggatgtcatttggtgtaagggcccaaactgctgcaaacagaggggtgatagcgcctaagcttagtgtaaagttgggattagggggctatttctgctagggggtgaaagcggatgataaaaaaatcccggctacaactatagtgctggagtggagtagggctgagacggggggggggccttctatggctgaggggagtcaggggtggagacctaatggggctgattggcctgctgctgctaggaggaggcctagtagtggggtgaggctggataagcgttagaagggctattggtgggggtctcatgagtcgagtgtaggaaaaatcagcgctagggcgaggatgacaaccgatatcgccagatagggtggaaacataggatcgctcgaagagctgcggtgtggcgcatctgcacgggcgtatcaaccaaccggactgcgcaagaagcgactataagtcctcacgccctctcagccgatgaaccagctgagcacataggtggcacgcggaacctaacgatagcatcggaacaggacga

SEQ ID NO: 503920 - DNA, 265 bp, Homo sapiens
gatcttgccttgtaaatgtcatcttcctgaaaagaactaggacctttcagaaaaaatggctgattccaggctggcagagcacatgatgagtcctggagcatgttttgcctacacagtgacgagggcatgtcacagaacacagagtcagcctgaagggcttcatccacccatcagaagcaatttggctcgtgataactgacaaaacgaaaggatatgacttgtttataaaataggaatacaaaatacacacaggtgtagatataca

SEQ ID NO: 503921 - DNA, 419 bp, Homo sapiens
  misc_feature (1)..(1): n is a, c, g, or t
nagattgaatgattctgcccttgggcagagctcccaattagggaggattaggtaagctttttgtggcgatgggtaataccattcttttcctcattgtgcctgttttttgtttggatattttttcccctacgttaagtgaggctgaagctggacaatgtgattttcagccctagcttgacgtgtctgacctgctcccaggaagatgaaggatgtacgtcatctttgcattgcattgcatggtacacaaactgtacatggtcttcctgccttccatggcagaaaaggcggcaaagggttataaacactggggaatgggaatcaagtttttcagtggtttctggagtaagaacttcattttataatagatttctgtatacacttgagcaaggtgtgttagcaattaggagttttgcaaaaaa

SEQ ID NO: 503922 - DNA, 826 bp, Homo sapiens
cctcacctgccatccaccttcaactacaaccctgctcagcaagcttcctaaaaaaaaaaaaaaaaaaaaaacaaaaagagattctccctttttcttggggggattggggcgggtctcctccacgcccaacatcacttcaacattacactcttggcgagaactacggttggtggcgctcaggcgccccttggggtttaaattccctttggagggactctggcgcacattggggttaccgcaaaaggtgtccccaattaggagggctccgtggcgatacctcaaacttatttctggtgtgcgtggcgccaaccaacctttaagatttgagctgcactacgaggtgttgctcttcaatagaggtttttggagccgacgggcgtcatgagaacttttctccacactttataaagtcccccctattatagtgggcgcaacgacggcagaaccagggactattgcggagctcttggtgaccacgacaaacgaggccaaatatcacccctgtggagccagagaacagttctccccaacgagaatgtgtccataaaacgagtggtcagacaatcgaaagaaagccccccccaaaagagaaactccccgaccgacagatgtctagaccacgccacgaaatcttttgtgcaccgtgggcactcattgcggtgcgccaccatctcgggggacagacacaccactgtacacaccaacagtctgttggtgaggccaacctcataccgagcgtgcaaaagaacacacctcaacctacgcggatactctccgccgattgggggacaaaacgttatctggtcacacaaacgaaggcgtcttg

SEQ ID NO: 503923 - DNA, 167 bp, Homo sapiens
tttttttcaaaaaaaaaaatgggggagggtaaaactattttccaggggtttggtggggaaaacggtttttaacaaaagggttaagggttcttgggccaattttgaaaggttcccccgggaaaaaaggggggttaaccgggatcaataaatcccttgggataatttta

SEQ ID NO: 503924 - DNA, 154 bp, Homo sapiens
ttcactttctctctctcttgctcccactctctaacgtggatgaactgggctttccccttgccttctgccatgattgtacacttcctgaggccttacccagaagctgaacagatgcctggcaccatgcttcctatacagacctcacagaaccgtg

SEQ ID NO: 503925 - DNA, 985 bp, Homo sapiens
gggccgggggcctggtgggcctgggatggggaaccgcggtggttccgcgggaggttacggcagtggatccggggccggggtctgcggccgtgacggggcgggccgagcgggaagtcgcgaaggaacgcgccgggtaaggagtggttgcccgtcaccaaaggtttgggccggtttgctcaaggacctctgaagatcactttccttggaggagatctattctctttcttcgcttgcccaattaggggaactcagagatcaatgatttcttccgtggggggcctctcctcagggatgagggtttggaagattatgccgagtgcagaacaaagaccccggttgcggccagcgcaccaggttcaggcattggtcgctatcggggcactaccatgtgggccaccgtcgactctggggtgtaaaggttgcctccaagagaggtgtgacaccgggcaattcgcggttggggccaatacaatccgtgggcccaaagtcttctccaattcgtcccccctggtggcgacaggagggactacacgtgcgcgagacacaagaatcgggaaaaggcccaaatttggtcccttgcaaggttgagacagggccggctacgggcttctgtgcttgggtacgcctcaatcctatgcacccaagagccagtgggtgtctgtctccgcacgtgttgccttaaaaaggctgcaccatgatgggcaggacttcgatggcttgtaacacctccagccggggcgtgcactgcaacccgttgggaatttcgtcaaggcccacttgattgcatttttaagacctagaggtacttacccccgactttggagggactttttcaccaggtcccctataggagtcactgcacttgtaagaccacaccaagtttcgtgcggggacagctccgatgggcacacacggttttaccacacacaagtgcttcggtggaaaaaatcatcatatattatagaagaaagggggggatacaggg

SEQ ID NO: 503926 - DNA, 265 bp, Homo sapiens
ttgctgggggctacaagtcaccaccgtgctgcaacgtaataggatgcaccagccacacatagaagtcgtgttgctgctgtttacttcccaagtttcgtcttcagtttacagggcttgaggaaagcatagcttagatatcagtgatttccaattaggacacaggacacaaaaaaggaaaaaattgacgacaccgtactttgggtgtactactacgttttagaaaccaactttttttctctatagaagagggagtctgggctcttgt

SEQ ID NO: 503927 - DNA, 1323 bp, Homo sapiens
gcaggcgtgtgccaccacacccagtaattttatttctcatatgtagatacaaaaggatattcttaaaatttttatagagacagggtcttgctgtgttacccaggactggtctcacactcctggcctcaagtgaccctcctgtctcagacctcccaaagtgctaggattataggcgtgaaccaccacgcccagctggttcctgacggaagtcagtgtgggaatacttttttattatatatatacggagtctcgcatctgtcacccaggctggagtgcaggtggcacagatctcggatcactgcaagcctccatctacacacaggtacacgaccataaacatacccgcactacaacctacccagagaaaagctgggaataacaggtaacccacacaacaacgccacagctaataatcaggctcggacgtcatataaaagcaacagaagaacggcgaatatacagacatggtgctataagacacaacgagaggcgacggaggcacaccaacacaagcacacaatatgcggaaaccagtgcacgtgagcacaccagagcagcactcaccacaaaaggagtcagagaacaaaacagaacgcaccagcaagccaaccgagacgagcaccaacacccaaacagaagcgaaaaataacacagaggcatagacgaaaaaatagccaagagaagccccaccgaaatacagcaaaacacacgcaagaacaaaaacgcaaaacacaacaggagagcaaagcaagaacaaaaaaaagcgaagccaaagcaatgaaccagagatgcagaacaaaggaagcgaactcacgagaccacaaagcggacgaagcataacccgacaggataacacacaacaaagagaaaacacagatacgaacatagagcaacacagacacaacaacaaccaggaggaagaacgaataacacataacagagaacccaaacacccaggaaaacgccacgacccacacaatcaaaacaaaagacgaacaagccaatcgagcataaagcagacccaggggcgatgagtgagcagagagacacaaggaaactgagcaaaaggcgaaacagaaagcaggtgcgagactgtatacctaatgtaaccgaagcccccgcagctacgacagagagggacagcaaggagcgagccgagtagatccacaacctcacaaccggacagtaaaaagcataagcactgatcggccaacgacacgcaggagcagacacaataaagaaagaaagggagaagaaggagagagaacaaaagacaaacaaagagaaaaacataagccaggacgaaggtctaaaatgacgaat

SEQ ID NO: 503928 - DNA, 440 bp, Homo sapiens
  misc_feature (13)..(13): n is a, c, g, or t
  misc_feature (44)..(44): n is a, c, g, or t
  misc_feature (46)..(46): n is a, c, g, or t
  misc_feature (70)..(70): n is a, c, g, or t
  misc_feature (75)..(75): n is a, c, g, or t
  misc_feature (97)..(97): n is a, c, g, or t
  misc_feature (106)..(107): n is a, c, g, or t
gggggtcccaaanggccccatcaagggggaaaaataatcactgngnaatggatggcacacattaaaggcnctggngacaaataaggatcctcagaangctccttannaggttttatcctgaacatatttccctttttccagaatagggcctttttgtgctccctagcatcactttgcagattacaaaaaaacagtgtttcccaaacagctcaatcaaaagccacatttaagtcagtgagatgaatgcacactttacaaatcagtatctcaaaaagcgtctgtcttgattttttccaaagatatttcctttaacaccataggcttcaatgtgctcccaaatattctgttgtagattctacaaaagcaatgtttccaaactctcaatcaaaaaataggtttaactctgtgagctgaatgcacagctcacaaagcagttcctc

SEQ ID NO: 503929 - DNA, 404 bp, Homo sapiens
ggctgtgtctagaggaccccgagggtgcttcaagatgaggaagttactacggagtaggtttatgaaaatagagtttccttttaggaaaatggtctagattcagaaatgtcgtctagaacaagcatttaaaaagaactaataaataatcataaatcaggaatacattaaaataaaattacagtacatcatcgctcctagaacattcaccatacaagacgatcctttcaaaggttcataaatgaaagtcttcttgactcgaaatcgtgtcctgcgtcgtgatggagagtatacagaatactaagaagagtcgcaagttttcagtagggtgatgtccaaactacttgatctggtgcggggcggagagactgtctagcttcggatccaagtgaagactatctatcttc

SEQ ID NO: 503930 - DNA, 284 bp, Homo sapiens
tcacaggattatgttagcagcgcagcacatccatcccgtaagtggaataaggctgttgtccttgcagtggatctgatttggacacagcagcaatttgtaagtgtacccgttccttattgaaaccaagccaaacccaacctgagccttggacaccaacagatgcagccgtcagcttctccttaaacttgtcacaggaaccaaagtcacgtatgatggcttcagcaacatcccttgggttctccaccaccgttagggatgatgtatgccagacaaatgctactgat

SEQ ID NO: 503931 - DNA, 394 bp, Homo sapiens
  misc_feature (394)..(394): n is a, c, g, or t
ggtcaggggagacctccaggcgcacggaaggacggccagagtgacacggaagcatgcgacgggtgctgatccctctgtccctgtggctgtgtgcgcggggcgtgggcgtcgccgagctcacggaagcccaacgccggggcctgcaagtggccctggaggaatttcacaagcacccgcccgcgcagtgggcctttcacagagacacaagtggagagcgccgtggacacaccctttccagatggaatatttgtgagggtggaatttaagctgcagcagacaagctggcgcaagagggactggaagaaacccgagtgcgaaggcaggcccaatgggaggaaacggaaatggctgggctggattactgggctctgaggcggtctgggccgcgtggtcn

SEQ ID NO: 503932 - DNA, 177 bp, Homo sapiens
  misc_feature (44)..(46): n is a, c, g, or t
gcgtcctccctagcaaatcaatattggaccctttttgttgaagnnngggtctctgttgggtgtgatttttttcccaggtgtgttccctttttcctcccctagttgttccttaagttcctccctccacagggatacattctattttgggcttgtatgtttaattaatagttagaatag

SEQ ID NO: 503933 - DNA, 112 bp, Homo sapiens
ccggcccggattaactgcttatagagcctgactacatcttctaagtcagtcacatagatatatgccagaatgggatgagaatgtgagctataattttgagaaactgaactcc

SEQ ID NO: 503934 - DNA, 416 bp, Homo sapiens
  misc_feature (12)..(12): n is a, c, g, or t
  misc_feature (46)..(46): n is a, c, g, or t
  misc_feature (307)..(307): n is a, c, g, or t
  misc_feature (403)..(404): n is a, c, g, or t
  misc_feature (408)..(408): n is a, c, g, or t
ctggaaagcctncctacacatgttgaactgcctgacgggaaaaganccccagtagataaatcctaggctttcccactcccatatattagctgaggcaggagaattgccttgaatctgggagacggaggttgccgtgagcccaagatcacgtcactgcactccagcctgggcaacagagcaagctccgtctcaaataaataaataaataaactaataactaaatgttgtaacacaaaagaggatgaatgcttaaggtgatggatatcctgtttaccctgatgtgattattacaaattgcatgtctgtnccaaaatatctcatgtacccgataaatatatatacctactatataccgacaaagttaaaaatagaaactggaagacaaaaaataaataaaaaatannattnagcttctc

SEQ ID NO: 503935 - DNA, 101 bp, Homo sapiens
cagggaactgtgggatgttcacacaaccagtcatgttcccacttccatcctgtaactaactgtgccaaaccagggctgggagtgaacttgttttgaaggac

SEQ ID NO: 503936 - DNA, 551 bp, Homo sapiens
  misc_feature (386)..(386): n is a, c, g, or t
gtgaatggcaagatcctgtcaccccagttgggggttgttattagggccctgggccaaacccttcccccccgagggtgctcaaggtcctggggacccccaaaaatgatgaaataaatgtgaaggggggggcctttaggcccttttttccccttttccaaacagtggccaaaaacaagggcccgggccccttttgggttttttttcaaggactttgggggttttccaaaaaaaaaaaaggcccccccctggggggttaaatccggcctgtttttttccccctggggggaaaaattcccaaggaaaaaataaaaattttgggggccgggccttaggccccccatggttgtttcccctataaaaaggttgccccccaggggtttaaaggntgggggccttccccgtttccccaaaggcggggcccttccccgggggaattttgtttttaccccaaagtttccccagggttttttttttcaccccctttcccctttttttttttttgggtaatttttcccggcccccttcccccaaaaaactttctttttgggcca

SEQ ID NO: 503937 - DNA, 274 bp, Homo sapiens
atgcatcttagactgtcataaggataggtcatgctgaaatagatctgagcatatagagtcccaggactcagaaggcctggacaaatagaactaagatagaggcagaggcaggaagctgcgggtctatctggtacagcgtttagcatcactgtaagagtgtgtgtctgagattaaattaaactagaagcagcaggtgcgtatttggtaagtacttctgtgactcggctcaattcccactgggcagggggcttctcaactgcacggtgcatcaaga

SEQ ID NO: 503938 - DNA, 374 bp, Homo sapiens
gtaatctacgagatgcttcacagtatagaagagagatgtgtctaggttatatacacacatgctatgccgcttgtatatcatgccaacatcagtctccagggaaggtcttggaaccaatcccccatggatactgagggattactgtagttctttacttaagactgatctgcctgaggacacagaaagctattttccttttctacttttctctttcacaatggtctcttccgtcccactctagaaaataaagccctctatcacatccatctgcaatcttactataaagaaaactgaagcagagagattaggaaatgtactcagtcacccagttaacaatagatgaagcctaggaatcaatacttaggctgcaacaa

SEQ ID NO: 503939 - DNA, 207 bp, Homo sapiens
  misc_feature (18)..(18): n is a, c, g, or t
tgtgttcatgcatagagntcatctcaggtgggatatggttggatgtttgtcccctccaaatctcatgttcaaagtgtgacattcagtgttagaggtgggcctagtaggaggtatttgggtcatgggggcggatcccttatgtatgacttggtgccatccccatagtaatgagtgagttctcactctggtggtttatgcatgaacaca

SEQ ID NO: 503940 - DNA, 318 bp, Homo sapiens
attgattctttctgtgactcatcagttccttctccgtgttatattcatgttttgctgtacatttgtgaatagaaccagcagcttgtagaaaccactttaatcatatccaggagtttgcaagaaacaggtgctttacactaattcacctcctgaacaacaaaaatgggctgtgaccggaactgtccgctcatcgcaggggctgtcattggtgctgtcctgactgtgtaagcccgtatgctaatgccagttggagacctgcttatccagaagacaattaaaaagcaagttgtcttcgaagaaggtacaattgcttttaaa

SEQ ID NO: 503941 - DNA, 713 bp, Homo sapiens
  misc_feature (89)..(89): n is a, c, g, or t
  misc_feature (93)..(94): n is a, c, g, or t
  misc_feature (330)..(330): n is a, c, g, or t
  misc_feature (332)..(332): n is a, c, g, or t
  misc_feature (340)..(340): n is a, c, g, or t
  misc_feature (399)..(399): n is a, c, g, or t
  misc_feature (403)..(403): n is a, c, g, or t
  misc_feature (436)..(436): n is a, c, g, or t
  misc_feature (464)..(465): n is a, c, g, or t
  misc_feature (497)..(497): n is a, c, g, or t
  misc_feature (505)..(505): n is a, c, g, or t
  misc_feature (510)..(510): n is a, c, g, or t
  misc_feature (527)..(527): n is a, c, g, or t
  misc_feature (532)..(532): n is a, c, g, or t
  misc_feature (537)..(537): n is a, c, g, or t
  misc_feature (539)..(539): n is a, c, g, or t
  misc_feature (541)..(541): n is a, c, g, or t
  misc_feature (544)..(544): n is a, c, g, or t
  misc_feature (546)..(546): n is a, c, g, or t
  misc_feature (549)..(549): n is a, c, g, or t
  misc_feature (556)..(556): n is a, c, g, or t
  misc_feature (568)..(568): n is a, c, g, or t
  misc_feature (571)..(571): n is a, c, g, or t
  misc_feature (578)..(578): n is a, c, g, or t
  misc_feature (596)..(596): n is a, c, g, or t
  misc_feature (637)..(637): n is a, c, g, or t
  misc_feature (649)..(649): n is a, c, g, or t
agtggagagagaacgaggtgctgggagggatagagggggtctgcctggcccccagctgtgggtacagagaggtcaagcccaggaggacngccnngtgcagactggaggggacgctggtagagatggaggaggaggcaattgggatggcgctaggcatacaagtaggggttgtgggtgaccagttgcacttggcctctggattgtgggaattaaggaagtgactcatcctcttgaagatgctgaaacaggagagaaaggggatgtatccatgggggcatgggcatgactttgtcccatttctaaaggcctcttccttgctgtgtcataccngnccgacccngacctctgagcccctgggtactgctgcttcattaaccccagataagccactgccacacntctnaccctactccaccccatagctgaccagctgctntttccctaaaccaaggtgacctcttgcnntcccttcttactcacacacaaaatgtacccantattctangtatnccctattttacaattanctgangcacnancnaantnaanacactgnctcatattcctncancctggangccaggtgctcaaggctnacacatccaccccatacacccactctactttaactgagcanactggtaaacanacttgtgggatctgtacccatatatgggactggtatggcccctttcgtttctctcttccctctg

SEQ ID NO: 503942 - DNA, 150 bp, Homo sapiens
gaaggcactagtctagggaatggagggagaagggataccttacaaccccacgatcaccatattaccttggtgcgctctatccagaaatattttgaggcataggacaggcacactatagtcatactagtatctagtacctatgcttatcta

SEQ ID NO: 503943 - DNA, 103 bp, Homo sapiens
  misc_feature (10)..(10): n is a, c, g, or t
cagcctcctncgtctttctcgcttggatcttggcactgagtaggcggtggccgtcgggtatcggagaaaagtaggaatgaatcctgcccaatgaggtccggta

SEQ ID NO: 503944 - DNA, 689 bp, Homo sapiens
atgggatgttccagccgactggccccccttgttcccgtatttcccgagagcgcgcccgattttcgtgccccttttgcctctagccaggttcccccgttatataggatgaccactctcccgagacgtgggaggccgactccaggcccctgtaggtttattcccacccgagattagtgccccttctggggccttgagcttgagcttgggctttagagcttgggctccagcttttgacccctccaggccatcttccctgttccccttccctgtcgttcctcctccccttcgtcctctgctgccagccatgatttttttgaatcttccaggaccacctcccatattttccatggccacccagagcttacacctctctggtgccccgaccacaccttcacagagccacacttcactggcgctccctcttggccctctgggtggacacttggccaacctcgtgggctttgcccaaatgttgaccccggttcacaccaggggattttttttttttagccatgataatccctcgttctgggtcactcttttaaggcttggtgagaccgccccccccagagcttataattttaaaagtattttcctttgtttaagactgctgcttcctctgtttcattggattgtgcccgttatccatggctcttgggttccaagtaataaagaattcccaaactgga

SEQ ID NO: 503945 - DNA, 392 bp, Homo sapiens
agaggacaataatccaattctctgtaactttattgtctgaaactttgacttatttatgtttccaagggtctcctgatgtatggaaactcattatacaaaacttacttttacaaaatgaaagatcagggaattactctgtttttgttactctcttggccaattcatacatttttgtaaaaaagttttttaaaatcatgttcagggtcatatagggattaaaagtttaaggtttgaaatctggggggccctaaatttgacccacggcatcgccttttttggctgcaaagtttttgtcaggatccttaaccagtttgcttttgtttgctcattgggaagggggtcatgggggggatttgcacccaagcaaactccacaaagcatccccttaagcg

SEQ ID NO: 503946 - DNA, 1208 bp, Homo sapiens
ggcaaaattcagacttgagtatgtctttgaataccttaagaagttacaattagccgggcatggtggcccgtgcctgtagtcccagctacttgagaggctgaggcaggagaatcacttcaacccaggaggtggaggttacagtgagcagagatcgtgccactgcaattccaagcctgggtgacaagagagacttgtctccaaaaaaaaagttacacctaggtgtgaactttgggcacaaaggagtgacaaacttatagttaaaagctgaataaccttcagtggtggtactaaaacgtgggttccacaggctatgctcgtgatcggctgaaaagaattctagtttacctcaaaatccttctctttccccaaattaagtgcctggcacagctgtcataacattacatattccttagggttacattcacacaggttacctgttcacagacgtgacacaactacgatgttctgtctgaaggctaccatgccggatctggtaaatgaacctgttaacattgctgtatttgctccaagcggttactatcgaactgttacttaactaccaatattgctacttttttacaaattttaacctaatagggcagtggcactacgggtaaaagttagcccccacttcttagaggggccactgtttaagctcttcaccaattcctttaactggcttgaactcattggcaagaccttgcacgcacggctgagccaaccccttcgcacaattcgcggagacgtaaacacatcccagaccgggcgcgcgaaacaacttgggcaactatcaagcaggaagcacacatggggccaacccacaacacaaagggggccgcgcctgagaaccccggcactaatcacaagcgcgacagcaacagatcggggcgcaccgagaagagaacatcatagcggtgccagcaacaccaaaaacaagagcagccacacagcgtgcacggggggtaggtagtgttggtgtgaagagcatcgcatccagggcccgacggcagcgaaactaaacacacacgaacccagcacacctagacagattgaagcgaggaggcacagacgacacacaaaacaacaacgcacgccaagagcactagcagcagctaggacggacgaacaacacgagccgaccaccgcaaacaacccacacaacaccaacacaacgacgacgaaacaagtacacacaacagcgcacgcac

SEQ ID NO: 503947 - DNA, 1098 bp, Homo sapiens
  misc_feature (73)..(73): n is a, c, g, or t
  misc_feature (84)..(84): n is a, c, g, or t
  misc_feature (198)..(198): n is a, c, g, or t
  misc_feature (217)..(217): n is a, c, g, or t
  misc_feature (283)..(283): n is a, c, g, or t
  misc_feature (286)..(286): n is a, c, g, or t
  misc_feature (303)..(303): n is a, c, g, or t
  misc_feature (311)..(311): n is a, c, g, or t
  misc_feature (353)..(353): n is a, c, g, or t
  misc_feature (391)..(391): n is a, c, g, or t
  misc_feature (435)..(435): n is a, c, g, or t
  misc_feature (438)..(438): n is a, c, g, or t
  misc_feature (452)..(452): n is a, c, g, or t
  misc_feature (457)..(457): n is a, c, g, or t
  misc_feature (500)..(501): n is a, c, g, or t
  misc_feature (509)..(509): n is a, c, g, or t
  misc_feature (515)..(515): n is a, c, g, or t
  misc_feature (528)..(528): n is a, c, g, or t
  misc_feature (544)..(544): n is a, c, g, or t
  misc_feature (550)..(550): n is a, c, g, or t
  misc_feature (584)..(584): n is a, c, g, or t
  misc_feature (594)..(594): n is a, c, g, or t
  misc_feature (610)..(610): n is a, c, g, or t
  misc_feature (619)..(619): n is a, c, g, or t
  misc_feature (647)..(647): n is a, c, g, or t
gagcggagcgcatggacctgtgaggcgtgcgaactggtggcagtgagagacttcggcggacatggctcccagngtgccagcggncagaacccgagtatcctaaaggcatccgggccgtgctgcgtggggcctcccggggccggtaaagggacccaggcacccagattggcgtgaaaacttctgtgtctgccatttagnctactggggacatgctgangggccatggtggcttctggctcagagctaggaaaaaagctgaaggcaaactatggatgctgggaanacntggtgagtgatgacaantggtagtnggagctcattgagaagaatttggagacccccttgtgcgaaanatggttgcttctggatggcttccctcggactgtggagngcaggcagaaaatgctcgatgacctcatggagcaacgaggacanganaagcttgatctgtnattgnattcagatcccagactctctgctgatccgaagaatcacaggannggctgatncacccnaagagtggccgtncctaccacgaggagtncaaccntccaaaagagcccatgacacagatgacatcaccnggggaacccnttgatccgtcgatcangatgactanatgagaaggccttgaaaaatccgcctgnaagcctaccacactcaaaccacccactcatagagtactacaggaaacgggggatccactccgccatcgatgcatcccagagccccgatgtcgtgttcgcaagcatactaggcagcttctccaaaggcccattcctagtatcagaagggcaggcgagactggaagactgttcatcaacccggggagtgatccctggtctaacgtgctgggcagaagggcacggggggcaagcggacgcgaagtcaagaacggctggcgacgggggcccagggaaaccggggacccaccgcacgcgacggcgaagcgggacgacacaccacacaccgcacactcaacgtgagcggaacaacccacaccaacacccgctcagagcgcggcaaccacacgcacacctcgcaacaggaaaacggcggggcagaaagtagcacgcgcgcacgccatgcacgcctaca

SEQ ID NO: 503948 - DNA, 705 bp, Homo sapiens
ggggaatagaagggatgaggaaacattaataatagttattcaaaagacccaaatgcttatacttctctctcccttcttctctctctgacacacacacacacacacacacacacacacacacagcgtgcactattcctcccttatagtgctcatgtgtgccttaaagtgtgccttataggtaaatccagggatgagtgagggaatccctcgtcacgtgggagattgtgtatatattcttatattatgagattgagtgggtgtggggaaaaatttttcctcggtgagagggctcaaaaatgtggtttcctaaagagtgagccactatcagatgtgcacactcagggagaaagagaatataggggttaacgtccaattaggaaatctcccatgtgtgcagggagtgcagtcatatcaaaaaaacaagccagccagggattaaagggtattataaactcctcatagcggaactatttctcagggcaagaggaaccgtggctcatgtgaaagatgagtgtcccatgcctgtgtgggtcaaagcggtcagcacttaacagggggaaaaaactaggtgtggtggtgggttattggggagcaatataaaattcaggaatgtttatagagcctgggtctctagaaggaggggaataatattctggagcattactagggtgggcggggtggcaagtaattaagtctccaggttat

SEQ ID NO: 503949 - DNA, 1148 bp, Homo sapiens
  misc_feature (73)..(73): n is a, c, g, or t
  misc_feature (84)..(84): n is a, c, g, or t
  misc_feature (198)..(198): n is a, c, g, or t
  misc_feature (217)..(217): n is a, c, g, or t
  misc_feature (283)..(283): n is a, c, g, or t
  misc_feature (286)..(286): n is a, c, g, or t
  misc_feature (303)..(303): n is a, c, g, or t
  misc_feature (311)..(311): n is a, c, g, or t
  misc_feature (353)..(353): n is a, c, g, or t
  misc_feature (391)..(391): n is a, c, g, or t
  misc_feature (634)..(634): n is a, c, g, or t
  misc_feature (644)..(644): n is a, c, g, or t
  misc_feature (660)..(660): n is a, c, g, or t
  misc_feature (669)..(669): n is a, c, g, or t
  misc_feature (697)..(697): n is a, c, g, or t
gagcggagcgcatggacctgtgaggcgtgcgaactggtggcagtgagagacttcggcggacatggctcccagngtgccagcggncagaacccgagtatcctaaaggcatccgggccgtgctgcgtggggcctcccggggccggtaaagggacccaggcacccagattggcgtgaaaacttctgtgtctgccatttagnctactggggacatgctgangggccatggtggcttctggctcagagctaggaaaaaagctgaaggcaaactatggatgctgggaanacntggtgagtgatgacaantggtagtnggagctcattgagaagaatttggagacccccttgtgcgaaanatggttgcttctggatggcttccctcggactgtggagngcaggcagaaaatgctcgatgacctcatggagcaacgaggacagatgagaacggcgttgagtatctgtgagtcgagattgcaggcagtcgcccagaaactcctgcgtgactggaatcccggaagcaattcatgagggagagggtcggattcagcacactcaaggagttggcgcggtttccgtagccaccggaggaagcttcaagggcctctgaaaagagcccatgacacagatgacatcaccnggggaacccnttgatccgtcgatcangatgactanatgagaaggccttgaaaaatccgcctgnaagcctaccacactcaaaccacccactcatagagtactacaggaaacgggggatccactccgccatcgatgcatcccagagccccgatgtcgtgttcgcaagcatactaggcagcttctccaaaggcccattcctagtatcagaagggcaggcgagactggaagactgttcatcaacccggggagtgatccctggtctaacgtgctgggcagaagggcacggggggcaagcggacgcgaagtcaagaacggctggcgacgggggcccagggaaaccggggacccaccgcacgcgacggcgaagcgggacgacacaccacacaccgcacactcaacgtgagcggaacaacccacaccaacacccgctcagagcgcggcaaccacacgcacacctcgcaacaggaaaacggcggggcagaaagtagcacgcgcgcacgccatgcacgcctaca

SEQ ID NO: 503950 - DNA, 868 bp, Homo sapiens
gctgccttattgctgtaacccggcttgtcgagatgtcgaaccgaggacgtgatgcgtcctctggtgcgaaatgccggcattccttgggtctcccgagtaggagactgtatatctaaatggttgctgatgaacaacaggaagcacaataggaacactgttatatgatcatcctgtggaaggggatctaagggacgggtgaagagtacatgtccaacgtgttgcttggtgtggtatgatgaatggatggagtggacggagtcatggaaaggccaatgcaagtagctgagaatgaatggtacatacaaactagatgtggtcattcggacagaggaaaaggtcaatatcaggatgaaagaattatggcggtgtttcgttaatggtatgaacgatgagtgtcatggagtcagtatgtgaacaaattaagagggtgatgatgaacaggttctgggcagtatgacaagggaccagtatggaaaagggagtgtggaagatgatgtggggcccggaatatgctttactaggtggatgggtgcagttgccactgaattctccggtagtattgttgaaatgagtagcaaaaaggtgatgacccgattcaaaaatgtattttgtaatgctacgtacaaaaactggtatatttgcctcataactttgtttggtaaccttatcctgtccacagggtgcttccttaactggtctaaaagagtatgcctgtatcgtaactcaggctttcattcctccaagtttttttcccatgaatcttctggcatgatcgtaagcgttatttcccaaaatgataacgtagctgtcagttggtttcgccatattaacgctctgcatctgcttaacggtgccagggacatggtcg

SEQ ID NO: 503951 - DNA, 1193 bp, Homo sapiens
  misc_feature (1)..(1): n is a, c, g, or t
  misc_feature (8)..(8): n is a, c, g, or t
  misc_feature (10)..(10): n is a, c, g, or t
  misc_feature (623)..(623): n is a, c, g, or t
ncctctcncngcttgtcaacgtgaagaaagaaagcaatgactgacagaatagcggaagcgttagtgcgatttgtgtgactgcctctgcgcttgttttctcgtgttgatctcttcgcgcgagtgatcttcttgttgctttacgtctgctgcacgtgtggctttctggggcatatttactgtgatctcctcccatatctcgtgatcctgcccccccctgcgctctgctcacacatcgaagcttttgtgcacacaaccaaagaccggtgttatttggcacgcgggcacaatgctcccccccggctttaaaattctttcgcgaggaccccccaccccgtggcgactcttcccggtttagacttttggaaagccttgtaaaataataaagttgcttgggttctagaagtgcccccccttagaggacgacctggttaaaccatctagttctcgctgtgttagtgtcccctttgcttgaggactagggtgtgccggtgtgcctaccgttttcatcacgggaatccccccaaggtgtccacaaactttttgtttaccagagatgtgaccttccgaagtgaacccgagtccgtaattggtccccgaaaggaactctggctgtagactggccnctttgacactaggaaagtatttcccttggaaaccctttctggaaaattctccacgaggactggaccccctacccaaaccttgtgtttgccctccactaaccccaaggcttcacggttagaaatttagaaaaatagaaatggttgggtaccctgatctaaaatgtttaaatgctaaaaggtatatcgtaaagggtaatgtcttgtttttgaaccgagtaaatttatgaagtttctcactatggaaggcgtattaacactaggtcttcacgaaacctatttaaagaattttcaataatagtattataaatccactagacttaaatctgagaattttttaacactaatgccagtcacgcccaacacttagctatccccaatataagagccactgtgttctggctgttttatacttccaccattttttccctaaagtggtaagccattactttgtaaacatatttttataaaacatcggtatcgggaggctgccggtggctccggcccggttgtcctggcacaacaaaggaggcgaggctatgcgtttcgaggcccacctaggccaaattggga

SEQ ID NO: 503952 - DNA, 824 bp, Homo sapiens
  misc_feature (41)..(41): n is a, c, g, or t
  misc_feature (61)..(61): n is a, c, g, or t
  misc_feature (82)..(82): n is a, c, g, or t
  misc_feature (193)..(193): n is a, c, g, or t
  misc_feature (228)..(228): n is a, c, g, or t
  misc_feature (237)..(237): n is a, c, g, or t
  misc_feature (240)..(240): n is a, c, g, or t
  misc_feature (265)..(265): n is a, c, g, or t
  misc_feature (385)..(385): n is a, c, g, or t
  misc_feature (452)..(452): n is a, c, g, or t
  misc_feature (507)..(507): n is a, c, g, or t
  misc_feature (509)..(509): n is a, c, g, or t
  misc_feature (525)..(525): n is a, c, g, or t
  misc_feature (562)..(562): n is a, c, g, or t
  misc_feature (564)..(564): n is a, c, g, or t
  misc_feature (582)..(582): n is a, c, g, or t
  misc_feature (584)..(584): n is a, c, g, or t
  misc_feature (588)..(588): n is a, c, g, or t
  misc_feature (618)..(618): n is a, c, g, or t
  misc_feature (670)..(670): n is a, c, g, or t
  misc_feature (672)..(672): n is a, c, g, or t
  misc_feature (674)..(674): n is a, c, g, or t
  misc_feature (701)..(701): n is a, c, g, or t
  misc_feature (703)..(703): n is a, c, g, or t
  misc_feature (717)..(717): n is a, c, g, or t
  misc_feature (721)..(721): n is a, c, g, or t
  misc_feature (724)..(724): n is a, c, g, or t
  misc_feature (729)..(729): n is a, c, g, or t
  misc_feature (735)..(735): n is a, c, g, or t
  misc_feature (751)..(751): n is a, c, g, or t
  misc_feature (819)..(819): n is a, c, g, or t
tcatcaacaaccaacacagcaacacaaatgccacagccagntcctcacggcaacctttttngaagtcaagagcaaggccctnaatgagccacctacatggaacatagtatttgcaatatgcaaatggagacctaaaggctcatgaagggaacagaaggtggctgtttacagaggaacagaaacgaagtgaagntaatgggaagttcaatcaacaattggcaacaagcnaggtcagtngtntacgaaagtggtcatctatacagtncctaagtgtgggttctgggcctggatcatgttagatagggagccaagtctgggtgccatgaataaaaactgccatcccagccctctggaaaactgtggtgagatgtgatctcttaaagcnatggccttgaaaccagcctgggtaacaaaaccaagcccttgtatctaaaaaacaaaagggcaggaanattccagaaaaataatgttgcaggaagggggtaataaaatacagaaatgtgatananagcaaaacctcaactnctgtttcattggctcccagttttttaatctgtttttncnaaaactttaaggtacatntnaaanaccccccaaacccagaaagctttttaacanctaggttgttcaagaacttggaaaattcaccttctgatgttctccaagaaanantncattttttatacaccttatttgctcananctgttaattcagcntggngtnaacanagaaanctagttttcctcaaantcctcttgggctttagaaaaaaggtgctggccctttgagccaagcaggttattggttagtagttcctnttaac

SEQ ID NO: 503953 - DNA, 310 bp, Homo sapiens
taattattgatactccacacaaagcaaaacctaatataccaggcaagaatagctatgcttagataaaatagactatatccaaaactgtaaaaagagacaaagaaaatcattatataatgataaagagatcaattcaaaaggctaaaacaactgtaaatatatatgcaccgaacaccagagcaccaaaataaataaagccaatattcttatatttcaaggggctctcacacctgtaatcccagcactttgggaggccaaagtgggaggaatgcttgagcccaggagtttgagaccagcctgcgcaacataa

SEQ ID NO: 503954 - DNA, 338 bp, Homo sapiens
atctgtttctattacataatcttggcatattacatttcataataaacacatacatttagttgcatgctacatcactattgcttttataattaatttcttaagcttcaaccatgtattataccttatttcgttacatcatatattcgtaatgtgtacatatgaaatcttttgctttacatgtctttttttcaaaatgtagacatgtactaaacttgcaacggcaattgaatgtagtatgatgaaaatgtgaatgttttgctgctgtcatgaccaaagatacagagctagtggacatttaggaataataattacagctagagtcttgtatgtcttctctt

SEQ ID NO: 503955 - DNA, 609 bp, Homo sapiens
aacctgggaggtggaggttgtagtgagcctaagggaggagaccacccctcatattgtcttatgcccaatttctgcctccaaagaaagaaaaagtaaaaactaaaaggcagaaatgaaatccacaagcagacagcccggggccacaccctggacctggtagttaaagatggacccctgacctaattggttatgttatctatggattccagacattgtatagaaaagcactgtgaaaatccctatcctgttttgttacgacctaattaccggtgcatgcagcccccagtcacgtaccccctgcttgctcaatcgatcacgaccctctcacgcacacccccttagagttgtgagcccttaaaagggacagaaattgctcactcggggagctcggcttttgagacaggagttttgccgatgcccccaccgaaataaaccctttcttctttaactcgagtctgagagttttgtttgtggctcgtcttattcaagccaaaaaggtgccattggacttcagcctgggcaacaagaacaaaactttattttttaaaaaaattatatattatataaactttgggggggcccggacccaattcccctttgggggtgttt

SEQ ID NO: 503956 - DNA, 1916 bp, Homo sapiens
  misc_feature (380)..(380): n is a, c, g, or t
  misc_feature (1478)..(1478): n is a, c, g, or t
  misc_feature (1618)..(1618): n is a, c, g, or t
gcccttctctcagtgtgccctaagccaagtactcgttctcatttgggtgtctgcactgttggaagctactgcactgtgtttccacgcagacagagtacagtgggaaaggctttctccagctgatggatggctgtctctttatttggagtatcttactggttatgtaagcgacctcgagagaaattatcctgacccagatcggaggatgcagtagtgcttcagctgcaggatttcttagtcgttaacaccacagtgctgatgacaaagagcgagttgtaatcctcatcactgccagggctgagccagagcagacagaaaatcgtcatttgctcgttggagacttgttaggttacagctcctgcttcgttctgtggtctggnttttcttcctatacaatgacgccgctgcaagtgagctcagaaatgcttggtttgagagccatttgcctgtgatttttgaagactaaagaagtatttacactagatactcttccagaacaaaatagaaatttcagcaaatacttactgacctttaaagccttgttgtggatttctgagatttaaagatactttaaaattctcaagaacaaaactttcaaacctctggttgaaagaaatatacccagttcagtcactgcagtagaattccttgtagataagcaactggattttttaactgaagatagtgcctttcagccctaccaggacgacatagacagcctaaacccagttctcagggacaacccgcagcttcatgaggaagtgaaagtctgggtaaaggaacaaaaggttcaggagatttttatgcaaggtccttattccttaaatggatacagagtgagagtatatagacaagactctgccacccagtggtttactggcataattactcatcatgatctcttcacccgcaccatgatcgttatgaatgatcaggtactagaaccacagaatgtcgatccttctatggttcaaatgacctttctagatgatgttgttcactctttgttaaaaggtgaaaatattggcattacatcacgacgcaggtctcgtgccaatcaaaacgtcaacgctgttcacagccattatacacgtgcccaagcaaatagtcccagaccagcaatgaactcccaagctgctgtaccaaaacagaatacacaccagcaacagcaacaaagaagtatccgtccaaataagaggaagggctcagatagcagtataccagatgaagagaagatgaaggaggaaaaatatgattatatatcacgaggagaaaatcctaaaggtaaaaacaaacacttgatgaataaaagaaggaaacctgaggaggatgaaaagaaactaaatatgaaaagacttcgaactgacaatgtttcagacttttctgagagcagtgactcagaaaattcaaataagagaataatagataattcctcagaacagaagccagagaatgaattgaaaaataaaaatacttcnaaaataaatggagaagaaggaaaaccccataataatgagaaggcaggagaagagaccctaaaaaatagccagcctccctgggatcaaatacaggaagataaaaaacatgaagaagcagagaagcggaagtctgttgacantcagcttcaagaagatatgattattcattcgtcagaacagtccacagtttctgatcataattctaatgatttacttcctcaggaatgcaatatggataaaacacatacctggaattgctaccaaaggagaaggtatccagaccacccacaccaaaatgtgttattgatattacaaatgacactaatttagaaaaggtggctcaggaaaactcaagtacctttggccttcagacacttcagaaaatggatcctaatgttagtgattcaaaacactctattgcaaatgcaaaattcttgg

SEQ ID NO: 503957 - DNA, 139 bp, Homo sapiens
aaaacagttcacctgtaaatactttttcctttttcaccgttgtattatacatgtatatgctgggtcctttttcagaaactcttttcttacctgagagttgtcttgttttctgggctgtttttaactgaggaaaaaaaaa

SEQ ID NO: 503958 - DNA, 1190 bp, Homo sapiens
cgggtttgccgtcagaacacaggtgtcgtgaaaactacccctaaaagccaatagatggtgaaatggaaaagagctcatatcaacgatgtcgtcatggtgacacggtagattcggggcgaagatccgaccactactggccatctgcatcgtataagatgccggtggcatcggacacatagagcaaccgattgcacaacacatttgcagcaaggaggctgctgagatgggaaagggctccttcaagtatgcctgggtcttggatagactgaacagctgagcgtgaagcgtggtatcgaccattgatatctccttgtggaagattggagaccagacaagtagctatgtgactatgcattgatagcgccaggagcacaggagacgtgttatcgaaaaacgatgattacagggacatctcaggctgtactgtgctgtcctggatagtagctagtggtgtaggtcgaattgtgaagctggtatctccgaagaatgggcagagcacgagagcatgccctctcgtggcttacaacaactgggtgtgaaacagactaagtagtcggtgtagaacaaaagggattcactgagccaccctacagccagaagagatatgaggaaatggttagggaagtcagcggttacattaagagaataggatagaaacacgacgatagaagcatggtgcaaattctggtggcatggggacaacatgttggagacaaggtggctaagaatgcacttggtacaagggaactgcaccgtcagcacggcaaagagatgcgaagccaagaggaaacaaggatgagatgagcgcactgcacctggcatacaaacaacaaccagcacccctgcagaacgccactgtgcctgacctcacaggcatgatcaccacatggaggactaggggcaaggccaccaggtggacacgagaggaacacgtggcgcccaaagaccgggagggtgccagcatggacaacgccacgggacacacgggcaacaacaatggtagaagaacgagagaagcaacagaacagaggaccaaaggacaacgagaaaaacgcccaggaccaccgcgagcacgagagaacaagaagacagacaccagaccaaagaaaccacaggccacagcacaacgaacgcatagatcggaaagacgaaaccgaacgggaggacacgaccgacacccgccaagagcc

SEQ ID NO: 503959 - DNA, 88 bp, Homo sapiens
tggaaatgatttttcctatttcctttgttcccacttgtggtgtttataaaaacccctctttaaaaaccaaataaattgggttcctttt

SEQ ID NO: 503960 - DNA, 725 bp, Homo sapiens
gaggttccttaagttggtcttagaagttgcttagtcatgtctggccgtggtaaaggtggaaaaggttgtggcgtaatgggagtgagctaacgccgtcatcgcaaggtttagcgcgataacatccagggcatcactacagaccagctatccggctgccttgctcgtcgcagcggtgtcaagcgaatttctgtgccttatctatgaggagactcgctggtgttactcgaaggtgttcctggataacgtgattcgtgacgctgtcactttacacatgagcacggccatactgctaagaccgtgtacagcaatggattgtggtctacgcgctgaagcgactagggacgctactctttacgcgcttcggtggctaaggctccctgcttgctgctcgtcttattctgcagttgtgtcataccataaggcccttttcagggtccgcctcgacgtttcttcattataagagccagtacgatcttgtttatcctgctttgtttccagatttgtcgctgatggaagtatgtctacttgtgcacatgttgtagattggcaaagtctgtggctcctgatggatctgagcaagatggccgttgtgaggaatgcacgaatctgtcttgattatttccgaactgatgtccagtctgctatggaagattgctgcctatatggtcgatcgttgcagacgttaaagtcctagaccaaagccttgttttccatactcagagacc

SEQ ID NO: 503961 - DNA, 620 bp, Homo sapiens
aggatgtcgtagacggagatcctggacgtgcggatggatgtagccacctctgagctccatgggaactcctggcgatcttcccagatcttcagagttaaggtctgagccatcttccccctgctcttcctcctccctcagctccgagtcatagcgtttctcggcagagccatccagcgaggctcttggggtaggggaggtgctccatgtgaagacagagtccttggcacccccactgtgtctcctgggagatgacccaacatcctcatttgaaaccgtccagatcaacgttatccccacctctgatgattcctcagatgtccagaccaagatagaacctgtctctccatgttcttccgtcaactctgaggcctccctgctctcagccgactcctccagccaggcttttataggagaggaggtcctggaagtgaagacagagtccctgtccccttcaggatgcctcctgtgggatgtcccagccccctcacttggagctgtccagatcagcatgggcccatcccttgatggctcctcaggcaaagccctgcccacccggaaagcgccactgcaagcccaaaactgtagtgctaaccactgttccaatgccatcagagctgcgt

SEQ ID NO: 503962 - DNA, 226 bp, Homo sapiens
  misc_feature (72)..(72): n is a, c, g, or t
  misc_feature (78)..(79): n is a, c, g, or t
  misc_feature (85)..(85): n is a, c, g, or t
  misc_feature (111)..(111): n is a, c, g, or t
  misc_feature (202)..(203): n is a, c, g, or t
  misc_feature (208)..(210): n is a, c, g, or t
  misc_feature (212)..(212): n is a, c, g, or t
  misc_feature (214)..(214): n is a, c, g, or t
aacctcagatacattctcagcgcccccgccatcgtctctcgtcttattggtctactcggaatacgtactaanagcttnntgtcanacacactctgaagaatcctgtaagcncctgaattaagcagaaagtcttcatggcttttctggtcttcggctgctcagggttcatctgaagattcgaatgaaaagaaatgcatgttcnntgccnnncncnctttgccgaccc

SEQ ID NO: 503963 - DNA, 324 bp, Homo sapiens
gggatcccctgcaaagtgaatgatgagaggtttagtagtctgttttaaattaaagttgtaatccggaacacatgatccgaacagagctatgttaacaatattacagggacatctctcccttcatttactttgtcttgctataagcctatatttaggtttctttactatttttttctcccatttggatccttatgaggtaaaaaaaacataatgtcttcagcctcataataaaggaaagtttaatttaaccaaaaaaaagcaaagagccattttgtcctgtttacttgggttccatcagagtcctattttttaacctttatccat

SEQ ID NO: 503964 - DNA, 327 bp, Homo sapiens
  misc_feature (18)..(18): n is a, c, g, or t
  misc_feature (56)..(56): n is a, c, g, or t
  misc_feature (66)..(66): n is a, c, g, or t
  misc_feature (322)..(322): n is a, c, g, or t
tcgcaggcaggtgctccntactagaaaaagtaaggggccacagctgggcgcagtgncttgccctgntaatcccagcattttgggaggccaagatgggcggatcacttgaggtcaggagtttgagaccagccttgccaagatggtgaaacctgtctctacaaaaaatacaaaaattagcctggtgtggtggtgcacacctgtaatcccaggctacttgagaggttgaggcaggagaatcactttaacttagggaggcagaggttgcagtgacacaagattgcaccacttgcactcccagcctggggtgacaaagttgaaattnttcaa

SEQ ID NO: 503965 - DNA, 384 bp, Homo sapiens
gagactcagtcttactctgtcgcccaggctggagtgcagtggcacagtcttggctcactgtgatctccgcctcccaggttcaagcgattctcctgcctcagcttcccgagtagctgggattacagggacctgccacctcgccgggctaatttttgtactttagtagagatggggtttcaccatgttggccaggctgttcttgaactcctgacctctcaggtgatccacccaccttggcctcccaaaatgctgggattacaggcatgagcgactgcgcctggcccagaactttttcatcttcccaaatcgtaactccatgcccattaaataataactcccaggcgaggcacaatggttcaagcccatgtcgacgcggccgcgaat

SEQ ID NO: 503966 - DNA, 827 bp, Homo sapiens
gggcggggggatgtcacaatggcttgaccatggtatggccagctcagagtaccttacagttctgatgtttaaaattacattcttttttttctttaaaaaaaaaaaaaaaaaacggggtttcactctggtcacacaggctggaagtatagtgggcatggtcatgggctcgctgggggccttaaacttccgtggggctcaagcagtccttggcctggagtaccagcgactacttacggtggcaccaccacatccagctaatttttaaaaatatatttgggtagagaagagatctctctatgtggcctaggtggccctcaaactccggagctcaaggcggatcatccttcccttggcctcccacattggtggggctttacaacctggtggagccactctggctgggccctttattcttttacattttttaatttttgtaaaaaatcaccaaagatagagggaaaacccaaagtggaatacgaccgggacaatcaatctgaactgtgtgtcaagtgcgtaatacgactatgtacacgggaccacacacaacaacaggtggggggctagacatttagaaataagaaggccaggcacgcgggctcaactccgcgtcatccaagccattgggcaggcgatgcagaaggggtacttggacgcgggtttcaagaccaagcgggcgcaatatggtgagccacagtcttgaccccaaaaaaaaatttgaaaataaaacaatggcgggccgggggtgaatgcggatccccagcacccaaaggggggagaggtgtgggccagaggcacagctcggggttagtgcccgtcccataaggatg

SEQ ID NO: 503967 - DNA, 477 bp, Homo sapiens
  misc_feature (14)..(14): n is a, c, g, or t
  misc_feature (65)..(65): n is a, c, g, or t
aaaccctggcccantcacggaactttttgtggtcaatgtcccagtggttagccctaaagaataanaacccggctgggatgaaagcccaccgtggaacagtcgtgcccattagacttttcccccctgcactcgttcaagtgtagatgaccgtatttcttccctttaaaccctggaacccgctttgctggtttgctggcctctgtggtgtcctcacacaacctgaacttaggcttctgcctcagctctttggaaagagggaaagacaatctctcttcctgcgaagtatgggaaggtgcatagaaatgccttttgtggttcttgctgtggttctaagtcacgaaggtattgaacttcattttggccactccggcttcggtgatggccacaaaagtgaagagcggttccattacttttttctttcttctttttttttgagacagcatctcgctctttttcccaggctggagtgaagtggca

SEQ ID NO: 503968 - DNA, 246 bp, Homo sapiens
ttcagtgtacccgtttgtcgagcactgtactccagctgatcactagagcgagagtccgaactgagaagaaagagcaatcgaaaaagcatacgtgtataaccactggtgatgagtaccacaactaaaatagagatggtaatgccctatcatctataggacttttatatactcctgccattttccattttaaatcccatttccatttggttgacaggtgaagaaaacccagtaccgtgatcgaccacg

SEQ ID NO: 503969 - DNA, 105 bp, Homo sapiens
tgtgtcagcgcaatcagcaaatcatccattcgggcttgatgtggggaggggtgtttaaggggttggctagggtataattgtctgggtcgcctaggaggtctggtg

SEQ ID NO: 503970 - DNA, 115 bp, Homo sapiens
cttcccctcaagctatttctatcagtcttcacatttagctgatatcttgcctgttaatcgggatagtcgaaagagaatccttcaggcattaagcctacctacctatccagctgcg

SEQ ID NO: 503971 - DNA, 275 bp, Homo sapiens
gcccgaaataatttactgcccttttacaaaatgtatttaaaaagtttttccagataaactaatcaaataaattagaataatgtgccaccattacaaatttaatttgttagctgcattccttttgatgttcccccgaaaaaatgttactgatgattcagggctatttttgaagtttgtatgttgctgctgtccccagtgatggtggacttatttttcccttccctgatcccaaattatgttggggaaaataaaaatttaatatttttttaaataga

SEQ ID NO: 503972 - DNA, 102 bp, Homo sapiens
  misc_feature (1)..(1): n is a, c, g, or t
  misc_feature (85)..(85): n is a, c, g, or t
nacagtgatgagacgtagaaggccttctacgtctcatcactgcaggttaaggacctgatgtagtctctgtgaggatatgagtttngattcctggcctcgctc

SEQ ID NO: 503973 - DNA, 492 bp, Homo sapiens
  misc_feature (245)..(245): n is a, c, g, or t
tagaacggaagaatgggtgcaatggtggttcctggaaagctcacccagcacagctgccctgagctcgtgggcgttggtttctgtccctggggatattatattcaataaatttttatataattacacagagaactagaaaatataaaatctgaggggttggggaagaaacgtgaggaactcagcaggaagccagagctggagaggtccattcaggccaagtttgacctcctctttgaccccttggncttctggcttctcctccttggtttgctcctcttcggtgagttctttcttctcctcggagtctacctcttttccatcctctgttttgactctcttggctttttggaagtgggaagagtacttgcggaccccctctccctcctcttcagaatcggagaactcttcctcacaggcaattcgttggtcagaggagcagatcgagatgcgctggtcagggtcgtcttcgtcctcatcgccactctcctcagg

SEQ ID NO: 503974 - DNA, 1112 bp, Homo sapiens
gacagacagtcagccgcatcttcttctcgcgtccccagccgagccacatcgctcagacaccatggggaaggtgaagggtcggagtcaagcggattaggtcgtattgggcgccgtggtcgaccagggactgcttttaactctggtagagtggcatattgttagccatcaatgaccccttcattgcacctcaactacatggtttacatgttccaagtatgattccagcccatggcaaattccatggcaaccgtcaaggctgagaacgggaagcgtatgatcatcaatggaaattccatacaccatcttaccaggagcgagatccctccaaaatcaagtggggcgatgctaggcgctgagtacgtacgtggagtccactaggcgtccttcaccaacatggagaaggctggggctcatgagcagggagggagccaaaagggtacatcatctctgaccccactactgctgatagaccccatgtacgtcatggggtgatgaaccatgagaagtatgacaaacagactcacagatcatacagaaatgacatactgaaacaccaactgcattagcaccacctggaccaaggacatccatgacacacttgggtatcgaggaaaggactcatgaaccacagaccatgaacatcactggcgaaccagacagaatggggatgggcacatccgaggaaactgggacgtgaatggcgcagggcatctccagaaccatcatacctgacatctcactggacgctgccaaggctgttaggcaacggtactcccatgcagctgcacgggacagatcaaagagaatggcattcgatgtcccaatgacacggtgacaagggtagacctgacctgcggcaacaaaaccttgcaaaataagtaatcaaaaggggtgaaaaagcattagtagggaccaccaaggagaaactggagaacgagtgagacaaggggacctcatgtagtcacagcgtcacccatgacaacatagaacctgaggagaaagtaactagaccagtcaagtgacagaaagcaagaaggtaccaggtgtgacctacaagccacagaaaccggaaaaccgaaaaaacgagtggacgcaacccaccacagtatgag

SEQ ID NO: 503975 - DNA, 365 bp, Homo sapiens
cgggcggggatcttacgcttcccttacccgcccccttttgtctttcacctcaggccccgccggctgctgtgggagcggcggccgtccctctcctggaggtcgtctcctggcatcctcggggccgcaggaaggaagaggaggagcagccggacctgtggcgcctgagtgagaccgaccggccctttggaatatggcgacgtgctaccggaccagcagcgcctcggcggcagcaccacagacttcctggaggagtggaaggcgaaacgcgagaagatgcgcgccaagcagaaccccccggcccggccacgggagggggcagcacgacgccgctgggacccggcggggctctgggcaccccgcggtcc

SEQ ID NO: 503976 - DNA, 141 bp, Homo sapiens
cgctgttgctgaaccggctgatcgctcgaggcaacctggtgaatgtcaccagcctgttctacttggtgcccgcggtgacggcggtgatggattacctgatctgtcgacgcggccgcgaatttagtagtagtagggggccgc

SEQ ID NO: 503977 - DNA, 232 bp, Homo sapiens
gattctgtccagatctctttgtccctgaggtgtcagtttgcggccgccatcttggtcccttttccaccatttttcagccccctccaggtttgggaggaacccggcggcccaacacctctttggagccctcggctgtaaagtggcctgggcattgaacgcccgtttttccggaaattttccagcctgaagcgcccgggttggtaacccattaaaccagtttgggtgctgggtg

SEQ ID NO: 503978 - DNA, 211 bp, Homo sapiens
aacttttggggtggagactagaggcaggagcttaggggctgattcctgtggttggaaaacttaggccgccccctaaggtggaggtgggggaatagtgtttccccggaagctcctttagttgtgtgcgggtggctgtgcattggggacccatacccctcagttctgtagcatgaaacaaaggcttaggggcccaccaggcttccagctggga

SEQ ID NO: 503979 - DNA, 425 bp, Homo sapiens
ccgggaagggtatgtgaaaggtgaggatatggagtggttgggtaataggttcaaaactgcagcaggaataagttctactgccctatagcactatagggtgactatgattaataatgtcttggatatatgcaaatagctacaagagaggatttttgaatgttgccaacatagcatacaatgataaacgaatgaggagaacagatctgctgagtaccctgattgattgacacattgtatacatgtatatcactattatgagtacgtacagtgatatgacaatcaaaattgaaatatgaatgacaagaacacggctaggtgtagatggcacatgcgtgcccagctaccagagaggctactgagtcatgatctcttgagctcatgagatgttggctcatgagcagcatagggagaccctacatcatgtt

SEQ ID NO: 503980 - DNA, 532 bp, Homo sapiens
tagttgaagggtagtcatcagtgtagataagatctttcagagaaacttttttttggagacagggtctcactctattgcccaggatggagtgcagtggcgtgttgtgatcttggctcactgcaacctctgcctcccaggctcaagtgactctcctgcgtcagcctcctgagtagctgggaccacaggggtactctggctaatttttccacttttggtgcagacggtgtctcgctatgtggcccagggtggtctcaaactccgggccgcaagcaatcctccgtgcttcagcctcccgtaatgctgagattacaagtgtgagccaccacgctgggccttctttctctattctaaaacttttggtggctcttgagtgtaaaatgcagaacctaagttatactatgcctttgcaagggtggttccttagcctagaattacaacaaattgtccttcaagaattacttgtccttcaagcacaatgtaaaacgccatctttcttctgcattcccctgtggtctgagtagcacctacgggt

SEQ ID NO: 503981 - DNA, 356 bp, Homo sapiens
  misc_feature (6)..(6): n is a, c, g, or t
  misc_feature (65)..(65): n is a, c, g, or t
  misc_feature (69)..(70): n is a, c, g, or t
  misc_feature (77)..(78): n is a, c, g, or t
  misc_feature (80)..(80): n is a, c, g, or t
  misc_feature (103)..(103): n is a, c, g, or t
  misc_feature (107)..(108): n is a, c, g, or t
  misc_feature (112)..(112): n is a, c, g, or t
  misc_feature (115)..(115): n is a, c, g, or t
  misc_feature (118)..(118): n is a, c, g, or t
  misc_feature (120)..(122): n is a, c, g, or t
  misc_feature (127)..(127): n is a, c, g, or t
  misc_feature (130)..(134): n is a, c, g, or t
  misc_feature (153)..(154): n is a, c, g, or t
  misc_feature (160)..(161): n is a, c, g, or t
  misc_feature (182)..(184): n is a, c, g, or t
  misc_feature (186)..(187): n is a, c, g, or t
  misc_feature (194)..(194): n is a, c, g, or t
  misc_feature (197)..(197): n is a, c, g, or t
  misc_feature (220)..(220): n is a, c, g, or t
  misc_feature (230)..(230): n is a, c, g, or t
  misc_feature (238)..(238): n is a, c, g, or t
  misc_feature (252)..(252): n is a, c, g, or t
  misc_feature (268)..(268): n is a, c, g, or t
  misc_feature (272)..(272): n is a, c, g, or t
  misc_feature (280)..(280): n is a, c, g, or t
  misc_feature (286)..(289): n is a, c, g, or t
  misc_feature (296)..(296): n is a, c, g, or t
  misc_feature (298)..(298): n is a, c, g, or t
  misc_feature (308)..(308): n is a, c, g, or t
  misc_feature (337)..(337): n is a, c, g, or t
  misc_feature (344)..(344): n is a, c, g, or t
gggggnggggggggggggacaacccctgcaaatggaatgcaaaaatgcccaaggccccggctttnctcnnccccaanngngtctacatatatcagtgataacngtgnnatgnggnagngnnnggggnagnnnnnaaaagaaaaaggaaaaaannacaganntagcaaaaaaaaacaaaaaannngnnagacacntcnccgggggtggcggcgtggggggngacccacagngggccccncgccgggcacccgnaaaccccccccccaangggnaagggggnccgggnnnnggcggcngnggggccgcgngggggcgcccacgggggggggggggcggngccccgngggccccccccc

SEQ ID NO: 503982 - DNA, 600 bp, Homo sapiens
  misc_feature (202)..(202): n is a, c, g, or t
  misc_feature (234)..(234): n is a, c, g, or t
  misc_feature (268)..(268): n is a, c, g, or t
  misc_feature (337)..(337): n is a, c, g, or t
tctgcgcccgtgccatgctcagactggtgcggcgattccgggcatggtggaacttgaccccaaagtgatgatgcaaggcattctgcgggtccaggtccagcgccacacctgactcgcccagtgcgctgcaacccactgctcaaggccgtgaccagcgtgctgcggccacaccgccattgatagacaccaacgccactatttnagggcgcagctccggggcaacgatgggctgtnggtggatactttcgtcaggaacactgccgaaaangtgcattcttgcattgatgccgtcggcatcatgggtaacgtctttaccaaacaacgccagaatttcttngcttaggctcatagcctgctcctcaagacgcagcttaaagacgtgaaggtcagcaagtgcgggcacttgccgcagatctattcaataggcgcccttgtaggggggcattctgtgacaaaggctcgagagtgtcattataaggctgtctttatgcccgattttcacgatggacggacgatagtcaatttaatggcttaccagccgtgtgtattccacagccttgcagctgtgaaacacgagcccaagacacctaatcgaagaaa

SEQ ID NO: 503983 - DNA, 820 bp, Homo sapiens
ggcctcggaggcgtcagcgtgcttcaacgatgaagctgaatatctcctatcccagccactgtgcggccatgaaactcattcgcagtggacgatgaactgcaaagcttcgtacgtttctatgagacgcgtatggccacacgaagttgctgctaggacgctctgggtgaatgaatggaaggggttatgtggtccagagatcagtggtgggaacgactaaactaggtatcccctatgaaggcagcggtgtcttgactccagtggccgtgtcctgcctgctactgagtaacgtgggcacttcctgttatcagaccaatggatgatacttggatgactcgaaatgacgaaaattcagttcgttggttgcatcgtcgtgatgcaacatcttgagcgtttctgcacgcttggcttatgttggaaaaactagggatagagaacggatacttgccctgagtagctgacctgatgacgtagcaggtgtgctcgacgcctagggcgcccaagagatgacgctaagcatacattcgcgcaaagatttatcatagcaaatactcgtgctactagacagctagtgcttgtccggctcagcttattagttgtgacaagacaacaggaccccttcagacacttacattggacatgcgtactggaaaacctctaagggaccccaagtaacgcgactcgccaagaatctcaaggcgtatcctcgctctatcctcctaggcgtcgctcccgtgcaggccaccaaaacgcgtgtcgtgctgctaatttggcctcctgactcgacaggcaggctgtacccacggaaaacaccttacaggaa

SEQ ID NO: 503984 - DNA, 345 bp, Homo sapiens
agaagtaaggtgaaacatattctaatgacccgttaagatgtagaacgcgcctgtttaacatgatttacagcaaaagtgaagaactaatcaaagaaagaaatgatcacaatgcttcattatgaccttctacatcacccgttatgaaccatctggaaataaaaaaggcaaaactgtagggtttggtaccaataattcagagcacattacctatctggaacataatcgcttatgaacaagttgctccaaaagaaagatgctgagaaaaaagggcccaaggactgatattagggtgcagcgagatggaagtggttaaacaaggaatgagccatggagagctctcaagtg

SEQ ID NO: 503985 - DNA, 113 bp, Homo sapiens
  misc_feature (62)..(62): n is a, c, g, or t
  misc_feature (107)..(107): n is a, c, g, or t
cgagatcatgtcccacgaccgcccgcctggacaccacagagaagaagacggagcagcagcgncggcgagtagaaggctgtgcacaggctgcgggtacagcaggccgngttggc

SEQ ID NO: 503986 - DNA, 140 bp, Homo sapiens
tttcttagagggtttcaaaaggacagcctttgcgcggccttttcctttcttaaccttttgagtccagcccttttccagtttttcatttccacttcggagtaacttccacttaaagcttgttctcaaaaatcgggcaacgc

SEQ ID NO: 503987 - DNA, 136 bp, Homo sapiens
caggatcctgaacgggtactgcggttgcggtacgcaaagactcgtgcacttgcactccagcctgggcagcaagaggaaaacaatctctgtcatacacacaaaaaaaaaaacggcacgaaagaacagacatatttgg

SEQ ID NO: 503988 - DNA, 867 bp, Homo sapiens
  misc_feature (1)..(1): n is a, c, g, or t
ntcgttgcgtcgcgccgactagccggagcgctgctgcccgttatggtggtggtgacaccgcacagccgcgtttgttgtgtcgtctcgcccaacctccccccccggcgcgggtgttgggttgtccgcgagcgcgcgcgcaggctattgttcttggtctattggtgtggtctcggcgccccccgggcgcgagggttgagatacaccactgctcgctcagctgggtatatttgtgttttgctcgtcgtcgtcgctcgccggcgcgctccctccgttatgcgcgtggggggcgccgcgctcgcttctcgcgcgctctgtcgctcggtccgattgcaaagatacctctctctgctctcactagacggacatccctctgccatggtctgttctcatgccccctcgctatagttaggatttttggtggggcgagttgttttctgtgctgcgacgctcttcgtcgtatggacgggtgcgccgtttcgttaccaccccccgcctctttgtgtgatgcacctttctctgcggggggagtacatcttctctgttgtgtggcttggtgatgcaacacacacttttcttttgtctcaatatagataattatactcttcttccatattcgagagcggtgctctcacactttctattgtatgtcgtccaccacattttaaatatatccctctgcaatcattattagtcacccacacacaccacaagggggtgtccataacaccccccccaccatgttttcccaaccacatgattaacacctcctttttccaccgcggaggacaccccccttttttttaaccccctccccccttttttcttttttccccccccccccccctctttcccgggttttttttttta

SEQ ID NO: 503989 - DNA, 325 bp, Homo sapiens
  misc_feature (235)..(235): n is a, c, g, or t
tgggacagagtctcgctttgtcacccaggctggagtgcagtggcgcagtctcggctcactgcaacctccgcctcccgggttcacgcaattctcctgcttctgccccctgagttgctgggactacaggtgcctgccagcacgcctggctaatttttgtatttttagtagagatggggtttcaccgtgttagccaggatggtctcaatctcctgacctcgtgatcagcccacctggncgacctaaagtgctgggaattacaggtgtgagccactgcacctgggcctataccattatattactatttgaggtgtccatttctcctgcc

SEQ ID NO: 503990 - DNA, 273 bp, Homo sapiens
acggatagactgcgccgcagacccatggtgtacacggaggatgatggaggcatcgaagctcgtgctcagacacacgccccttgtcaaatttagtgcagacccgcgacgcttacactgagatccttgatgggaaaacacctctggcgtcctgggtgaggtctcctccctcatattctgtcctgtatcccagctccgaccccaagtcttctcacctgaagggccaggcggttcctgccagcaagacgggcattctggaggagtcgatgtgcccgc

SEQ ID NO: 503991 - DNA, 1405 bp, Homo sapiens
ggcacgaggatgggaagatgtgcctacttcccctttgccttccaccgtgactgtacatttcctgaggactccctagccatgctttctgtacagcctgctgaactctctgcccaaatttcagctgtcacagaatgagtgatcctcatagtataatggaaatgcatcatctcagtttccccatggcctgaatgtccatacaaaatgagagccagtagagaaaaacagaggacgtgaggagtttttaaaaattgaggaaaagtggaaggaaaagtaaggatgaaggtgaagatgaaggaatatgtcagagatgctagcactggcatcccccaccacacagtaccatgtactgctaaagaactctagaacatacagggtgtagacggcagtcttcttggggaaaaagaggcttcaggattgcaagatttcagctactgtctctcctcggagcaggattccatcttttccatggctggggcccttgacacatgtcactgtgcactgctcttctcgctgggaaaaggaaactgaggcccagagagggcaagtgaatttcccaagagtgtccagatgatacggagctgagctggaaagtgagcctggatctctctggttctgaaagctttgctcgaaagcacaggatgacacctccattcaaccaataagcactgagacccttccatggactcagcaggtcctgctgtccctgaaggttgacactctcatttcaaaccacagcgagaaccccaaaaggaaacagtgcaaggaaaataatgtgatatttgagaggcagcatgggttattggggacagggttcatgtcccttctctcccacacacgtggcatgatgttaagcgggtcacctcacctctccagggttgtttcctcaactgagaaaatgagggggttgagatgaacgccagccctggggtgctcaatgctgcagtctagggtggtgtggactggaatcagaattctttctcctccgctctgggtgctgacacatgatctctggctctcactccccacccctaatcttgcccatctgagtttcaggttattttttccttcctcctgctcttcaatttccttattgaggaagctctttcctgctgcctctgtccccgctggagctgtttgatccagtagagccagtcgaagccaaggggaccctgacttgaatcttgctttctgacatgctggctgtggcttgcttgggacccgaataagagcttgcttactcccggtgttcaccacagcggaaccatgggtgcagaaatgtaattctcaaccagcccagtttaatcagcgaaagacaatagagcttgcaggcggtgtcatgctgagtatctgaacacaccatggctgctgtcgcccttttcattaaaatgattgaaaatgtatttct

SEQ ID NO: 503992 - DNA, 786 bp, Homo sapiens
gttgctcaactttaattttgcagtcagaattgtgtaagctgaaccagttggaatgtctgtggcgttggctatggtttgtactgttaatcatcagtactcttcaattagggcacaaacaagattttttttttccttgcaaatggatgtagttggtcttctatagtgggcttcatcttcaacatcatctcatcttttcttaaaataaattattcattgtgtaaactgccaatttcttgggggcatgcccccactaacatttgtgtaaagcagcaatgatttcctgattttcccacccaaacttccccataaattgtgatgtctggctttaattttagcagaatggacattgctctgataaggggctcttttcaaactgatttcttatcctttttttgtgcctcaaaatagatcctgtcagacatgttacaaattagtacaagtttatttggatataaagaaaaatggaaatccatgtatagtttttccataatatgtatttcccatgaaaacttttgtgaaattcttcatattggctgagatgatatggcaaaggagttatattatattacaaagttcctgttggtgtgttcatattatgtggcatatgttatatttttcacattatcatggctttctgatacaagttaaccttttatttgacctaactcaatccaacttggaactccctaaatcgggagggagaatactaaggctgttaatttggggctagcaacgccaagagtttaagacgcttcttaaggactcctttgaaagacaacttgaact

SEQ ID NO: 503993 - DNA, 923 bp, Homo sapiens
catcgggggagtcgcctcatgtgaaggttgtccttgcggctgccgtcttcgacggctcctcgtctgactcacagctggtgacgtggagctttactagcgagactgtgtgaccaagaaagaaagaggaccaccaccagtatgactgtccaaaggatatatgtctaggatcttccgagaacttgggtagcatgagatcatggtgaggcccgtgggtgatccagcttggtgggtctctgtcagagtaccacagcagttcccagaggagagtggggacatcaactcgggtctgggccctagaggcttgcctgtgaggagaaacgagtgatggtgggctggaccaggccgcaagtgtaaaggccccctcgccgataaatcctagggagctctgcatggaatctcaggggaggcagggtagaacctttcaaccacgaggagaaaggagtagtgaccgcacgggtcgtgatatacgaggccacttgtacctggccgtcgagcctcttcaccaaggctagcatgaggtctattgtatatgcaggtcacatcaggggtgtgatgggcatggtgccgaggaaatgtgcccatatgccaacaggtaagaaaagcattcaaacgtgtggatcgcgcttattacattcaagtaccagaaggagatgcatgtatagccttcggttaaaggatgagtaaagacagtgttggtagattgagtactcaaagttagggtgcatgagtgcatggctcagtggatagtgagaaggcgtggaagagggccaaagtagaagaaagcgtggggctgaaaatcccctggacagggtgtccattcgtattcatgcattgagtggaggaatcaagggtgtgctaaacgcgttttggcaaaacagatccggggtagtgactcgggttattgtactaaactgacatttggg

SEQ ID NO: 503994 - DNA, 924 bp, Homo sapiens
gcatggaatgcatgaatcctgatccggtatcaaggaatgtcaaaacctgcttagagcaatgcagagggcgttggtatacaggttctagcaggtgtatagtaggatgtgatacaacggaaggccacggagtgctcatcccagggattaacttcctggacttgtgggtgcatcaggaagcattgggaaggtcttcttcgggggaatctcaatggatacttatatcgggccagcacctagctgatgaacatcgaagtcaatccatcgagtcaggtaatcacacatgaaactctgagaaggatcgaggctagattgtattcaaggcagatgctagtgaggtctctggggcgtgggaataagatctctcagctaacaggaatccagcaagattcaggcatgtattcgggacacaaaaaactgggaatcagaggtccagccgtgaaatgtgcgagtttctctggaaatcgctgtcggaacgccacacagttgcgctaaagctcctatagtagacacactagggatggtgtatcatgcgaactgcctagccttagtttagtaactggttgacctgtggtcgtcccactccactacatagcatgcagtatcggtcatcttgaacaaatgtaaattttagtctttcgatagacggttcttagatcttcacaagtacctcgctttatttcactttgagctcttggaatctctgtgctggttgtaagactattgcaatatgatgcgtaacaagggtggacgtacgggtaacgaggtcgtgggtacaactgaatatgctcttcttggaacggggggaattacgggtactggatgcataacgtctgcattttctgacccctttgttacccatcatcgcctattatagctggtgccggattgggctgcatcgacagatttcgctttaagattagccag

SEQ ID NO: 503995 - DNA, 504 bp, Homo sapiens
  misc_feature (368)..(368): n is a, c, g, or t
atttctaatgtctaggcagtcatgtgatcagtctgtgactgtatgtcttctgaattggggatgcttagaaaggcttttagccggctggaagcggtggctcacacctgtaatcccagcactttgggaggttgaggttggtggatcacttgaggttaggagttcgagaccagcctggccaacatggtgaaacaccgtctctactaaaaatacaaaaattagttgggtatggtggcgggtgcctgtggtcccagctacttgggaggctgaggcaggaaaatcactcgaacccaggaggcagaggttgcagtgagctgagatcacaacactgcactccagcctgggcaaacaggaggtgaggaactatgttncgttggaaataaaaacaaaaaataacaaaacaaaaacaaactgtgttgcggccggcccgtgggccctcggaaaaaggttttctaacaccctttcgggtggaggcgccgggggccccatgggctaaggggaaccgtg

SEQ ID NO: 503996 - DNA, 260 bp, Homo sapiens
  misc_feature (230)..(230): n is a, c, g, or t
  misc_feature (232)..(232): n is a, c, g, or t
gggtaaaattaagttcctggaagagcaacttcaacatgaatttcaaacaaaatggaagagattaagatctaaatggccacacatagcattaatctcagaagttcagtagctacagtactcttgtttctgacaagacttatggatgttgtagaacacttgaaaagtgatttacgtaagtgggatgttaagtctgtggagagttacttaaactggacttttgaggagacacnangagagcgctattgaatgacgtgattatt

SEQ ID NO: 503997 - DNA, 175 bp, Homo sapiens
cgacggtctgtaccatatgttgtgtctaatctccgttctgagaaggatgaaaaactttcttccaagtgaagatccattataagaacacatgtattgacatgccgtatatatgctggattgtagtatgctcttgtctttaacagttattaataggaacgttcttaagcaaatacat

SEQ ID NO: 503998 - DNA, 154 bp, Homo sapiens
cactaagacacttgtctctgacttcggaattgagtgtctgtgtcttacacgtgatactgggactgaacggatctgtgcgcgatctcggactgctgcgtgacgtcttgactcttgctcgatgctttctcggcgagggaggggcttctccttttgg

SEQ ID NO: 503999 - DNA, 736 bp, Homo sapiens
  misc_feature (73)..(73): n is a, c, g, or t
gaattacttctactcctctttacagggggaacaaaaggaggatctccggcggggcggccccctctaaaataanatgtatctcccgggctgtgggatttttggacgagataaccttaccctaagcatcgatgagctcacaggcttaagcaccagctgcatcttacgctgtcattatttagatcccaagcaagagatggtgggcattggctatcccacactatagcggagaagagggcagtgctagactagacatcgacttcctagtgaagatccatgaaatctcagaaatatgaattgacgtccagaacgtgatttatcattcctgtatgctacagaagaatacttgcaagacagtgtatggcttccctgtatcttctagatatgtcatctagacgttgagccaggaacacaatcaagcaacctttcatgatatagccaggccccaagcctcttcagaactgcgaataatgttttgaattgaaacagaggtgtaaagcagagaggtcagagcagatcaatactggttatgggtgatgagatccagacagaacagtccacagacaaataactgtcttacaacgagggggtgtgatggatgtgttatcttgtttcttatgagtctagtagtattactgtctgacactggtcagtctttaggggctacttcaaaatgttatttgtgtctttcttggaatacctgccgtagataatactcaatcagatgccatgacttgga

SEQ ID NO: 504000 - DNA, 118 bp, Homo sapiens
tccatacggaggggcgtgggcggaaggggggtagatacagaaatgaaccagaccgtgcccgtgctctttatcatctcttccccgcagaatgacgcacggaatgacccgcagaatgccg

SEQ ID NO: 504001 - DNA, 169 bp, Homo sapiens
  misc_feature (15)..(15): n is a, c, g, or t
  misc_feature (142)..(142): n is a, c, g, or t
  misc_feature (161)..(161): n is a, c, g, or t
gtccgtggtgaagtnccactcaggatgacaccatcaccaaaaaaggtttccacctgcgatacaccagcaccaagttccaggacacactccacagcaggaagtgaccacgtgccagagcaggggcggggacgtagagccagcntgccctttgccgcctgacntagaatgc

SEQ ID NO: 504002 - DNA, 1069 bp, Homo sapiens
gagccaggctggctcctgtctccccacggtgtagccagcatgaggcctggagaaggccagaggcagccaagaagaccctgggagttggggtggaagccaggcctgtagggacttcctggaactagctgagactcacagccggaaatggcagcgggctctaaattatgagcaggagcagcgtgtccacctggaagagacaattgagcagttggccaagcagcacaacagtcttgaactgggccttctgcaacacccctggcgggccagccagctccagcaagagcttcagcgagggaagcttcttgacttccaaaggagagaacagtgaggaagatgaagatactgagtactttgacgccatggaagactctacatctttcatcaccgtagtcactgaggccaaggaagacagaaagcctgagagtggacctgggaccaccactgtggactggacctcagcagataactgtattagatggtgcctcattcatgcccaagaattcatgcaaagttaagaggcgagtccgcatccctgacaaacccaactatagccttaacctctggagcatcatgacgaattgtattggccgagagctttcccggatcccatgccggtgaacttcaatgcagccctgtacatgctcccagcgacttacagaggacctggagtacaacaactgctggaccaagcgggtgaacttgacaggctcggtggcagcatatgttgccttggtaagccggctttcgtggtactcctaatcccacagtggaccggttggccaagcctttatccctagaccggagacctcgactggcctatgcggagttgtgccggtccctcggagcgggttgccacaccgagtggagcgcacaactgttcttcctcatggcctagcacgcctgaaaaaaccgcgacattcgtggaacaatttcatgagaagagatcagaaaatacaagaactaaggaaggcaacacagacaactacgcacaacagacatacacatcaaaaacaggagagtcaactcagacagagaatcacaaccatagagataatgtgaaagacaatag

SEQ ID NO: 504003 - DNA, 156 bp, Homo sapiens
gaactgggcaggcgcctgggagctctggacacctgctcagctctcggggccccaggcctggcaggtcacgcggctgccctggtggatgatgtctggctatatgtgtctggaggccgcaccccggcacgaccttcttctccgtctgcgcctcccagc

SEQ ID NO: 504004 - DNA, 911 bp, Homo sapiens
tgtaatcccagctactcaagaggctgaggcaggagaatagcttgaacccgggaggcagaggttgcagtgagccgagatcacaccactgcactccagcctgggtgacagagcgaggctccgtctcaaaaaaaaaaaaaaaaaaaattggtttagcgcggggttccccagggggggaaaaacagacccagcgtgggagttgggcccctgggccttggtgtggcttgacttcttgggggtcctccaaaccacgtggtttttttctggtggagcctggtactgggggagagatcagtagcatttggagggaagtaagagaaaagattcttgtgtacctcagggtttctttccctttactcgctgggcaagccattggtctggtggggccctcatggtttttccacactctactgggcgccgtgggaggtaacagatcacccacggccagtctcctctgcggggatgcgccctctgagagagaggcctagcagggaaggctccctcggggcatcccgggatgcagactctgggacaaattgcctcctttaaagtgtccgggtgacagctcaggtgaagtggagggtagacgggagacccagacttgtttaccacgcgtttccaaagctcttgatctttccaagattgttactgaaaatgtgtctctggtggtgcgagggggggtggggggggtggtgggccagttcttgtgaagtgatgtggtgtctttgattaggatacaggttctctgctaattgaaaaaggtttttaaattattatttgtttggacccagggttcagggtttatccaacgaggtttaaggtataaccttcagtatggtgaataatttctgttggtaaaagcatgggacatttcaagatttggttttaccattggtggcttggtctaaaccgtt

SEQ ID NO: 504005 - DNA, 1168 bp, Homo sapiens
gactaatcatatagtacaacccatcccatgaccccttaacaggggccctctcattgccctcctatatgacgctcgcggacctatccatgtgatttactgcttccactccgataacagctcctcaatgtactcacggcctacgtgaacgcgaactacgactaacgcatattaccattgatggcgctgctgatcgttagcaacgtgatgcaataagccacatgaccgaaggcacgaccatagcaacccccctggtcacatagaaagcgtccttcgatcaccgggataaatccttatgttattaactcttcagagaacgttttctctatcctgtgctgcgatggattcctctagacgcctgttgtatcctatctgccaggccttatgctctccttacccacccaatatatggaagggcactaggcctcccagtacagggcacttactcccgcataaatgcccctatagagtcccagatcctaagacgacagtccggtagttatctctgctattcatggagtactcgaaatgcacccgtgatgctcacgcagtatgtctaagtacgaaacaccaagctcggaaaccaatactgacttcagaagctagctgcattattgagcaaatgttataactggggtgctcatacttgttacccatccgtacagagcctcagaggtactctcgaagtctcccttcaccatttccgactggggatctacggctcaacatttccttgtagccacaggctgtccacggacttcatgtcatcattggcgtcaaccttgtccgcagtagtctgctgcatccgccaactaatatgtcactttactatccaacatcactttggcttcgaagccggcggctgatactgacatttcgtacgactgttggtttgactatttctggtatgtccccacctatggcgaggcgcgtaaaaaaaacccaaagcagacacaactcatacacaccacagtgagcgcgccacctcgtaaaacaccccgaggagccacaaatcggcacccgcgtttcgtaaaagcggcccaaagagggccctaaaaagcgcaggcgacaaacacgcggtgtgaaaaaggagccgctacctataagaccacgtggttgtactaggagcccacaatgcgccgccaatcagtggataatctcgggagccgtt

SEQ ID NO: 504006 - DNA, 517 bp, Homo sapiens
tactatggatagaaacagtgttgcagaagaattaggaattgccaagtaagttgctggtcagggaaaatttcacagaaaaagtactatttgattaaagatctgaaggagatgtgggaactagatacgtagatatttattaaagagaatgtgatttgggaaaacggacagccagttcagagatcccaaggccggagcatgtttggtatgtgataaggtttggctctgtgtcccacccaaatctcatcttgaattatacttcccacgtgttgagggagggacctggtgggaggtgattggatcatgggggcagttctcccatcctgttctcatgatagtgagggagttctcacaagatctgatgatcttaaaagtggcagtttcccctgtgcacgtgccgtctcctgacacctgtgaagaaggtgcttgcttctcctttgccttctgccatgattgtaagtcctgaggcctcctgagccatgtagaattatgaatcaattaaacttatttataaattaaa

SEQ ID NO: 504007 - DNA, 417 bp, Homo sapiens
  misc_feature (53)..(53): n is a, c, g, or t
  misc_feature (280)..(280): n is a, c, g, or t
ttactgtcccatgagactgtactggacgggtgcagcccagagtgggcgcagtncactaaggtgcggcccgccctgcctgcccggtgcctcccactgacctgagcttactaagggatggcagcagctccccagaaaaaaacgacactgcgagccctcgggacatgactgagttccacctcctgaagccagactccacctcttgtgcttttttgcttgggaaaaaggagtttttctttagaaacagtgccaagaatgatataaactacttttaactaagatnctaacaggcttttaacacaggtgtccatctccactctgtccccggtctctgtcccagctcaggctgcgttctctaactcatactgtgaagacaaccgtgtttttgattaaaaaaaatatatctacatagtcttaatt

SEQ ID NO: 504008 - DNA, 391 bp, Homo sapiens
ttttctgtctcagcctcccgagtagctgggattaggggcgctcaccaccatgcccggctaatttttgtgtttttagtagagatggggtttcatcgagttggccaggctggtcttgaactctcgacctgaggtgtacgcctgccttggcctcccagagtactgtgattacaggcgtgagccaccgtgcccagccaatttatattctttaaaatatttccatgcttgttttacggtccagcatatggtttatcttggtgaatgttctatgtgtgcttgaaaagatggtttatcttgctgttggtgggtgcagtgttctataaatagcaattatgtcaagttggttgataatgttcttcagatcttacatatttttaataattttctagttact

SEQ ID NO: 504009 - DNA, 220 bp, Homo sapiens
gttgcaaggtcagagggagaggcgccagacactaagagccaggagtggacacagggacccttcaggtcaacagctctttatcaaacacctgctgcgtgctctaggccagatcctagagacgcaggctgagcacgacccgtctctgtgcctgagctcttggttggatgggaggcgccccttaaccagatcatcagcacacatggtaaggagtgtgggacgg

SEQ ID NO: 504010 - DNA, 788 bp, Homo sapiens
ataaagaaataaattattgatggcatctggcatcccaagatactgggatgtgtgtgggggtatgaggtgtggtacttttgtttgttccaaggacagagtctcactctgtctccctaggctgaagtgtagtggcgtgatctcgagctcattgcaacctccacctcccgggttcaagcagttcccctgcctcagcctcccgagtagcctgggattacagtgctcccggccacacgcccggctaattttgtattattagtagagatggggttccactgtgttggccaggctggtctcaaactcctgacctcatgatccacactacctccagctcccaaagtgttggaattgcgggtgtgagctaccatgcccagccgtgtttccatgtcttaaattctttattcggtacgagatggggtctcacttttgttgcacacgcctggtcgttgaactcctgacctcgagcagtcctcctgtcgttggctccccaagggagctggacatcacaggcatgatgccactgtggcccagccccaagaatcctgtacttttaacacacacttcctaaattatatttgaaccaaccatcccatttaagtaagtcgtggggttaacgaaaatttcaggccagggggacagaaatgtgtcctagaaagaggctgtggtagggaaaacccgaggagaacatgtcattatccaaggctgtccaacatagaacgttcaatagagtgaccttggccagcctaaaaggttgctcccagcaggagttaaatataacacttgccgtagga

SEQ ID NO: 504011 - DNA, 133 bp, Homo sapiens
taagtaactctagcaggatcttatcactgggataaggaacgtcactgggataggaacgtcactgggataaggaacgtcactgggatagaggaacgtcactgggatagaggaaccgtcactgggatagaggaac

SEQ ID NO: 504012 - DNA, 1733 bp, Homo sapiens
  misc_feature (1089)..(1089): n is a, c, g, or t
  misc_feature (1298)..(1298): n is a, c, g, or t
  misc_feature (1733)..(1733): n is a, c, g, or t
atctccaatctgtcagtcatgatttccatggctccatatcttctacatcggaaattatgtcaatagagcagcgacgcagtggacattacaaactgcaggaatgatcctcatccgtgggagcgacaatgcagacacatcgatgttctattcctcatggaatacctgaagtagtcctggacgataagctgaccattcttctgtaacactgtctatcagatacatgctcttaaagcgtccagccaaccgtggttcttagtgcacttatgaagatcaagctcatgtactgcgttggtatttcgtacttgttactcttcctgagaatgattgtacacgcgagtgtaggttccttaaaaataaagttagaacaagacaaatatgggataagaagaggatgagacacaaaacagaagaataataacggcgcgcggccgtggatcatgaccaactatattctccgctcagtagggtggctccaacaagtcttctacacgtgagtgatcctcaggggtctatctctttggagtccctggtggcgcgcgaccacacttatatgagactgtggagaggctaccgctatgtcattgtacaaactttgtccgcgggcaatggtgcctgcagtatagcgttatataaaaccaaactttgtttccacgcgcgaactggagggggagaaaaccaggggggcggatcatctgcgtgagcagagctttctagagtggggataggctgggaaacattctagattggcctcagcgcgagaggagtgccgcaccacgatataatcttgtggcgcccgaatacacgttcgcctttaggacaaatgtgggatatttcccacggcgttgcgctcctctcagatcggtgtgtaggaaatatattcaagaggaggatcctcgggacaaagtgggtgtgctcgccatacgatggggtgcttccacaccccctttgctttcaatgggccctcctatatgtgaagcaaggcccgcggtattaggagaaaaaaaaatttgagggggcgcaccggagggaagtttgtggacagtgcaactcacaggccagcctcactttcactataccacggggaacgcncggcgcgcctcgatcagcaacaacagacgcgacgaccaccaacccagagtgaagtgcagcaaccagcacgcctagaccaacaacacgcagagcaccatccagagcgccgacatctccgcacacacacgagacatcagggagcgcagcaacacagaacacagcggcaagcgccacgacccgaaataaaaaagcagacgcagcaccgaccnccacgcgcgcgacagcctagcaacacacaaccgcgtgacacacgccgcaagaaccaacatgcacgaagccgggaagcggcccactctcgcgcaacgacccccgcacacacatgagggcaacgggagaagaacgatagatgcacacactagacaccagggcacacaaccacgcccgccagggaggcccccacaccacacacaggccgcagaggcggaccaccaacgcagtgctggcagcgaacgaaacggtgcgggagacatcgcagagcaatacgagcgcacgcaggcagaaacaagccgcacgcggcagcgcagcagacagcagcgccatcagccagcacacgcgcgaagcgcggcggccacacacaacagcaccgacccaagcgccagccaggcagtgagccaacagatacgagaggagacacagaacaggcn

SEQ ID NO: 504013 - DNA, 213 bp, Homo sapiens
tcctctctccttcacatgcctgtccctctgaccaaactctgggggtgggcttcctcaggaccttgtcctgagcactctatatctctctttatggatcacctcacccagtctaagtttctctatcacctttatgcagacttcagaaacagagttcctgagtgagggacactgagatccaagggcgcctgcacaggacagccccacagagagcgt

SEQ ID NO: 504014 - DNA, 173 bp, Homo sapiens
tatttaaattggagctttattttcttgggagggagggtctggcttgtcatccaggctgtagtgaaggggcttgtcataactcatggtttccacaacctccggggctgaaatgatcctccagcctcggcttcccaagtagctgggactacaggtaagtgccagcacatgggtgg

SEQ ID NO: 504015 - DNA, 891 bp, Homo sapiens
ggcgcagagcggtttggtcgggcgtcgatgcggtgctggtctatcgctcgtggaatgcggctctacctcgggcagcggaagcgggcggaggccggagaagtgggcaaaaatcgaacgagggttggggtgaacaggaacaatggccgcgacaaacaagcgagaacggtggcgtaagatccaacggaggtggaaatagacccccgtcaggacaggttgggaacacgcagagccgcgcaggatacagacgcatcccgctaccggtggggtgaagcacgtccctcgagtcgactacaggccacgggaatacgtggcagcttcgaagcagaagtcggacgctatatggcagacagtgcagaatcccggagactggatcaattccgagtaagctgtcgctcatttcacagaagggtgggtgagggaagatcggagcaggactttgagatagatgcgatctgacaggtggcatgaagcgccgtccagtcggttgcgactgtagagacgcgcttatgagaagtcggttagcacctggttgggctctgttcgaaagaataacccaaactcggtgtgtcatgcaccgctataccacgagtgcgagcaatcattgcgccaatgggagaatcccaagtttggcctaaggtcgagatagcggtggaaaggagaagacgtctaaaagtgagaggcacgaggaactgagggtttgagtaagtaaatttcgttgtgaacatactgtgagggtttgagtttggtggactatgggtcgtaacggaaaatttgtttagtaaatatggtttgggttgttggttactttaaagttaatttgaattctttacttcaaggattgaattggggaacaaggactggtcgtaagaccttcggtgtgtgggagcacta

SEQ ID NO: 504016 - DNA, 566 bp, Homo sapiens
  misc_feature (404)..(404): n is a, c, g, or t
  misc_feature (526)..(526): n is a, c, g, or t
  misc_feature (560)..(560): n is a, c, g, or t
aattcgggccgcgtcgatacggctgcagacgacagaaggggctgtctcttggatataagccattttaactggggcgagatgatatctcattgtagttttgatttgcatttctctaatgatcaatgatgctgagcaccttttaatatgcctgcttgtcatttgtttgtcttcttttgagaaacgtctattcaaatcctgtgcctatttttgattggattattagactttttcctatagagttgttttagctcctcatacatattatggttcttaatctcttgtcagatggatagtttgtaaatttttctcctattctgtggttgcctcttcacttttttgatgctccttgctgtatagaagctttaaacttaagtgatcccatttgtccattttggcttgatgcngtgctagggggtattactcacgaaatctttgcccagactgatgtcaggagagtttccctgttttcttgtagtagttcatagttgaggtctagattgtctttaatccattgaattgcctttcnggtgagagaatgaagtcagtttcatctctggcangggatg

SEQ ID NO: 504017 - DNA, 488 bp, Homo sapiens
  misc_feature (143)..(143): n is a, c, g, or t
  misc_feature (149)..(150): n is a, c, g, or t
actaagtctttaaaatagtttgcagccttctcccacaggagaccagttgaaagataagtgtgattttagatctttcttgcccataggtgtttccagtgggagtcttcccatctgggtcctacccaaaaggctggggttttttntttttnncttccaattccccatccaccaccgcctgccagctcacactaatagatgattcttaattgccaaatgtgttagaggtttggtatatcctactcctgggccttacatgtcgcctgtggggcttaagaccaggtttgataagtaggaactgaaaggtcttccagattcacaggtagaaaattttatagacatttctggttaaagaaatatatcgattttatggtttttcaattatggttactggtaaatacctttggtacctgttcatggattattttattctaaaatattttgtcaaatggtggtatcaaccaagttaaaaagaaaggttttccatgtcc

SEQ ID NO: 504018 - DNA, 170 bp, Homo sapiens
gctctcccaccataacccctacttcctccactgactcctggaccatagtttcctataatagttggaacagcaagagaaaacaaacatactttgatttcccatgatcagcctaacactacagatgattctattttatatccatccagtcttttaaacaagcagttcctcat

SEQ ID NO: 504019 - DNA, 1515 bp, Homo sapiens
  misc_feature (501)..(501): n is a, c, g, or t
cacctatatcgagtgttttatgggcggccccccttttatgggtcccttctgcggaagcgagttccccccccacgggttggctccgccacaaatgccccgcgcctctttgtttataactggtccgcgcccactgtaacttatatttaccccggtctctttataagagttatccccggggccccctttgtgtgtgccccgaatatttctggcgcccccgaggagcgctttgtgtgtctccccctcgtcgttgccgtgcccctctctcccggaagaggtcccccccgggggttgagcctttgccccctacaggggttcctcaaattccgcccaccctgtgtggggcccctccgccaacagggtatttttgccgaagagattttattaataggggggtaggaaccccctcttgggggagcccccccccccccgataaagtccttgtggcaaaaattgggggaacactatattggcgccaatctctacgggggaaatttttgggcnttctctatggaaaatgttctgttctctcccacagaactagactacttgtggcagatatccgccccttgggaccccccccacgcggcttctcatcagcccgggaggagttcttttgtgtaatatataagcgggaattatctagaaatcggtttatagagagagacaacgctcaccccgcgagacacccctctggagatctctcccccgctttgtggttgaaagagaatataaagcgcgtctccccaaataaatcgcccacactttttccctctaattgttgtcacgccacgttgtctctgtgcgctctattattgtgtcttcaaagagccgcacagagatcttgctgagtatatcacttgtctgctgtgttctcggcggagagggctcacacagctgatattaaaggagagcctctcctctgggagacactctgggagagcacccaccagagagagatagaccctacacgccccacaccactctctcacagcctcttgtgtgtctcttctcttatgtctgtatcacttctgagaagacccactctgtgttgcccacacagagggccacagcgggcgctctggcacacatgtgttcactttgtcccacacagagaagtgtgagtttgctctgagagagaagagtgatgtgaaagaatagtgttgttctcttggagaaacatttaccgctttaagaggaatagtcacatgtggggaaaatttccccacaggtgtaagaaatagtgccttgcgttctcccctttgcccttcttgcccataggattcttaagatttctctgaggcctctccccagatacgccagaagccatgttaagccccccagaacccggtcccagtctgtctgaccctctgaactgctttgaagacccctcccggaggttccctgccgctgcgttgaacacccagtgccctggactccctgctccctgaggcgaatttaccccgggtcccactgggtccgacccgagttttgaatttaaacctgcctccccaccca

SEQ ID NO: 504020 - DNA, 1108 bp, Homo sapiens
  misc_feature (115)..(115): n is a, c, g, or t
gcacagctgctgcaggtgctggccggcggccggttctgtgccgtgctggagggcggctaccacctggcagtcactggcggagtcagctgtgcatgacagtacatgtacgctgctngtggtgacccggtcccactccctgtcagggcctaatggcgccatgtcagaagtgcccttagagtccatccagagttgcccgtgcttgcccagggtcccgtcactggaagagcctccagcagcagagatgtgaccagctagtagccgatgtagccccgagcatgccgacgtccccacgaggggagtgcctccacctctgcatgcctgtggcgtgtcctacgtgtgtagaggtgcagctgcgagtcttgcagccgtagcttccacttccgtggatccaaggcctgtgcctcttgtgcaccgtgatctccctcgtggtacacgcaaccgtcgtgctatgcccctgagcacagcgcccggattacttcacagttggtatcgttgccacccgtgatcgttcagtcccaacaggacaggcgtcaagtccccttgacggggaagggagaaccatgcaatgtcccttggggccaagtggccaacgaccgaacgattcgccttggaggccccgcgtgaacgggcacaggcccttccatctgaccaacctctgtgggacatgcattcccttggtaacccttcttttaaagcacttaggtggcacttgaccacttggggaaactttggtggggcccaaaggggctttgaacgacgcacatggttgggcgcgttacttaaccagtacaacgttgccaaagcctttctcgacgtatcgccatacaatggtcctttgcccacagggcacaatatgccctaacgcccaccttgtgggggaacattgttttggggcccttgggtcttaccccggggcgaaaagaaggatgtgctcctttgggaatcccacccatattgagcgacaaggtcccccctatcaggtaagcggaccttgcccttgcatagaccggtctgagggtccgcccattgaggtgcaacacatgagaacatgggtgaaaacccggtgcgctgcgtttccctcacaggaaaccgcgttccgtgaccacca

SEQ ID NO: 504021 - DNA, 170 bp, Homo sapiens
atgcccaataaaaccacaaaaattatgctgttgtggtggcacatgcctgtaatctccactatttggtaggctgaggcagaggaatgggttggagccggtttgtggaggttgcagtgagctgagattgtgccactgcgctccagcctggcgacagaaggagactcagtctc

SEQ ID NO: 504022 - DNA, 568 bp, Homo sapiens
cttacgcaatggttatgtgagggtgtacggtagaaacgctattattcatcctactgtgggtaattgaggagtatgctcacgatactgcgtagctgggtttggtttaatccacctcaactgcctgctactgatggactaagacttgacgacgacgtgacggaacacggcttacgtttacgtacgggacgacgacttcggtatatgacttgacactgggggctacgtttttgtcatgtgacgacacgacagcaggccggatgtccgacggggtgccttgggcaacctctgggactcagaagtgacaagggggctattcctagttttacttgctactacgccattatgattattaactgactgagtactcgattggtagtacttggttatggttccttgtccggagagtatattgttgaagaggatacgctattacaaggactatggctgcggttgcttgcgtgaggaaatactagatggcagcttctgtggaacgagggttactattccggttagaactggaataaaagctagcatgttaatttctaggcctactcaggtaaaaatcagt

SEQ ID NO: 504023 - DNA, 914 bp, Homo sapiens
ggctctctggccttccagacactgttttcgaaatcacggagttgcaactctctagaacttgaatgtcattaatgaacgtaatgataccatgccacctattgcacagctagtacaatcttcagagagactcgtctctgcagccaggtgttctgtcaaaagtccacaggtgcggacgctctcgttatcctgaaggaaaacctcaaggtcttgagcgtcaagttcgattgacatgagggaatctccccccctggatgtatgggctccgaaatctggaagagctgtagcctagttggctctctaagtcatgatatttccagaaatgtcacccttgagatctctgacgggatcgtcaaaagccttaaaagttctctctagtcaaaaggcacacgtatgccagaaagtccctcaggtcagtggctagagtgtgaccaggccattctccagaaggatgtgcatacgtaatgactggcatcaacgctgggtgatgctcaacaacttaacagaagatgagcaaatctgaccagaagctggaagcttggtgccactgatgaccttgggagcagtattcctcatgctgtgttcaggactagctcagcctccgagggaacttgcgaccctggacggtacaaacgaatcctgacactctactccgaaacgaaactcgttaagctttcaaggcactttaaggaccagctagacacgctgctagacaacctggttgcgccctataccaggcattcaaaccgtagaattccacaagaaagccttatgcaatgggcagacgctcacccagccctgggacaccgcccgtaccctgttagttcacacagtaaagctctcgagggatctggccctatcccaacccatgctccctattttcaacaaggagccggaatccttgtgacatattcgga

SEQ ID NO: 504024 - DNA, 795 bp, Homo sapiens
  misc_feature (325)..(325): n is a, c, g, or t
tcccaaatgaaaatcgctttatatttatactcgctttggtttggatatttttggcaacaaaaaccccctggttccaaagtctcagacgtgatacctgaacgtgtccaaacgtggaaaagtggaccaggcgtggtgggcgcaccccgtggtcccctctctctcctgtgggcaaggcgcccccacccccaggggaacagagggtctccaggcgggccagctctcactgtgcacgcgtggccaccaccacttatacccatatacaggctcactcactcattgtgctcttctcgtggtgtttacactgtgcccacctgtgtgtgccgcnctctccacactgtgccctgtgaaatgtgggcgccagagctctccacacccctgtgtgattcccctgtgacagagagggacaactctgtgacaaccagtgccaaaatagcccgcacagaactctcagtgactgtgaaaagaggtttctgtggggcacaaaccaaatctgtcatatatctctctccagaaatgtgctcactgtgtgcgtcaactgtagacccagaagaaaccagcgcggccacaaaagaagccggacaaggtggggcacttcttctatctcagaagaggtgtgaatctccctccgaacggagacactctctcgacgggaacactgtgggtatctcatctcccactctatctctataaccctctccacaggtgggcctgtagaatgtggagcatttgtgtcacggtgcccactccatccctcgggtatctcgcggccaataaaccctctcaaccctccgacga

SEQ ID NO: 504025 - DNA, 140 bp, Homo sapiens
  misc_feature (106)..(106): n is a, c, g, or t
taggaggagaaggtgaaggagcagctggaggccggcaagcccgagccgtcatcgaggaggtggactggccaactcgctcctcggaaggcgtgactgggacctcaangagagatggtggccaagcaagcttggagaaacta

SEQ ID NO: 504026 - DNA, 143 bp, Homo sapiens
  misc_feature (97)..(97): n is a, c, g, or t
  misc_feature (106)..(106): n is a, c, g, or t
  misc_feature (133)..(133): n is a, c, g, or t
atgaaaagaagaagagtctaaatttgaagaaatgaagaaaaagcatgaaaatcaccctaaagttaatcacccagggaagcaaagatcaacctaaaangagggtatnggaaggagactcatggatttggatccnaaatgacctt

SEQ ID NO: 504027 - DNA, 312 bp, Homo sapiens
ctgatgcgattcttgaatcactgcgaagctccgcctcctgggttcaagcgaattctctgcatcagcctcctgagtagctgggattgtaagcacccgccaccatgcccggctaatttttgtgtttttagtagagctgaggtttcaccatgttggtcaggctggtctcgaactcctgagctcaagtgacccaccctcctcggcctcccaaagtgctgggattaaaggcgtgagccactgcacctggtctgaaatgcataatcttttaaaactgaaagccatatctaatagtgttcttaatttgtcaagaatcgg

SEQ ID NO: 504028 - DNA, 211 bp, Homo sapiens
tagcaaccggcgttcaatggaattcctttttaccaaaaacccagacgttttattccgcaaagcacatacgcacatacttcaaacacggaaaattaattcggaagtgaatgccataacaaatcaactactgaccatcacgtagcaggaggtgacatggaccaactggctttcaggtccctcataccgcctgtcggtggggcggaagaaccgg

SEQ ID NO: 504029 - DNA, 120 bp, Homo sapiens
gtaagagcttatcacctcacgatggatcacgtccttagtaatcattttgcctttattctgctttcctaagtccttgttattgccttctacttaacacttacaacaataacttcacttagt

SEQ ID NO: 504030 - DNA, 491 bp, Homo sapiens
acacgggtgatgcggttgacgcctgacttcgccttttctccccgtgacccaaaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggacttggataaaggccatgcagcacatctcgtacctgaactcccggcagttccccacgcccggaattcgcagactcaaaaatcaccagcacaatcaagcgtttaacgacggcacctgcatttcggtccccccggtagatgtgtgcccagccacagttcgtgcacccggaacaccgctcctttgttgacctgtcaggccacaatctggccaactgaatcacccgtt

SEQ ID NO: 504031 - DNA, 752 bp, Homo sapiens
  misc_feature (318)..(318): n is a, c, g, or t
agcggagctggccctagtgagcccagcgccggcggcatgtcctccggggctagtcgcgagcgccctgcagcgcttggtagagcagctcaagttggaggctgggcgtggatgaggatcaagggtctcatcatggcagctgcatgagtcttcaaacagatactgtgagtgcaagatatgcctgcgaggatgcctactgctggtgggctgttccaggtggaagtaaccccttccggagagcctagatcctgtgctttactctgaagactcgagagaagttggctgaggaagtgccttcagaggcacaagtgtgatgaagtngactggctcttcgacgtctcaaggaagagacgactgtttctcctaagcattttacgagatctttcatgccctttgcctgtggcctggtcctatagccgaaatcacaggatattcatgagttactacttgagtgagaaaactgggtgaaggaatagaaattttaatatagtaataactgctagtttgctttgtgcaagtacttttatatcattaagataaacaaagaaccttacgaacaaacatacgcatatatgctaccgtctttcataagtgagttactaagatttctatactctggaatatcatgtatgtgtcatttactggatgtatagattttaggaaggaccatagttctgtctatgtaaacaagtgaatacttatagaactgtagtacctggaagttattattccgtagaaaattgtcttcgtcatga

SEQ ID NO: 504032 - DNA, 167 bp, Homo sapiens
gccaggtacatctgcctgtgatgacaggaaagaaatcaggtgtgattcatgttcttgtttacccatagccacctctcctcatacaggcttctactgcaggaaactacacatccagtggtggtaaatcacctaatttacatctacatgcattgaaacaaggtcactca

SEQ ID NO: 504033 - DNA, 224 bp, Homo sapiens
ccagttacttcgagtctcccttcatcatttccgacggctctacggctcaacattcttgtgtagccacaggctgccacggagcttcccgtcattattggctcagagctttcctgcactatctgcttcatcctgccaactaatatttcactttacatccaaacatcactttgggcttcgaagccgccggctgatactggcacttttgcagactagatggttggtgt

SEQ ID NO: 504034 - DNA, 284 bp, Homo sapiens
atacaaattatggctgaaaatagtgtattaacatccactactgggaggactagctaggcagactcttccatttacgattctaaagtttctgatattttcaaggaaaacttacttattggatctactttatatgtacaaaaagagatgcctcacattgaaacatgagtgatatggcttcaagaagctggaaaacacgaagaacttataagagccttaaaagacattaaagtgggctttgtaaagatggagtcagtgaaagaatttgaaggcttgcatactccgga

SEQ ID NO: 504035 - DNA, 728 bp, Homo sapiens
  misc_feature (31)..(31): n is a, c, g, or t
  misc_feature (80)..(80): n is a, c, g, or t
  misc_feature (95)..(95): n is a, c, g, or t
  misc_feature (100)..(101): n is a, c, g, or t
  misc_feature (117)..(117): n is a, c, g, or t
  misc_feature (128)..(129): n is a, c, g, or t
  misc_feature (145)..(145): n is a, c, g, or t
  misc_feature (156)..(156): n is a, c, g, or t
  misc_feature (160)..(160): n is a, c, g, or t
  misc_feature (213)..(213): n is a, c, g, or t
  misc_feature (219)..(219): n is a, c, g, or t
  misc_feature (251)..(251): n is a, c, g, or t
  misc_feature (302)..(302): n is a, c, g, or t
  misc_feature (312)..(312): n is a, c, g, or t
  misc_feature (342)..(342): n is a, c, g, or t
  misc_feature (347)..(347): n is a, c, g, or t
  misc_feature (421)..(421): n is a, c, g, or t
  misc_feature (426)..(426): n is a, c, g, or t
  misc_feature (434)..(434): n is a, c, g, or t
  misc_feature (453)..(453): n is a, c, g, or t
  misc_feature (455)..(455): n is a, c, g, or t
  misc_feature (475)..(475): n is a, c, g, or t
  misc_feature (524)..(524): n is a, c, g, or t
  misc_feature (536)..(536): n is a, c, g, or t
  misc_feature (552)..(552): n is a, c, g, or t
  misc_feature (560)..(560): n is a, c, g, or t
  misc_feature (584)..(584): n is a, c, g, or t
  misc_feature (600)..(600): n is a, c, g, or t
  misc_feature (602)..(602): n is a, c, g, or t
  misc_feature (728)..(728): n is a, c, g, or t
tctatctcctgcccttaaggaaatctattanattactaagccagaaaaacaatatgcaacaagctgcttcaatgtattcnttcagatgtcaaacncaganntacgcatttactcctntgagcataatnnaacacactaccttganacatgcttgtnaacncgctggtcctgaaggcacagccttatgcccacctgccgttagaaggcaaccangatttncttcaggcactttttttccccgtgtgtgttangaaatcatgctgtccaaccagtcttccagctcttcctcggtaacatttttngaggtacttngttgctcaggttccatgtttttttcttcantcacngatggttttgcacaaacttcttcctcttggaccacctccccatcttccttggatttcaggtcctgagacgtctnatctngtaagatnttatctccctcttttatangngcatctaaattaagcaacanatctagttcttcttccaaatggtctcctgctgactgcactgggggagtnggctttctgcanactcccttgaaggacncgggcttnggttgtctttgcccagcaacacanggcagccagcagccananatttcagctcaaagatgggcccccttcctccaggcccaagggcccctttaactgcatccctaatcccttgccatcatcagttctctttggtttcactgaggaatctctaaaggactgtaccctggn

SEQ ID NO: 504036 - DNA, 983 bp, Homo sapiens
ggtcctgcctggccggggccgcacggcggtggctccctcccgtgcgtccgtcgtgggacctttgtccctgctctgccctgctgtgggtgacagctgctgctgctccgggtccagcggcagtgggctgggtgactgcccggccttgtggcccctgctgccccacaaatgataaacgctgagggcttcggccagggactggtgataatacccacatccccggaaactagggtgatcagcggttggcaggaacccagtgtgtgcccttcgcagggaatcccatgcgcttcgagggccccaggaaacgccaccagaacgcacagcgatgcctgtgggacgccgccggcgggccttgggggagtggcgcgggacgtgctggggccccagagtgccatcggcgacgccaggacgccggctacgcacgaagccggcaggaaaggcatgttgcctcgcacaggtccgtcagggtagcggcactttcttacccaaggtgccggttgccagccgaacagtggattaaccccggtgttgcgctcgcgtgggacgggcacttattgccagcctgcccaaggcgaaagggcacactatccacaaacaggtggggagaaaccgaaagccggctggcgggcacgctcggcccgtgacacgcgacacataacagtctggccgcccctacattggaaaaggtggcagcaataggcttaccagtaaaccagcaccgcggccattcacgggtatgcgacacaccatgaaaccagcagacgcacgaaagaggggcacgggcttcaaccggcgccacgcgcaattttaaaaccctgtgtggcctttgggggcacaccacacgaggtttgacccaccgaggacgagggggccagccacgacgcggcgccatccaggcacaaaacacgggccccaaaatgttgtgcccagtgtggattatatccaccgcgcagttggacattcgaacagcagtgggagatataccc

SEQ ID NO: 504037 - DNA, 149 bp, Homo sapiens
aatccaaccccaaaaaaaaggcttttgtcagccatggggcaatacaaattaataccacctccggggtttttaaaacagtgacgatacggcagttccaaaatctgactgcagtatctaggtttctaagtacaaaaaaaagttcaacagtt

SEQ ID NO: 504038 - DNA, 411 bp, Homo sapiens
ccccgtcacacttatcgctactagctattttccatctttattttttcattaatccagcaatgctcctttaattccacaatcatttatatccagagaatacattgctgtctattgtgaaaccaaatattattagtccaggaattgttcctaataatcgaaggaccataaattgtattcccaaggctagggaccgttgtctgtgatttacacaccttaggattacacactgttataggagtaccgtccataaaggtaaaaattattacaataaagaatatgctaaggaatatgggcagtttcgcacaatgagtttcacattttccagctttggcttcaaaagcaaaagtttctgcagtgtatgttttttctgttttcctttctatacaggaacagttgtaatataccttttgg

SEQ ID NO: 504039 - DNA, 1390 bp, Homo sapiens
ggcccagcgagactcagcagtcccgggccctgaggcctctcttccccatctgagctcagcaggcccaggaggagtcacatcgtcccagtgcgccagcagagggcagtcgctgtcaagcactgggtgcatcatcacacgttcgctgatggagagtctagatagcttcacaggaccatccgaagggctccagtggacacaccatacctgagtactacgtgccccactcccagggtagacggaagccatagccattcctccagtacatcctgttccacgtgcgtggttatgaggcgcaacgatgaggatgggcggacggacaacctggctggatacctgaagactagtctgggcgtccctgcgagtcagacgaggcgacggagaacgggagaatgctaccgagtgagttgcccacttacactctgctttccagaccagacatcggtgacgccctgacgggctaccatgggacgctcggtaggccccactctgaagactaatctcggggaagagactcttgctcgccgagtcaggggaacccatcgatgttgtcacggggcaccaagacacaagtggacttgctccattagatcagacggccatgccgaaggatgtgacgtggcacgtggtacccccgcattcacggtgatactgttagttcaccacagaccacacttggcgagccatcatcggtcgggcgaccaatagcttttgtgacgagacgagaagagacacgcgcgggctactgcatgagccgaattggtctgacccttggccttagttggcggcgggacccattgtgccgaattgttgagccaattcccggacagtaacatggacaaggccaccggggactggggaacggaccatataccaagtgggacgccgtggcgtaccaacaggcacgtataatgccaccaccggaaagagaggcctgggcggcagtgacagggcggcacgaaccccataggttggccaggattggtaccgggaggcggccatcctgggcgcacgcgcattaaggcaaaacccccgggtggggaaccagggcgcgttacagctccaaacacaacgggggaacccgggggaggtaccccccgctgagaacacggagaactgcgcaaaggaaacaggaaaaccaacatgcggaaaggcgcgccccatcccctgagagagagccaggagaagggcgaacccgccgggcacgtaatggagcaacctggggaacacccgtggggcaccgacaaggacaaacacacgagcacgggagggaggaaacaccggcgtgccacgtcgatgaggcatggcacgagcgacaaccgctgtggaggggccccgctgacaagcacaccacgcgcgacacacgatcaagcagaagcgaccagaagagaag

SEQ ID NO: 504040 - DNA, 1054 bp, Homo sapiens
  misc_feature (557)..(558): n is a, c, g, or t
  misc_feature (568)..(568): n is a, c, g, or t
  misc_feature (574)..(574): n is a, c, g, or t
  misc_feature (583)..(583): n is a, c, g, or t
  misc_feature (593)..(593): n is a, c, g, or t
  misc_feature (603)..(603): n is a, c, g, or t
  misc_feature (615)..(615): n is a, c, g, or t
  misc_feature (622)..(622): n is a, c, g, or t
cagaccgaaacctcaacaccaccttcttcgatcccgccggaggaggagaccccattctataccaacacctattctgatttttcggtcaccctgaagttgatattcttatcgctaccaggcttcggaataatctcccatattgtaactatatctatctccggaacaaaatgaagccagttggatacataggtatggtcatgagctatgatatcaattggcttcctagggtttatcgtgtgagcacaccatatattgtactagtaggaatagacgtagacactacgagcatatttcacctccgctactcataatcatcgctatccccaccgggtcaaagtatttagctgactcgacacactccacggaagcgaaggatgaaatgatctgcatgcgagtgctctgagccctagggattcatcttgtcttattcaccgtaggtggcctgactggtattgtattagcaaattcatcactagacatcgttaattacatcgacattgtactaattgttgtagctcaattccactatgtcctatcaataggagctgtatttgccnncataggaggnttcatncactgattncccctattcncaggctacancctagaccaaanctacgcnaaatccatttcactatcatattcatcggcgtaaatctaactttcttcccacaacactttctcggctatccggaatgccccgacgttactcggactaccccgatgcattacatccactatgaaacatcctatcatctgtaggctcatggcatttgcctctaacagtcacgtaactattaagtaatttctcagtgatttgagaatgccttcgcttcgagagcgaatacagtcctacataggtagaagaaccctccataaacctggagtgactatatggatgccccccaactctaccacacatgtcgaagaaccccgtatacgataaaatctagtacaatactaaggacggaatcgagccccccaaagctggtttcaagccaatcgccatggactccatgacttttccataatcatactttaaacttaagggaca

SEQ ID NO: 504041 - DNA, 137 bp, Homo sapiens
ggccccgggttaaaaaggaacctattaacctttgcccggaatttatgggtggggaatggcttgtcaaagcatgttagttttataaggcaattggggttttttttgttaaaacacccccccaaaaacagggtttgtta

SEQ ID NO: 504042 - DNA, 798 bp, Homo sapiens
  misc_feature (557)..(558): n is a, c, g, or t
  misc_feature (568)..(568): n is a, c, g, or t
  misc_feature (574)..(574): n is a, c, g, or t
  misc_feature (583)..(583): n is a, c, g, or t
  misc_feature (593)..(593): n is a, c, g, or t
  misc_feature (603)..(603): n is a, c, g, or t
  misc_feature (615)..(615): n is a, c, g, or t
  misc_feature (622)..(622): n is a, c, g, or t
  misc_feature (745)..(745): n is a, c, g, or t
cagaccgaaacctcaacaccaccttcttcgatcccgccggaggaggagaccccattctataccaacacctattctgatttttcggtcaccctgaagttgatattcttatcgctaccaggcttcggaataatctcccatattgtaactatatctatctccggaacaaaatgaagccagttggatacataggtatggtcatgagctatgatatcaattggcttcctagggtttatcgtgtgagcacaccatatattgtactagtaggaatagacgtagacactacgagcatatttcacctccgctactcataatcatcgctatccccaccgggtcaaagtatttagctgactcgacacactccacggaagcgaaggatgaaatgatctgcatgcgagtgctctgagccctagggattcatcttgtcttattcaccgtaggtggcctgactggtattgtattagcaaattcatcactagacatcgttaattacatcgacattgtactaattgttgtagctcaattccactatgtcctatcaataggagctgtatttgccnncataggaggnttcatncactgattncccctattcncaggctacancctagaccaaanctacgcnaaatccatttcactatcatattcatcggcgtaaatctaactttcttcccacaacactttctcggccaccgtccgaccgtatggccgacacgtactaccgttgtagctcacttccacctatgtncctatcaatacggagctgtatttgccgatcataggaggcattcattcactgat

SEQ ID NO: 504043 - DNA, 1547 bp, Homo sapiens
gcgggcggcggcggccggcgggcggcggatggcggcgtgcggagtgccggtggcgacgacgcccgctgcggtgcggctgagcgccgagcgggcacaggcgctgctggccgacgtggacacgctgctgtatcgactgcgacgggtgctgtggcgcaggggagaccgcacgtgccatggcgcggcacccgaggccctgacagggcgctgcatgagcccgacggacaagcgccatggagccttcatcaccaaacaacagcagcacagacccgcgctgccatacgccgagaagctgcaggcgccctggagcattcaggcaggcacccagcaggggagcccggacagccaaggccataggaagggtcattcgggcaccgagagcatacatagaaaccagcagcatctacacattgatagccaagcgaccgtggacctggacagccacaccggaagaccacaaaaggcctaccgatgactagagggcatgaccacaaagacacttgagacaggacaggaaacaatggagagagacccagataggaggacaggtcagacccaagaacggagtgggagcgatgtagggcacacaggcaagcacaacgtgaaagtgggaacagtacgggggctcacacggggcaggaacatggggcaatgacaacagacagacccgagattgagaaagaccaccgaaactggtagcagccgacgcgatgagatagagataggaggacatattatgaaaccacggaaagctaacagagagatacacaattgaccacggcttcaagccgacgagagggcaccgccttggaggacttcaccacattggcacagcaaatagacaccagaagacataagcacattcagatatccagctgagaggggacacccagaagacaaatttagggaaccacagcgcaagggtgctataccgaggcctttgaggaaacaccaggaccgagcatatccattcaggcgtgagggtaaccccggggttaggtctgtgagaccacaggaaaggacccagtaggaacgactttgggaccggcacgaaggatgcgacgaaggggcgaggacaaatataaattcgaggggaacaaaggcgccgcaaaagggctagggatatacgctatatattacagacggataggcgagagattagtttaccacaaggggaagattacagagaggacatctaaaggcgaagcagataagcgacggaagcgaagaggccagattggatttgagtaggcagccgaactgtgagatatataagagaacatattgcttatcgtatagagaggaacagagcattgattgtggcaatggtaagcaacacagttcgatttagaccattatagcgtgtatgtttacaaagctgattaggggatgaaagtattgaacgaaacatatctgagtgagaatagatgaagagttgcaggagatgttaaacatagaagaaaatggatgcgatgtagacatcatattgtatagaacgtgaagttcaagaacacgattgatcagagatggacataacaaggatatagaaa

SEQ ID NO: 504044 - DNA, 268 bp, Homo sapiens
ggaccatcaccctaaatttattatgcttcaaaaactaagacgattatggaagacaaaagaaaacataaactggacttccacaaaatgaaaaactttgtgcagcaaaggacgttattaagaaagtaggcccagcgcagtggctcatgcctgtaatcccagctactcaggaggttgagtcaggagagtcactcgaacccggaggcagaggttgcaggcagagttgtgccactgcactcctgcctgggaaacagagcaagactctgtctcc

SEQ ID NO: 504045 - DNA, 385 bp, Homo sapiens
caagctatccggttcaatgcccatgctttcccccacacaccatgccaccacatgtccctcaggaaacaggtctgcaatgattcaggagacctcgtagtctacattgatagatgtaaacaggcattggtttctgtcttagagagtgggccagtgaggaaggcatggatcaaagcaaaaagaaaagccaaggagggggaggatggagattaaacaggtccctggttgtcaggggcaaaactgttaatgacggtggagcaccatgaaattaatgacccacccaaagcacctgagaaattgaaccggatagcttgcccggggtaaccgaggctccgaatttccgctaatcaatgggtccataggcttggtttcctagtggtgaacattg

SEQ ID NO: 504046 - DNA, 100 bp, Homo sapiens
ataggaggagagcatctcagccgtgttgcctgacgttggttgatgtatgtagagttgttcatggactagaatacatcgcctctgatcgcgatcactctga

SEQ ID NO: 504047 - DNA, 135 bp, Homo sapiens
gtgtcgggctacgcgttgcgtctggccggcgactgacgagcggtcgtgacatggtggccactgcgctggtggccctggcgtgtggttggttctgtgtctcccccgtcccctctcctggctaccctggacgacccg

SEQ ID NO: 504048 - DNA, 669 bp, Homo sapiens
  misc_feature (52)..(52): n is a, c, g, or t
  misc_feature (585)..(585): n is a, c, g, or t
  misc_feature (591)..(591): n is a, c, g, or t
  misc_feature (625)..(625): n is a, c, g, or t
  misc_feature (628)..(628): n is a, c, g, or t
caggcatgagtcactgcgccagccctagtttcttaatttttacacatcaggntggaaatatcttggttatgtaatcagagtttaattggcagtttatagttggttaagcctgaagcttgtttccggcaatgtagtaatttaccaaaaaatgctcttgagtttagattattttttagaagtagaaatccggggactagagccacctcagtctaattgcctgccacttaattattttcacactccgatggtgacggatttttccctgaatttttcacatgtgtgccaagcaggacctcaagtccacccctcatcccatattcctccagcctaactctggcttacagcaaaatactaaatttccagtttcgtctgatattcccaaatgccaatttcccctccctaattcactttatcaactatttgtccttgagtgtacatttttatattattttaatcttttcttttttttctttcttctgttttttttcgagacggagtttcactcttttcgcccaggctggagtgaaatggtgcaatctcagctcaccacaatctctacctcccgggttcaagtgattctcctgnctcagnctcccgagcagctgggattacaggcatgcaccancangcccattcaatttggtatttttagtagagaaggggctctct

SEQ ID NO: 504049 - DNA, 117 bp, Homo sapiens
atagagttaacatcttcctgagacaaaaattggaatgaccccaggcttaagcccccagtgattttaggggtcagatgcactgacagtgatccacaatgtacaagtgttatgggaacc

SEQ ID NO: 504050 - DNA, 116 bp, Homo sapiens
gtctctacaacctgctctctttaaccaaggaccaaggtaaggggcagcctagaaaggcagaaaactcttagagtgtaactgctctactctaggtcaacatctatgaaaaacctatg

SEQ ID NO: 504051 - DNA, 255 bp, Homo sapiens
cttgagctcggtaggtcgaggctgcagtgagccatgatcgcgccactgcactcagccttgggcgacagagttgagactttttcttcaaaggaggaaaaaaaaggattgacggcggggttttttcttttccccctctcggggccttaaagcttccgggccgtttgtttgccgtgtctgtctgtgcagagtcgtgcgtgctcatatcataatcagagcgctctttgagacccccgagaggggtgcgcagaaagagca

SEQ ID NO: 504052 - DNA, 137 bp, Homo sapiens
tagagtgatcccccgcgagctggcgcgcagcatgcgcgcatcggatggcgcgcaatacggcaccgaggacgcgagcgtcaatgcttccatgccgagcatcagcggcaggccgatcagcggtacttcgtaatcgaagg

SEQ ID NO: 504053 - DNA, 292 bp, Homo sapiens
ccaggataagcactgcagaatcaggtctggggagggctgtcatcatagatggctgtgttttcacgtaacctgcatggcagaaggggcaaggaagctctttgggtcctattctataagggaactaatctcattcgtaagtgcagagccatcatgacttaatctccttcccaaaacactacctctgaatactatcacattgggggtgaagatttcagcaattttggagaaacataacccttcagactgtagtacttgtcttttacctttcttgataatgtcctttgatgctgga

SEQ ID NO: 504054 - DNA, 871 bp, Homo sapiens
  misc_feature (88)..(88): n is a, c, g, or t
  misc_feature (125)..(125): n is a, c, g, or t
  misc_feature (133)..(133): n is a, c, g, or t
  misc_feature (231)..(231): n is a, c, g, or t
  misc_feature (278)..(278): n is a, c, g, or t
  misc_feature (294)..(294): n is a, c, g, or t
  misc_feature (307)..(307): n is a, c, g, or t
  misc_feature (339)..(340): n is a, c, g, or t
  misc_feature (355)..(355): n is a, c, g, or t
  misc_feature (358)..(358): n is a, c, g, or t
  misc_feature (368)..(368): n is a, c, g, or t
  misc_feature (399)..(399): n is a, c, g, or t
  misc_feature (410)..(410): n is a, c, g, or t
  misc_feature (415)..(415): n is a, c, g, or t
  misc_feature (424)..(424): n is a, c, g, or t
  misc_feature (432)..(432): n is a, c, g, or t
  misc_feature (442)..(442): n is a, c, g, or t
  misc_feature (444)..(444): n is a, c, g, or t
  misc_feature (569)..(569): n is a, c, g, or t
  misc_feature (609)..(609): n is a, c, g, or t
  misc_feature (712)..(714): n is a, c, g, or t
  misc_feature (716)..(716): n is a, c, g, or t
  misc_feature (725)..(725): n is a, c, g, or t
  misc_feature (730)..(730): n is a, c, g, or t
  misc_feature (735)..(735): n is a, c, g, or t
  misc_feature (738)..(738): n is a, c, g, or t
  misc_feature (751)..(751): n is a, c, g, or t
  misc_feature (761)..(761): n is a, c, g, or t
  misc_feature (769)..(769): n is a, c, g, or t
  misc_feature (777)..(777): n is a, c, g, or t
  misc_feature (796)..(797): n is a, c, g, or t
  misc_feature (799)..(799): n is a, c, g, or t
  misc_feature (805)..(805): n is a, c, g, or t
  misc_feature (807)..(807): n is a, c, g, or t
  misc_feature (869)..(869): n is a, c, g, or t
gtctgcagtcggcagcctcgccggcagctcgctcggcccccgcttggcccggcccgcagttctctccccttgccaccatgagcgagtnatttgactgtgcaaaatgcaacgagtccctgtatggncgcaagtncatccagacagacagcggcccctactgtgtgccctgctatgacaatacctttgccaacacctgtgctgagtgccagcagcttatcgggcatgactcgngggagctgttctatgaagaccgccatttccacgagggctgcttccgntgctgccgctgccagngctcactagccgntgaacccttcacctgccaggacagtgagctgnnctgcaatgatgctantgnatgcgttttnctcgcagtgctccgcttgtggggagactgtnatgcctgggtnccggnagtggaaanggagccanacaggctgancnctgcttcctgtgcagtggctgtgaacagccactgggctcccgttcttttgtgcccgacaagggtgctcactactgcgtgccctgctatgagaacaagtttgctcctcgctgcgcccgctgcagcnagacgctgacacagggtggagtacataccgtgatcagccntggcatcgagaatgtctggtctgtaccggatgccagacgcccctggcagggcagcagttcacctcccgggatgaagatccctactgtgtggcctgtttttggnnnantctttgctnctaantgcancanctgcaacgccccnatcgtaagantcggtggnagcaaatnagtgtcctttgaaaaacgnnantggccncnaaaatgcttctcctgcgcccgctgctctaactccctggtggggccaggcttcgttacgggtnga

SEQ ID NO: 504055 - DNA, 355 bp, Homo sapiens
ggggtactgaggatcccctagagttaaccaggctcagctaaacgatatttggaggtcagcacggtgctcacgtgtcgacggaacttgtacagggaggcatgcaccgacaatgtaaatacacgtcgaccaggctccatctttaacgatatttggagatcagcacggtactcacgtagatcgacggaacttgtacagggagtgcatgcaccgcagtggtaaatacacgtcgagctggaggcatgcatgcatgaactggtactgaaggctcctctagagtcgcccaggctccagatataacaatatttggaggtacagcaaggagctcacgtgtcgccggaacttgtaccgggaggca

SEQ ID NO: 504056 - DNA, 183 bp, Homo sapiens
ggctgtttcacgggcgatggtcactcatattcggctcagaataaatctcttcaaatattttagagtttggcttttcgttgacagcacctatcacttcctgctgttttcgtttgtttgtttttgttttgttttgtttgaaacaagggtctcactctgtcccaggctggagtagagtggcacgat

SEQ ID NO: 504057 - DNA, 617 bp, Homo sapiens
  misc_feature (29)..(29): n is a, c, g, or t
  misc_feature (261)..(261): n is a, c, g, or t
  misc_feature (275)..(275): n is a, c, g, or t
  misc_feature (289)..(289): n is a, c, g, or t
  misc_feature (299)..(299): n is a, c, g, or t
  misc_feature (361)..(361): n is a, c, g, or t
  misc_feature (384)..(384): n is a, c, g, or t
  misc_feature (452)..(452): n is a, c, g, or t
  misc_feature (482)..(482): n is a, c, g, or t
  misc_feature (535)..(535): n is a, c, g, or t
  misc_feature (567)..(567): n is a, c, g, or t
  misc_feature (583)..(583): n is a, c, g, or t
  misc_feature (594)..(594): n is a, c, g, or t
  misc_feature (617)..(617): n is a, c, g, or t
cctatcatttcaatagatgcccaaaaagngtttaataaaaaacaatacccattcattatttaaaatacaacccttggcaatgtagtaatagaggggaatttcttcaacctaatgaatgattttgcccttgaaacacgaacatgtcacaacagaagtaggataacttctcttaccatttatattcagtaatatattgaagtttgtaaccagtgcattaaggggctttaacaaagtttaggaccacaaattagaaagaatganataagtaaaacggnttctggttggaagnaccagaaacnaccaaagtctacatacaaaaatgtttttaaaaccatcaaaaacccaccagaactgtaagcanttatattgaaaggttatttaatnaacgtgactgacaacattgtcacttggataattttcaatttgcatggtaatatttcataagaatttcnactattttaaaaagaaaaagcctttctatnatttagctgtaataaggtggaagctgtggaccaaccatgtgggctgagtattncatggctgagttggcgggatttaagtattcantatttattttgagacngagtcttactnttggcatccaggcttggagtgcn

SEQ ID NO: 504058 - DNA, 830 bp, Homo sapiens
  misc_feature (52)..(52): n is a, c, g, or t
  misc_feature (99)..(99): n is a, c, g, or t
  misc_feature (109)..(110): n is a, c, g, or t
  misc_feature (113)..(113): n is a, c, g, or t
  misc_feature (143)..(143): n is a, c, g, or t
  misc_feature (172)..(172): n is a, c, g, or t
  misc_feature (188)..(188): n is a, c, g, or t
  misc_feature (190)..(190): n is a, c, g, or t
  misc_feature (208)..(210): n is a, c, g, or t
  misc_feature (217)..(217): n is a, c, g, or t
  misc_feature (227)..(227): n is a, c, g, or t
  misc_feature (236)..(236): n is a, c, g, or t
  misc_feature (266)..(266): n is a, c, g, or t
  misc_feature (296)..(296): n is a, c, g, or t
  misc_feature (301)..(301): n is a, c, g, or t
  misc_feature (304)..(304): n is a, c, g, or t
  misc_feature (314)..(314): n is a, c, g, or t
  misc_feature (319)..(319): n is a, c, g, or t
  misc_feature (321)..(321): n is a, c, g, or t
  misc_feature (332)..(332): n is a, c, g, or t
  misc_feature (348)..(348): n is a, c, g, or t
  misc_feature (380)..(380): n is a, c, g, or t
  misc_feature (384)..(384): n is a, c, g, or t
  misc_feature (395)..(395): n is a, c, g, or t
  misc_feature (403)..(403): n is a, c, g, or t
  misc_feature (460)..(460): n is a, c, g, or t
  misc_feature (471)..(471): n is a, c, g, or t
  misc_feature (475)..(475): n is a, c, g, or t
  misc_feature (630)..(630): n is a, c, g, or t
  misc_feature (729)..(729): n is a, c, g, or t
  misc_feature (808)..(808): n is a, c, g, or t
cctgtgtacaggacagaccctggcacacaccaggtgccagtcaatatttgcngaaggaagtcacaaatagggatcagccatcattactttatcatcatnatcaacaggnnacnccactgtcctcacccaatcccctccaaaangctttgaagcagatgtcaacattaattcnctgtctcaggtgacancnctcatcctgaggccaggnnnggggggnggtgggaatngggggaganttgggtttcatgttccaggttccttgatancccccaccccacccagcaaggaaaaaccangaggnagnaaaggttaanttgantnttgttgttttnttataaatatattatntatatccaaaatatgatattaaaatattattncgtnttatagaaaanatattaangttttttattatttatattaaaaaagcaagcacttttaaaaaaaaataaaataaaanaatctctactntttnttttttgatatactctggccagaggggataccgtgtcctcttccaaatgaccaagatgctctgcaggggctgtgcctgtgaagacatcttggtattggaaacatcagctctggcagggtgggggcagcagagaagtaggggtctagacttgagcnggaggttccagcctcttctggccggctaccctcagacccctgctgagcttcaccatccttgggggacaggctaggctgaaggtggtggctggggctgtncacctgcccagcctcccggggtcagtatgcagggctgtggcagaacagtgctccacgacgcttaggtgtgcctgggggnttcccagaccactggggccaga

SEQ ID NO: 504059 - DNA, 163 bp, Homo sapiens
gttgtgggtagataacatagataaaatgaaacatgtagggctaatggtaaggaatgaagccaccagaggtgaagcacgggagactcatgctgaagagtttgcttctaatccaggggtaggggaagcccatcaggttaagcatacttagacaggatccatgctt

SEQ ID NO: 504060 - DNA, 108 bp, Homo sapiens
tactcatcgctaaacataaacactcacaagactcaacccctgcacccatgcctcaggatactcctcaatagtttatgctgtaatagtttatgctgtaatagttatatg

SEQ ID NO: 504061 - DNA, 741 bp, Homo sapiens
agtccgctcacccagcccagtccgtccggtcctcaccgcctgctggcggccaccccccaccgcagccatggacgccatcaagaagaagatgcagatgctgaagctggacaaggagaacgccatcgaccgcgccgagcaggccgaagccgacaagaagcaatgctgaggaccgctgcaagcagctgtgatggaggagcatgcaggccctccagaagaagctgaaggggacagaggatgagtgtggaaaagtattcttgaatccgtgaaggaggcccaggagaaactggagcaggccgagaagaaaggccactgatgctgaggcagatgtggcctccctgaacctgcgcattcagctggttgacggacggacgctggtgacctggtgcccagtgaagcgcctgtgctacatgccctgcagaagcttggatgtgagtgccgactgaaagtgcggctgatgagagcgatgagaggacatgaatggtcatcgaaaaccggggccatgaatggatgatctgcgacacgatgcgcactgcacggaagatgcacgctgaacgaggccaagcacatcgcctgaggatacagaccgcaacatatgaaccaggtggcacggcaacccggtgatcctggaaggagagctggagccgcacggaggacaggacctggcgtggccgacgactaaatgtgcggaccaacgaggacgacacgacaactcggaccaaccaaacatgacatccccaggag

SEQ ID NO: 504062 - DNA, 365 bp, Homo sapiens
gcgtccctggtagactaaccaagcacagctctgcttaattagctataccagggcgggggtacagggagaatcactgggaatagagtgtggctaccaatctacaagggccctggcctcagaatcctcctgggagagactacaggcaaggatgtttcctgagaagttagttgtgagagtgacagtccctgatttcaagcatggacgatggattaggggagtacattggaccaatctatccattaacctgccaggtcccttttgggataggttagcaagattgtgtggccatggaataccagaaaactcactgtcccatgcatatttaaaacctgaaactttggccttcttagtgttaggtctacctg

SEQ ID NO: 504063 - DNA, 262 bp, Homo sapiens
acctccagccaggagacaagtgatgagtgtccaccctctagacggggagagaaaagatacacaaaactggctgggtgcggtggctcatgcctgtaatcccagcactttgggaggccaaggtggtcaggtcacctgaggtcaggagttttgagaccaggctggccaacacggtgaaacccagccaaaaaataaaaatacaaaaaaattagccagatgtgatggcaggcacctgtaatcccagctctttgggaggctaaggcag

SEQ ID NO: 504064 - DNA, 126 bp, Homo sapiens
catactggaccttctcagtgtggtttcggtaaataattaacaacagataaactttcgaaataaccaaaattcaggagtaatcatgtgacaatgtgaaatgcatttgcaagatgtgaggatagaagg

SEQ ID NO: 504065 - DNA, 120 bp, Homo sapiens
tagttatggaagtggcttaggtgaattgagtagagggtcattccaattcctactgtataggtgtctgtgtctcaaacatttatttgtgaatccattggctaccactatggtggcctccaa

SEQ ID NO: 504066 - DNA, 230 bp, Homo sapiens
gtcgacgccgagaaagaccggcaaaaagcaactcttccttcgagccggagtcgaaccagcgacctaaggatgtctgtttattcaactacagtcctccgctctaccaactgagctatcgaaggtcgtgacgctggtcgggccacgggacgaagtgaaaagtggacgaatggacgtctatgagaaacagggaaaagatacgtccgagtagctgtaggagcgtaaaaaaagca

SEQ ID NO: 504067 - DNA, 1448 bp, Homo sapiens
  misc_feature (236)..(236): n is a, c, g, or t
gtgttgtttcgttcgttcggtgcaacatcacgccccggacgttgtggggagtcctctccaagggagggaagtataccacatgttgtctctcttggctgtttcttctacaccctcgcctaagagccagccttcgtggtagccgctgtgccctcccccgagattttttcccactaaacgccggaagttgttgcttgtctccccccattgtcttgccacaaacccccgttgtccctgcnccaagtgtgttagcgctctgttggggtgtataaccttcttcatacttggcgcgcccaccatagggttcgccctccgccacccccaaccatggtccccccaccacagccgttttatagtgtgtcccgctgtgtataaactacgtcctgtgtgtgcttttgtatgagagagaacaccaccggcgggcgttgtccttctccttatagtcgccacagcgtgttataaaagggctttttgtcgaaagacaatacattgtttatattctcttcggcggggaaaaagggcgccctctttcctcttcgtggatatgggggactagtgattaatatggggaaataaacaggaaatagttgcaccagccctttttgggggaggctcccacagaaaatttgtagtaaagctgatatctgtgtctgggaatgttatatcatcgaagcagggggaacacctcttgtcgaaagctcaccttctggttatggggctcctctttcgcgaatagacacccccctcttttttggggctccaccacatcgctatatctccccctctcacgcggagaggcaaaaagggctactcgaaagatctctcgaaaggtgtgtaaattaagattataccacatttgttggtgtgtcctcccctctgtgcccccctcggtgagatttgtacactctctgggactctggagagacacacactgtgctctcacagagactctctttgtggccacaccacactctgcctctgtgtcacttttcacatactgtctctctcccacacttgtgcacacctgcgagggaataagcgctgcgtgatctctagagaagtacaccacttgttcttctaacctctctcaactctccacagagaagaagtataggtgttgtaagggcacaggtgtgtcacaaagaaagaaaatctcccccacagcttctaagacacctgtggtggtccacaatatggcacgccactgaggccacacaccactggtgattgaacacactggggagtgtggctggtttgaaactgaagaatatatgcctgtaacgtgtaaaaatacacccaccacgacttcacagaggccttcacagtgaaaaaagaatgtaaaattttttattaatactttcttatattgattaagcaaatgattgtaaatgataaccttttacataatgagttaaataaaatgcattacaaaattgaaaaataaaaataaa

SEQ ID NO: 504068 - DNA, 332 bp, Homo sapiens
ccgttgacagtgctgctgaattgttgatgacaagattgtcctctttgaggtaccagtccatctcctgaggaaggcctgtgagatgaatttgaccttatagatcattctgacttacacatttagtactgtagccctagtctgaagactctgtgcaaactggccgtgattcagaataacctagaccagtcctgtttgcctcacgatatcaggtgggagctgaatgccatgaccaccaacagcaatatcagtcgccccatcgtctcctcccatgggtaggaggaagtttctgccacctcccctcctgagcctgctgtcatcttcactgacaacgg

SEQ ID NO: 504069 - DNA, 148 bp, Homo sapiens
taacacaacatcactccaaacaccctcctacctcccctcgcatacaccatcacaccacccatcacctcaacccactcacacatacacactcccactcaccactcacccaacagacaactgataatcactatagggccctaggttttat

SEQ ID NO: 504070 - DNA, 244 bp, Homo sapiens
gattcagaggaagcgggacattcaatgggaaatggccaggccaacacaccctgcaaagaccacgatgctgggagaaaagccaggcccttggcccatatggccagttgaggcgggaattttcccaagcaccagccccacagaaagtgattttccgtggtcctcagagagcatcacatccctccaacatcaaagaattctgtggaaaatcaggcttccgtcaccttccagtaatgtgggctggtcg

SEQ ID NO: 504071 - DNA, 733 bp, Homo sapiens
taaatggggcttgggtgagggaggtaggtggtagttggtgtttaatattttaagtggggtgatgagaaatagtgtaaggagtatgggggtaataatggggggccatacggtagtatttagtgggggcatgggagtaggttaaggtaatgtacgtagtctaggccatatgtgtgtggaaattgacaactagtagggctaggccccccgctgcttcgcaggcggcaaagactagtatggcaataggcacaatatgggctaaaagggagtgggtgtgagggttatgagagtagctataatgaacagcgatagtattatcccttctaggcatagtagggaggatatgaggtgtgagcgaaatacaagtatccctaaaagtgagagggtaacggctcagtataatatttatggtaaagccgagcgtccgccgttgcccgtgcgcctctggcctccgcgccagggccggcctcaaccccgggaggcggtgaaacgcaagatccaggcctgcagcagcaggcggacgaggcgaaaaaccgcgcgcagggcctgcaggggaagcttgaacggaaagcgcaagcggcgcaaaaaagctgaaggtgattgtgggcgccctcaaccgaagcatccagctccgttgagagaggacttggaccggggccaggaacgagtgtcccagggcctgaaaactggaggggcacaaaagtgcatgaagtggcaacggcaagaggggtaaaac

SEQ ID NO: 504072 - DNA, 137 bp, Homo sapiens
tccccctacacgttggtatgacgaagacttccggactcatgttgatcggaaacactcaaccccgctgtaatgaggtaaccgaggtgatcgtcacatcagtaccaggccaagagctacaggtagaagtctttgacaag

SEQ ID NO: 504073 - DNA, 1177 bp, Homo sapiens
  misc_feature (181)..(181): n is a, c, g, or t
  misc_feature (609)..(609): n is a, c, g, or t
  misc_feature (646)..(646): n is a, c, g, or t
  misc_feature (693)..(693): n is a, c, g, or t
  misc_feature (721)..(721): n is a, c, g, or t
  misc_feature (755)..(755): n is a, c, g, or t
  misc_feature (886)..(886): n is a, c, g, or t
  misc_feature (891)..(891): n is a, c, g, or t
ggctccggtcaaccgctccggcaacgccaaccgctccgctgcgcgcaggctgggctgcaggctctcggctgcagcgctgggtggatctaggatccggcttccaacatgtggcagctctgggcctccctctgctgcctgctggtgttggccaatgcccggagcaggccctctttccatcccntgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatactgctgaagcttggaacttctggacaagaaaaggcctggtntctggtggcctctatgaatcccatgtagggtgcagancgtactccataccctccctgtgagcaccacgtcgaacgggtcccggnccccatgcacgggggagggagatacccncaagtgtagcaagatctgtgagcctgggtacagnccgagctacaaacaggacaagcgctacggatacaattcctacagcgtctccaatagcgagaaggacatcatggccgagatctacaaaaacggcccgtggagggagctttctctgtgtatcggacttcctgntctanaagtcaggagtgtaccaacacgtcaccggagagatgatgggtgggcatgccatccggatcctgggctggggagtggcgaaggacaccctactggtggttgcatcggaaacactgactggggtgacatgggtcttaaatacccgaggcaggacacgtgggaccgcacacatggggggggaaccggccgagcagcggaaaaataatgcgggcgtggcactgcggccacaggaaaacgtaatcagcacacaaaaagaggaggcaggaacaacccggaaactgacgtgga

SEQ ID NO: 504074 - DNA, 337 bp, Homo sapiens
  misc_feature (43)..(43): n is a, c, g, or t
  misc_feature (69)..(69): n is a, c, g, or t
  misc_feature (71)..(71): n is a, c, g, or t
  misc_feature (88)..(88): n is a, c, g, or t
  misc_feature (90)..(90): n is a, c, g, or t
  misc_feature (101)..(101): n is a, c, g, or t
  misc_feature (128)..(129): n is a, c, g, or t
  misc_feature (132)..(132): n is a, c, g, or t
  misc_feature (145)..(145): n is a, c, g, or t
  misc_feature (163)..(163): n is a, c, g, or t
  misc_feature (168)..(168): n is a, c, g, or t
  misc_feature (229)..(229): n is a, c, g, or t
  misc_feature (251)..(251): n is a, c, g, or t
  misc_feature (306)..(306): n is a, c, g, or t
aagaaatcttattttagtatagctacagctgcagtagcttttnagtatgtatcaacatttcattataantnatagcttcctggttctntntctcagctgtntcagaactttcagccaagttaaatctnnccnggtgttgaaactnttagtaagttgagtaagntattnccctccctacggtaatccacaatctgttctttgtgtgggttgacacctatttataattctnaaaataagggtagctcaaaggngccaagtacagtagtttagcttgctactgttgagcatgaatagcagtaggttgtnttcattaatgcagttttcataatgtctccca

SEQ ID NO: 504075 - DNA, 293 bp, Homo sapiens
  misc_feature (90)..(90): n is a, c, g, or t
  misc_feature (271)..(271): n is a, c, g, or t
ttggcctcccagagtgccaggattataggcatgagccactgtgtctggcctgtcttcacatcttgacagaagaagatttaccatagaggnagaatcatggaggaatgtacctgcctgcagagacatggtcttgctctgtcacccaggctacagtgcagtggcatcatcacggctcgcggcagtctcgacttcctgggctcaagggactcccatctcagcctcctgcatagccgggactacaggtacgcaccaacattgcccagcttaattntaaaatatatatatatatatat

SEQ ID NO: 504076 - DNA, 1289 bp, Homo sapiens
  misc_feature (141)..(141): n is a, c, g, or t
  misc_feature (293)..(293): n is a, c, g, or t
  misc_feature (721)..(721): n is a, c, g, or t
  misc_feature (758)..(758): n is a, c, g, or t
  misc_feature (805)..(805): n is a, c, g, or t
  misc_feature (833)..(833): n is a, c, g, or t
  misc_feature (867)..(867): n is a, c, g, or t
  misc_feature (998)..(998): n is a, c, g, or t
  misc_feature (1003)..(1003): n is a, c, g, or t
ggctccggtcaaccgctccggcaacgccaaccgctccgctgcgcgcaggctgggctgcaggctctcggctgcagcgcgtgggcgtggatgctgcaggtgggtgcgaccagcggtgcctcacggcagcctcagcgcacccangactggtaacgcgagtcctggcttcccaccttcagccatcccgacgtatgggtggatctaggatccggcttccaacatgtggcagctctgggcctccctctgctgcctgctggtgttggccaatgcccggagcaggccctctttccatcccntgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatactgctgaagcttggaacttctggacaagaaaaggcctggtntctggtggcctctatgaatcccatgtagggtgcagancgtactccataccctccctgtgagcaccacgtcgaacgggtcccggnccccatgcacgggggagggagatacccncaagtgtagcaagatctgtgagcctgggtacagnccgagctacaaacaggacaagcgctacggatacaattcctacagcgtctccaatagcgagaaggacatcatggccgagatctacaaaaacggcccgtggagggagctttctctgtgtatcggacttcctgntctanaagtcaggagtgtaccaacacgtcaccggagagatgatgggtgggcatgccatccggatcctgggctggggagtggcgaaggacaccctactggtggttgcatcggaaacactgactggggtgacatgggtcttaaatacccgaggcaggacacgtgggaccgcacacatggggggggaaccggccgagcagcggaaaaataatgcgggcgtggcactgcggccacaggaaaacgtaatcagcacacaaaaagaggaggcaggaacaacccggaaactgacgtgga

SEQ ID NO: 504077 - DNA, 1120 bp, Homo sapiens
  misc_feature (181)..(181): n is a, c, g, or t
  misc_feature (636)..(636): n is a, c, g, or t
  misc_feature (664)..(664): n is a, c, g, or t
  misc_feature (698)..(698): n is a, c, g, or t
  misc_feature (829)..(829): n is a, c, g, or t
  misc_feature (834)..(834): n is a, c, g, or t
ggctccggtcaaccgctccggcaacgccaaccgctccgctgcgcgcaggctgggctgcaggctctcggctgcagcgctgggtggatctaggatccggcttccaacatgtggcagctctgggcctccctctgctgcctgctggtgttggccaatgcccggagcaggccctctttccatcccntgtcggatgagctggtcaactatgtcaacaaacggaataccacgtggcaggccgggcacaacttctacaacgtggacatgagctacttgaagaggctatgtggtaccttcctgggtgggcccaagccaccccagagagttatgtttaccgaggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatactgctgaagcttggaacttctggacaagcataccctccctgtgagcaccacgtcgaacgggtcccggnccccatgcacgggggagggagatacccncaagtgtagcaagatctgtgagcctgggtacagnccgagctacaaacaggacaagcgctacggatacaattcctacagcgtctccaatagcgagaaggacatcatggccgagatctacaaaaacggcccgtggagggagctttctctgtgtatcggacttcctgntctanaagtcaggagtgtaccaacacgtcaccggagagatgatgggtgggcatgccatccggatcctgggctggggagtggcgaaggacaccctactggtggttgcatcggaaacactgactggggtgacatgggtcttaaatacccgaggcaggacacgtgggaccgcacacatggggggggaaccggccgagcagcggaaaaataatgcgggcgtggcactgcggccacaggaaaacgtaatcagcacacaaaaagaggaggcaggaacaacccggaaactgacgtgga

SEQ ID NO: 504078 - DNA, 1042 bp, Homo sapiens
  misc_feature (181)..(181): n is a, c, g, or t
  misc_feature (558)..(558): n is a, c, g, or t
  misc_feature (586)..(586): n is a, c, g, or t
  misc_feature (620)..(620): n is a, c, g, or t
  misc_feature (751)..(751): n is a, c, g, or t
  misc_feature (756)..(756): n is a, c, g, or t
ggctccggtcaaccgctccggcaacgccaaccgctccgctgcgcgcaggctgggctgcaggctctcggctgcagcgctgggtggatctaggatccggcttccaacatgtggcagctctgggcctccctctgctgcctgctggtgttggccaatgcccggagcaggccctctttccatcccntgtcggatgagctggtcaactatgtcaacaaacggaataccacgtggcaggccgggcacaacttctacaacgtggacctgaagctgcctgcaagcttcgatgcacgggaacaatggccacagtgtcccaccatcaaagagatcagagaccagggctcctgtggctcctgctgggccttcggggctgtggaagccatctctgaccggatctgcatccacaccaatgcgcacgtcagcgtggaggtgtcggcggaggacctgctcacatgctgtggcagcatgtgtggggacggctgtaatggtggctatactgctgaagcttggaacttctggacaagcataccctccctgtgagcaccacgtcgaacgggtcccggnccccatgcacgggggagggagatacccncaagtgtagcaagatctgtgagcctgggtacagnccgagctacaaacaggacaagcgctacggatacaattcctacagcgtctccaatagcgagaaggacatcatggccgagatctacaaaaacggcccgtggagggagctttctctgtgtatcggacttcctgntctanaagtcaggagtgtaccaacacgtcaccggagagatgatgggtgggcatgccatccggatcctgggctggggagtggcgaaggacaccctactggtggttgcatcggaaacactgactggggtgacatgggtcttaaatacccgaggcaggacacgtgggaccgcacacatggggggggaaccggccgagcagcggaaaaataatgcgggcgtggcactgcggccacaggaaaacgtaatcagcacacaaaaagaggaggcaggaacaacccggaaactgacgtgga

SEQ ID NO: 504079 - DNA, 174 bp, Homo sapiens
tcccacctttggccgtcccgtgcatcttagtcaacacaatgcctgtaagcatccgaatgaaatccttaaagagtttggcttgctgtaaacgcattttgacccgttcgttgctatccaaaacaaagcaaggccttcaatgcgggtgcatcttggaattttgcgttgaattaatcg

SEQ ID NO: 504080 - DNA, 348 bp, Homo sapiens
  misc_feature (16)..(18): n is a, c, g, or t
  misc_feature (24)..(24): n is a, c, g, or t
aaatggaaacagtctnnnaagttnttgtgaggattaattaacagaatgtacacaaagtgcttgccaatagtaggtgctcaatacatgctccgatgacctgcatatcaccatgggactggcagtggtggctcacccatgaggccatggtggactctctcctccagcgcaggcacgatctccctgtggctgtgtctgctctgatgcccgtccatgtgctgagaagcacccccagctgtgagcaccaagctcccagcctcccactctccctgcagccaaggagccctgcaccaagagctgctcctgggttagcacggtccgtcctgcccactcgcctgggagatagagaag

SEQ ID NO: 504081 - DNA, 93 bp, Homo sapiens
ctagaagattcagcaaagtacttttgtgctcttggcgctccccttcctagcccggaaaggtactgggggatacggatggattcggccctgatc

SEQ ID NO: 504082 - DNA, 356 bp, Homo sapiens
gagagaactagtctcgagttgttagttatttttgtttttcgttttttttccctacgctcctgactatcctcaactaggggacccttttcttccgacttgccttgcggacctctgatatctctttcaggtactggatctccttggccagggaatgcgccctctcttttagagcctggttcttattttccagctcttggcactcaccagagagagccttctgttccgccctcttcttctggcggtacctagtggctgctgacttgcaatgctccattgttttcagcttcttatccaggttataaccctttacttttgctgctaccatcttctctccaggaggatcgcggatttggcgg

SEQ ID NO: 504083 - DNA, 970 bp, Homo sapiens
ccggtcggtagtcgtcgccccagcccgccgggggctgcagcgcccgagctcgccggcctcgaggacgggcaccgatgagcatcatgggcagcatcgtgtcccgcgtctccgcgctccgtgctgtttctgctgtttgtctgcctgcgccgggtcctgaggctagtcctgctgggggccgatgctcaccttcgagctgccggacaatgccaagcagtgcttccacgaggaggtggtagcagggcgtgaatgaattctcccatggattatccaggtcatcactggagagccactacccactgttgattgctagtgtaagaggatccccaggggaacaccatctacatgagtaattacgaaacaagcagtacgacagcgttcacgtaccggcgctgaagaagtcaaccggcgtgttatcagttgttgcttcagttaatgagttttgccacacgttctctcacatagaccgtctatcgtttgatctttcaaagtgacgcggatgagctctcccattctcccagactatggggaacagggtcacagagtctcatccagatggatgtcctgactgcgtgaccatccatgaggctctgaaaacggtgatagactcccagacgcattaccggctgccgggaggccaggaccgtgcccgagcggaagaccttaattagcgagtctctttactggtctgtgggggcgacgatctgaattgcccctggttcgtggtcagctatcacgtcaggtgctactgtttgaaaagcttcctttcccagtaaaacggccattcggcgggggagtcccattctatgcccggatcttgtcctagggccctttgtccccgggtggagcgcgcctctatgtaaccctgtgggcggtccctacccggggggcccaaatcgtgggggccgtcttctgccagcgttttgcccccgtgggccaacccagccgcgtttgtgggaaaatcggcctgggc

SEQ ID NO: 504084 - DNA, 452 bp, Homo sapiens
tcaagtagtaactcacgaaacataacacgattttaaaatggggagacactctgactagacatgactccaaagaagatatacaacgcagaccaataaacatgaaaacatgctcaactcttattactcatttaacacaatgcaaatcaaaaccaatgagaaagcactccacatccatcaggaaggcaataactagagagacagattacaataagtgtttagtgaaaatgtgtggaaactggacccctcgacattgctggcacggaatataaaatgatgctgtcctttgacaagcagtctggcactttgtcaaaaagtgaaacacggggatgccatataactatagcaattgcactcctagatctggagaaatgacatcatgtgaaacgcttgtatgtgaacgctcagagcagccttatttagaacagccaaaacgtggaaacgacctaaatccc

SEQ ID NO: 504085 - DNA, 552 bp, Homo sapiens
aatgtgaggattgggaacttccctttcagctcaatcttcacaaaattacatatactatacctgagggggaaatgtaactttaaaaagagttacaacatctttcaaataaagcaaattccgactgtaggaaaataaattatcacttgatattggggtatatgtttgttaaatcacttggcacatctgcgggcagaaactccattcactaagtaaacgaaggaacttttttcttccaagggctgggaccaaatttcctgtgcaaaaaccttcctgtataagggaaacctgtcattctcccagcaaaggataattgatattagagagtgtgtaaaacaaaaattccactttattccccaaattatttggcccccatacagggttagaaaacctggcccttccgaaattcttgcgtaaaaggacttttatttgttttttaggggggagaaaattagaccaacacatttttgggggcacatggtgggttccctggcccttacccttaattaatttgaccaaggggagacaaaatggggtctttcgggaaaggagggc

SEQ ID NO: 504086 - DNA, 709 bp, Homo sapiens
  misc_feature (110)..(111): n is a, c, g, or t
  misc_feature (215)..(215): n is a, c, g, or t
  misc_feature (226)..(226): n is a, c, g, or t
agcggattcttccggtggagatggctgcggccgtggcggggatgctgcgagggggtctcctgccccaggcgggccggctgcctaccctccagactgtccgctatggctcnnaggctgttacccgccaccgtcgtgtgatgcactttcagcggcagaagctgatggctgtgactgacatatatccccccgaaaccagccatccacccatcatgccntgccatctccntcccagccccccacaggaggagataggcgcatcatacaggtcttgctccgcctcggcgagatagcaggcatgctttgtgccacgtgactagaccgatatgtgattagtcccggtcatgcgcaggaagtgtgtggcttctgagatggtcgaggacgggaacaaagtctgtcattagttgcgatgatcctagcctggcgggtagaacgagcgaaagattgcgctgtagtgagacggtcttcgcccgaaccaggtccgtgaggcccttccgtggaggattccaagtaccaaaatctgctgctccctttttgtggggcacaacgatgcatgctggtcagtgacgagcccaatggtcacggagatggtacggatcttaaggactgtgccattcctggccgcgtgctacagtggctgcgttgatgacagccatacctgcagcaggcagggctttatcaaactactccaagctccccagacctgcccctg

SEQ ID NO: 504087 - DNA, 689 bp, Homo sapiens
  misc_feature (195)..(195): n is a, c, g, or t
  misc_feature (206)..(206): n is a, c, g, or t
agcggattcttccggtggagatggctgcggccgtggcggggatgctgcgagggggtctcctgccccaggcgggccggctgcctaccctccaaggctgttacccgccaccgtcgtgtgatgcactttcagcggcagaagctgatggctgtgactgacatatatccccccgaaaccagccatccacccatcatgccntgccatctccntcccagccccccacaggaggagataggcgcatcatacaggtcttgctccgcctcggcgagatagcaggcatgctttgtgccacgtgactagaccgatatgtgattagtcccggtcatgcgcaggaagtgtgtggcttctgagatggtcgaggacgggaacaaagtctgtcattagttgcgatgatcctagcctggcgggtagaacgagcgaaagattgcgctgtagtgagacggtcttcgcccgaaccaggtccgtgaggcccttccgtggaggattccaagtaccaaaatctgctgctccctttttgtggggcacaacgatgcatgctggtcagtgacgagcccaatggtcacggagatggtacggatcttaaggactgtgccattcctggccgcgtgctacagtggctgcgttgatgacagccatacctgcagcaggcagggctttatcaaactactccaagctccccagacctgcccctg

SEQ ID NO: 504088 - DNA, 284 bp, Homo sapiens
gaacgcttcaggacgatgtagaggacccccgggccctaagcatttggatgatgacgaagatctttacgaatccagcatacatacctcggaaagggcgtggtctttgagcatgatcttcgagggcaaactcaggaggaggaagccagacccacggagagccagcagcccgctatggaaggatgagggtcgctgggagcatgacaagttccgggaagatgagcaggccccaaagtcccgacaggagctcattgctctttatggttatgacattcgctcagctcata

SEQ ID NO: 504089 - DNA, 413 bp, Homo sapiens
tcacgccggttatcctaggacttcggatgaccaaggcaagcagatcacttgaggtcaagaggtcatatccaggctagccaacatggtgaaaccctgactctactaaaactactaaaaaatcagccgggcgtagtggcaggtgcctgtaatcccagttactcagcagcttgaagcaggagaattgctggaacccagcatgcgtaggctgcatgtagctgaggtcccgtcaccattgcactacagcactgcgaaacagagcacgactccatctcaaaatatcaatcagtctctaaccatgtcagcccgctagtcctattagcttctagactagagtacgcttatgcatgcaaccgcacttcgagcttacttgaccattcggccatatcgcgagacgatttaccttcactgccgcg

SEQ ID NO: 504090 - DNA, 526 bp, Homo sapiens
  misc_feature (342)..(342): n is a, c, g, or t
gccgcgggaggatgaggcaactcccatcagattagaaagatgttaacactgtaacaaaagtggggctcgaggaaggggaaaagcgcagctctctttttaagacgccagaaagtagtcagacatgctaagaacaaaacaaacacaaacgaaaaccagcaaagaaagctcttcgagaagagtaaggctactgatctttaggaatcaaatcattatttccacacatgtcatgaagaacacagacattaaagcacaaaggagaaacttaaatgaaagtaggagggagaagtcaaagctcaagtaaagagatttttaacctagagaggctgagttatcaaggaaganagaaggccaagccagcttgttgcagaatgttccagaagataagataatgatagacttaaataaatagggactgatcaaggtgatagcgagttcttggtgaaattgcttccaaggattttatagaagtgtatttcatggaaatgtacagtaaccggatgactgtattaaaattttaaaactgcaa

SEQ ID NO: 504091 - DNA, 110 bp, Homo sapiens
  misc_feature (6)..(6): n is a, c, g, or t
  misc_feature (10)..(10): n is a, c, g, or t
  misc_feature (15)..(15): n is a, c, g, or t
acacangtangtaancaaagtaaattcgtgtcacgagtagtatagtacgtaagtgtgtaacgtgtaaactgtttttgggtaaagtcgtctgcgacaaaagtacgctacca

SEQ ID NO: 504092 - DNA, 105 bp, Homo sapiens
agctcctccaggaggcctcctaaagcccttggatggctgggtacacaccagtgttcctgtcagctgtgtgacaggcgggtgttggaatgatccacacgttagtgc

SEQ ID NO: 504093 - DNA, 482 bp, Homo sapiens
ccccttctcttccccgaggctatgtccacccggtgcggcgaggcgggcagcgccagaggcacgcagccgcacaggggctacagagcccacaatcagccctacaagatgcacttaggacccccgcggctggaagaatgagcttgtccttcctcctcctcctcttcttcagccacctgatcctcagcgcctgggctcacggggagaagcgtctcgcccccaaagggcaacccggacccgctgccactgataggaaccctagaggctccagcagcagacagagcagcagtagcgctatgtcttcctcttgtgcctcctcctcccccgcagattttttgggcaagccacggaagttgttttgttccaaacaattttccatgggaccccctggggggcccgacccgcagccctttctgtagagggggcatcggatttccatctcgaaatactacaccctacggggggggggaacggatcccaacaac

SEQ ID NO: 504094 - DNA, 159 bp, Homo sapiens
ggcgtagctttcgatcacgccgctgtacatcggggaacgttcaggccgccgcggatatgtcatgggtgcgggcgttggtatgcgtgatccagcacggcaactgccgggggatgcatggccacactacccatgtacgaaaacaccggaatcggatccagg

SEQ ID NO: 504095 - DNA, 194 bp, Homo sapiens
ctagtcgacgccgacggtgtcagtgatttgggaatattgcacaggagttattctaaagttaagagtcatgtgactattaggcgaactgttttagaagaaattggaaatagagttacaaccagagcagcacaagtagataagaaagctcagaaaaccaaagttccagttcagaccctcagttcagaccggggact

SEQ ID NO: 504096 - DNA, 1403 bp, Homo sapiens
  misc_feature (578)..(578): n is a, c, g, or t
ggtcgacggcgacctgcgtcagttaggtgctcgaactgcagtacccggcagtgccggtacatgtctgcgagatggaatttgtcttgccattgtctctggctgcttaaaaccaacctagtgacgagctccagatctcggtggtgcggcgtgacctgtcgcgtgcgcaccgcggtacactgcgtgtgttcttcctggttgaccgtgggcgcgtactggtcctcggtctagcgtgctcttccagtcgtagtggacctttccttctgtcatgcggcttcttcatagtcgcgcgcgttcatcctcgttgctgtggccgtaggtcttcgatcgcatacgtcggtgtttgaccattgagaaaactaccagacgtgaagtccccagaatttaaactaaaagcctaggagtcatcacgaaggagtcgagattgtctgccgcagaaggcggagccacctattgactgcaagttagtggtcggttctagcctatacaaccccataccttgcccattcaagggcttccgatcgatgggacgaccttcccggttcggcggcgttgaagaattcaggatatcgttcaagctngttacccttcttacctatgtacagaaagttaagagaacgtatgcgtacacccaaagaaacgtccggtgtcgacacagtctctctattgagaaggtcatggtgattgcggacatagccaatgtaaggccccccatgcggagagaaatttgttgtgaccctaataaagttggccgctatacccacagatgggagaggaccaccggaaaggaagagactttagcagcgcagggcatataccccaagcaattatcgtatatccttaccgtaatagagaagaagtatgcaaacccccgagttagaaaggggggccggcagaccacacgcctttttagcagtggttcgtaggtatggcgtggatataccagaacgttagtcctcctccagtagccaacaggaggtgtatactcaaacagattcgccagtgcaggttccataggcggcaatgtctgaaacttatgcgtagatgacagaatcccccatgatgttgggacactatgaagcaccacagttcttactcgtttcagaatccattcccccagtttgcggaaaggcgcatacgagtatagtttatcccgacatatccgttggagagaggaattccatggccaaaatcggaacagaacatcttctggaaggaccttattgggcgcggacatatgcgggcggccacggacagcctatagagcagaagcagggaaggtaaactcgattcctaaccagaaccgaaggcgttaggcaacctcgccaagaggcaaagagagcagcccctatacagaaggcagtggtgcttttgcggccacatcgctctcatagtgggcacccacg

SEQ ID NO: 504097 - DNA, 228 bp, Homo sapiens
  misc_feature (3)..(3): n is a, c, g, or t
gcnagttaccaatgttctgtctcagcctctgacactctagcgtgtcaaacaggactatgctgaatctgttgctgccagagtctctgtgctgaacatgacgtacttgaccgatgtctgcaatgcgtgacgatactagatttcatgagcgtagaatcgtccagtgtgtgatatgagttctttacctatagaccccaagacgtgcgcagtgctcctgataccgatcatgtc

SEQ ID NO: 504098 - DNA, 1012 bp, Homo sapiens
  misc_feature (544)..(544): n is a, c, g, or t
cctcgctcctaccccgttggggggtccatgacgcaactccgccttgtgggtcagtgtcccctcctggagggaggcccgtcgtcactcaaatgttagtgattttttcaaagcgggatttatatctggggtgtcctctgttgtttcccctcgagcgctagttgcaagctggtagattttctgctccaccaagggggtgttcttactacatgtgtcgggcggcgtgcctgccgcaaccctctctccccggagagagtgttttatagtcgtggggcgccccccacgttttttttgttggggcgcgcgagtgggtggatttctctgtttccatctgtcttgtcccccgcggtttgtccctgctttgacgagcttcgaccgcttctctttttttcgcggcgagcgtgtgtttttgtgtgcccgctccttgatctatctctggccgcacccgtcagtctcgcactggtggtgcgacagagatagatgagtgtgttccctctcacagaccagcgtctcactacctgcggcggccgcccccccacgttctganttttgttgtgtcgggagcaaacgaccgttcgctcgcctcgcgcctcagggcgcttcgatctcccctcgcgccccggtggtcgcctcgccagataagaggttctcaccatctgcacagagagatcgccggtgatcctccccctagaggcacacggcacgcgttgctcccacaccccaccgctgtggagaaaaaaatcactgcaaatgctggttgttttcttggcagtccggcaataatactgacttttctttatgtaaatatcaccacgaaataattagcaaggagggttccgccatcttaagatagtttttatggcagataatttcctttgggggagaaaagaaaaagagggtttttttttcccccatatttaattttttggccttcgtggaacacaaagcggtcatttttggggcttttcccaaccatttttttatttttatttacatcacggttttgccttttcca

SEQ ID NO: 504099 - DNA, 324 bp, Homo sapiens
attgaacaatgacttaccgtgtaggctctcagacttgaaatgcagtagactctgacatctgattagtaccttaaagacgtgcttattccactagagctgttctcgctgttctctgaggacatatatatgtatactagcattcttagatattaatcatggccaagcttttgcactgaaactcaaaagttaccttacagtatgtcccgaagacgacatcacattacattatgggggaaactactagttaagactctaaaacgcacacaaggctgagtgcagtggctcatgcctgtaatcccagcacttcgcgcacgcgctgagagg

SEQ ID NO: 504100 - DNA, 165 bp, Homo sapiens
aaagtttcaggttccaggaaagcccccaggcctggggtgttggtccccctagcagctgaggggcttttcaatacaaaattagtttttgtgccctggagatgaatatacttttatttgtaacatgtgaaaacatctataaaccttttctgaagcctgttttgtcca

SEQ ID NO: 504101 - DNA, 169 bp, Homo sapiens
taatacgcaagtatgacagaggacacacattttccccatccaagagtgctctggcatccaatccaaacaccaggatacaatttatggtcccaaattctatatgaaaaccagacagttcagagcatcagccaaggccattttgagtacgacttcctaccaaactattccc

SEQ ID NO: 504102 - DNA, 116 bp, Homo sapiens
gcttctgccgctcctgcttctcgcttctgcttctgccgcttctgcttctgctgcttcctgcttctgccttcctcttctgcttcctgcttctgcccccgctccaggtcttggtgagg

SEQ ID NO: 504103 - DNA, 396 bp, Homo sapiens
  misc_feature (273)..(273): n is a, c, g, or t
aacgggtgatgcggttggctctgttttgaactactgcgagtatagatggtgaaaaggtgggtgagaaacagacgctgtggatgaaagctggagttcttcaaatatgctgagcatgagccgtccaactcctctccgagcaggtagctgcttacctgcgttcaatgaggagagaggagtcatggctggggatgtgattttgggtatcatctgattctagagaacaggacacacctatttcatgcttagtgcacttaggactagagatagcagatntctgcgccacatctatcgtctgaggtctgctggtaaaggaggatgacacagggggcagccagagagcagcaggaaaaacctgtgtgtgtcttcagagaagcccagattagagatgttttcaag

SEQ ID NO: 504104 - DNA, 1909 bp, Homo sapiens
ccttattaggacagtcgtcggttgtgtagcagcttatagtctcgtttcatcgtgcacgtcgtgtctcatactactccggtcttgctgttctaatcctctgtctggctctcagtgttagtcactttctaccactacattagcttcatctagtcctatcatcaagtcgtagctatagctcgtcgcgtagtcagtggtttcatgcttctatcactcagactccatcctctgtatgagtttacttcgtcactcgatggttatggtccatcactataagaaagagattttctctcgtgtcttttttgttggtgtggacagacaaatatacatatatctattcgtcgtattgtggtcccacccaccgacgtggtgggtgttcgtttctgtccattctatcatagtttgtgtctggtgcggcgtctgtctgctccctccgggtgtgggtggttcttcggctccgtgccttcgctcgttcgtgagcgtaggttggctgtccgcttccctgcacggtacgtgttgcattcgatgtctcgtggtcgtgctcgaccgtctgtcgttctttatcatcgatgtttggcggggggggggatcgacacacccccactcttgcggtgggtggtgtggtgcgggccccgcctcactccacctccgcctagcgtgcttttagtctgtttgtattttgtttctttcctcccccatgtttttgttttggttccggatttcgcgtatgctatactgtctcttgtttgttgtcgtgcgtctttcgcagccaccctccctctctggtttggttgttttcgtctgtccctcgccctcttggtttgggtcttctgagacttttttggcttttcgtcgtatgatgttgtgccgttgctctcttgctccccacacgttttctcttctgtcctactccaccagtagttgtgttggtggtacttcgtcttcttgtctgtgttttgtgttgttgtcctggtgtgatacttctcttctgtgtgttgccgcgcgctcgggtgtgttggctcccgcccacagccctcgccgtcatgagttgactactctacccaccgttgctgtgtttgagtttctttctttgtatattattattattagcagcgcaggagcggatatatataatatatatgttctccgtcgcgtcggtcgtgggttgctagtgtggtaggttgtgtagactacctccccaacactcctctactcactacacatctcatgtcgctcgcgtcgcgcgtgcgagcaagagaacagaaaatattatgtatgagtggggtgagtacagagaggagcttcgtgtgtgtagcagactgtgtgtgtggtgctgttgggtatgtactcactcgcagcgcgcgtgagtctctctcacacacacagtgtgtgtgctctgctgctgtgtgtgtgtgtgtgtgtgtggcgcccgcgcgcacgcacatatgttcacacacgcctcgcatgtgtgtgacaccacccgcgcgcgctctcgggagaggacacacacgcctcactattttgtctctatataagagggggggagaaaagaaaatgcacatctatccactccctctgttctgtccgagcacacacactctctctcccacatagtttttcgtctctctctgtgtgtgtagagaataaatcacaccccacattgcattatatattgtgtgtgtgtagagagaggaggtgcgcccccaccgcgcgcttgtaagagaggaagaagagagagggatcctcctcgcttgttgtgaggggaccacacacctcttttttttaaaatctcttctgtggtgtatctttgtttgtggtgtccgccccccggttgcaagcatggaaaaagagagggggagggggggggttctcgccccaagattccccccccaatatttttttttttttttta

SEQ ID NO: 504105 - DNA, 138 bp, Homo sapiens
ctagcttctcgcggttggccttgtggttcatggcgggcctcggtcagcagcacggggtgctcctcgggtagccacacgcagcctcattgtagaaggtgtgcgtgccagattttctccatgtcgtcccagttggtgagc

SEQ ID NO: 504106 - DNA, 194 bp, Homo sapiens
ggaccgtgggctgtcacagattctaacagtatctcatagatcggaattcacaaacctgccacaatgacattggggctggatacttctattatgggcaggtcttatatatgtaggatgcttttgcagcatctcttgtcctcatctattagaaataaataggccagtcacagtggctcatgcttgtaatcccagca

SEQ ID NO: 504107 - DNA, 370 bp, Homo sapiens
  misc_feature (273)..(273): n is a, c, g, or t
  misc_feature (292)..(292): n is a, c, g, or t
  misc_feature (331)..(331): n is a, c, g, or t
atcaagttttaaaatattcaaaaaatggaaataatatcaaacatctactctgaccacaatgggataaaactagaaatcaataacaaggaattctgaaaaccatacaaatacattaaaattaaacaatatgcttctgaagaatcagtgggtcaatgaagaaaccgaaaaaaagttgaagaattccttgaaacagatgataatgaagacaccatctaccaaaacctatgaaatacagcaaaagcagtattatgaaagaagtttatagctaaaaanaaaaaatctaacagtgtgncttgaactagaaaagcaagagtaaaccaaaaccaaaatncagtaaataaaggaaatactcaaaggatggacaggcagg

SEQ ID NO: 504108 - DNA, 416 bp, Homo sapiens
  misc_feature (8)..(8): n is a, c, g, or t
  misc_feature (31)..(31): n is a, c, g, or t
  misc_feature (181)..(181): n is a, c, g, or t
  misc_feature (213)..(213): n is a, c, g, or t
cgaatctncattttctaaaaaagccaaaagntgccaacacacagagagaaagggcacagaagaaccttgaaaggaaatgaacctgtgactattgaagaaggcttgtcttgattatgaagtcagaattggaagatacccatgaatggatgtttgtttcagtgttgcactggcacttccttcntaaagattagagttgtgagtgtgaggaatggntatgagaagaccctaaagagatgtttgggtgacacgagtgaaccctaccctaaaatggtttaaagataacatgaagggtccttaaaataaattgaagaaatcctcaaatcttctggtgacctggatggacagcaaaggaatcaaatccctcaaataatttatttgacttaaattaaaaataaataaatatatacagtaaaaag

SEQ ID NO: 504109 - DNA, 171 bp, Homo sapiens
cccaggatatgttctatagacgtaagattacagcaatgatagatctctgcctcacggaagcacgaacgttcttctctagaggagaatatctataacaggcaagcttactatctccccggacactttcctacaccaagacttctccgaaatacgaccttatgccaagtgcta

SEQ ID NO: 504110 - DNA, 378 bp, Homo sapiens
ttttgcagaaccagaggatgcttctggaagttgtgactagacaggtggcacataagaaatccagtctacagacatctgcaaagcaaattgaggacaggatttttgaagtgaagcatcagcataggaaggtggaaaaccagatcaaaatggccaagatggttctgatgaatgagctgaacaaacaggccaatgggctaatagaggaattagaggggattactactgagagaaagcggaagctggaacagcagttacagagcatcatggttctcaaccgtcagtttgagcatgtgcagaatttcatcaactgggctgtctgcagcaaaaccagtgtcccttttcttttcagcaaagagctggtaagaggaatctcccaac

SEQ ID NO: 504111 - DNA, 919 bp, Homo sapiens
tgtccctggccttccaggccactgaggagggtagagaacctctcacacagcctggagttcctcagagtggcttctaggcacccagaactagtgcctctctggctgatcagatgagggacagaagagtggttctcaaagatgcccacatgacagccccaggtcctgtgtgtccttgccacagtggaggaccttgacaaggggacttagggtaggtaggcctgaaggattgagaaaggattgagaaagtctacaccaatgggtttagtgtggacacagggcccctcagaagtggacagaaagatgcccaggactgagtctctgttgctgacctgaagatgaggacatgaaatacattgaagagacttaggaggacagcacagctccagccagcaaagaagccaggatgtcacgcacgcccataaccacaaggagctgaaactggccaaagcctgagtatacagcaggcagaccatcagagccatgagggaggaggccagccagtggcccctggatctgacctatatgacgctgagcagagccagctaggtcgataacactgcaatcacgcatgcgtgtgtcaaccgaggcacatgggtgcatgggcagagccaccaaggtgtggtcagagtgagagaaagccagctttgaggattgacctgtgctctcggggcacggacggtctgaagcagaacccaaagggaacctggcgggctctgcttcaggggggaaacctccacgcattgggaattccaaccggctattccgggggtgtggaccccgggtgcggctatgttcttggggtggggtaaaccctctcttccgtgtaaaagggttatggcgctattaacggtgcaacatggcacagtcaccacgaggatgccccaatattgaacgcgagggagcggtgttacagaaaggc

SEQ ID NO: 504112 - DNA, 186 bp, Homo sapiens
atactggtcttgcagcgtgggcaatgctggagcattgtccatgggtattgagacatgtcatattagtatgctagcggtgagtggtacgaagtttttcataggaggtgtatgaattggtcgtaacggaatcggccgtatgctgttcgaattcataagaaaagggaggttagaagcagggtcttggtg

SEQ ID NO: 504113 - DNA, 320 bp, Homo sapiens
tcgacagcctgggggcactcactcgcggccagcgacagaccggcggccagaacctgttcgacccggccgacaatctcgaaagcgattatgcccgggaagcgctcaatcaatggtatcatctgctccatgacggcaagctcgccagcaccacgcttgaagccttcgttgaactgacggggctgaagctcgtcaatgccgacgacggttcgctgctcgagcatcttccgccgatccagcgttggctgaaccgtatcctcgcgctacgcatcgccacgcaaaatgctattttcgaggaatatctcgggcccatccaggcccgg

SEQ ID NO: 504114 - DNA, 461 bp, Homo sapiens
tggagtgcaggggcgcgatctcaactcactgcaacctccggctcccaggttcaagtgattttcctgcctcagcctcccaagtagctgggactacaggcgtgtgccaccatacccggctaattttttgtattttcagtaaagatggggtttcaacatgttagtcaggatggactcgatctcctgaccttatgatcggcccgcctcggccttccaaagtgctgggattactggcttgagccacaccgtgcccagcctctccctcttgtcctgttttagaattttattttattttttagtcaggcttcagaagggccctggaacatggctctgtgtgatctggcccctgcctacctctgccacatctcagagccctctgtcccacagctgcatcttcctgtcctctgccactcccagctccccctgccccacctctctgttccctctgtctggggcatcttcct

SEQ ID NO: 504115 - DNA, 340 bp, Homo sapiens
  misc_feature (1)..(1): n is a, c, g, or t
ncagtcattggatccgtaagcaactttgggtatcatatctcattcgcatagtagcctattcccaaacattgtgttcagcattcggaaacctcgtgtcgtaccgtgctcacggcatcatctgtgactcatggatgacaacctcacctgtagagcacagcatgtatccatcgtcatccagggtcgaagcttgaaagctacacccgtgggaccagcgtgcagtcacatctggatagggcattggctaagccgtcagctacaatccgctcagcacgctcgcgagaaagaggggttacaatgtcaggatatcagcataggctcctcaactccagctcaacgggag

SEQ ID NO: 504116 - DNA, 220 bp, Homo sapiens
gtaggtccgagcggcccggccagaggcagggcagttcgcgagcccagccgccgcttgtcgccggcagtagacagtccattcgtgcagtcagtcggctcgtcggcggaaccggtgcgtcagagggagcggatgccgcgggatcgctgacaagcccgagctccagcgcgcgaggccgtatgtcccctccgcgcgacggccagtgtgccagtagactggttgg

SEQ ID NO: 504117 - DNA, 810 bp, Homo sapiens
tggcattttaggaggctgaggttggagaatcgcttgaggccagaagtgcaagaccagcctgcgcaaacagcaagaccctgtctacaaaaaaaaaaaaaagtattctttatgcctcagactcccaggttagctgagacctacccacaccttggtcccagctactcgcggaggctgacggtgggcaaaatcacttttgcccaggaatttcaaggccgcaagtgagctatgatggcaccactgcacttccaggaaacagagttgagacccgtgtcttaaaaaaagaagggagaaaagtgttcagaagtggcatgatgaggttcggggggggaaatagcagcaagtggggactcaggcagttgttggcatggcgtgctatcccctcaccaagaaggatgacttgttgagccagggccagcctgggaaggttgcaggcgttgtctgacccgtggtggcaaaatcaggggacaaacgctttccaggcctgatggagaacaggccaacggcacgacggccgttgatgtctggccatgtgccacttgtcgcacgtgagcttgggaatacggggcagatgaaggatggtctgaaagacgcgtcggatcaggacaaacacacactgcctttatttaaagaccaaggtttgtacagcaacctgcctacaaagccttgaagctgtaagctgtaacatttggcactcaaaggcagaaggaagccaagcaatatgaagaaaaccctccttacctacacaaattggtccctataaacgaccatttgggcctgcatgtgcctaactccggcgcataaggaaggccg

SEQ ID NO: 504118 - DNA, 139 bp, Homo sapiens
ggatccctctagagacacatgatagcggattaggtttccctttaatcacatcaaagttcatggtgtccaaagcccgctcagcgtcggccggctgctggaagttgacgtacgcatagcccagtggagcggcgggtgatca

SEQ ID NO: 504119 - DNA, 319 bp, Homo sapiens
agctggggcccccattgggcacgcgaggtccaaaaggatggcatttgcccgccccacccctggcccttttgctgcctgcactcatttgccatggaccctcctaggataggaatgccctccttcctggccccctgccgccatcctgctagccacccacataatgaccatctcaacccaactatagtggccctctagagtctccatgcattcttactgccctagagtaggcagttcaccaaggcctttattccccggcccaggaaaagggtcagggagggaaggggctgttccacccctgagacctcatagacttgggata

SEQ ID NO: 504120 - DNA, 192 bp, Homo sapiens
gggtgcagccaatatgttgaacagtggaggttagtcagtgtacaatttcactttatacttgtgaacacattaggcagtttctgtaaagcatccattctcattctctgaacactagaattttacctggcttgacaaagggtctccagggaccaggtcttgagtcatcacccctcctgggaatccgatcgtcgt

SEQ ID NO: 504121 - DNA, 196 bp, Homo sapiens
gccacaggttcctcacctctcctcccttaaatctcgccttcccctcatgggctttttggcttttttaggggaccctaggaagccggagttttttttggtcctttaactagggtcgccaaagtccagggggcccagcgcaggggctgattaaaaggcacttttgtccgtgggagacccagcccccatgactttttca

SEQ ID NO: 504122 - DNA, 1191 bp, Homo sapiens
  misc_feature (331)..(331): n is a, c, g, or t
agcggggagggatagggagggattgacctttccgcagcggagaaatcgcactgatcctcgtcgctgtctgttgagtactgcctcgtttgagctatttatgtgcctaagagatgactcgagatgagttgtgaagaagtgtagggcttaccttgtgctaggttattggtaaggttagtcgagtccttcaccactaggatgtctgtgtactgtatcttgttgagcatttcattgcatagttggcacgccttgttctgttctcgtaatttcatacatttatatgggctcatgaatagattagtgggtgtataccgagcattgagagacatggaanagacgttcatagacgaggatattggtcactctgattcagagagttaacgcttccattgtggtatccgtaggttaacgcgaactattttcatagctacgattaccgccatgcatctcgttcatcctgcagcttcttttgtgcgttaatcctgtatgcattacttctccaaattctttgttcttgctgcgtcggttcgttgaccgtatgggtatctttcctcaatgcgggtctcgtcccgacgcattagcaatgggaggcatttgcgatttgcgacgccttggtctaagaattccctccatgcatacttctgtgaacaaatggcaccattttgaagaaacaatcccttggggaatgcgtccttaccgaatgtccccattacgcgttttccattatggggtgtatcaaccgtgccgcttgtatggccaccgagtgttggtgtgtgcggcgggcaccacggttccattcgtttggcatctcaacagcgtggcggacactccgtccactttgggcgtctcgcacttcaccattgttccgggctcggcgcagctattttagcccaaccgccgtacctttttgtgcgtttcatcccaggttctgcaatcgcacgggcccgcactttaactttagctttcacatgcgaagtttccgcacaaggccccccaaaccttcagggaggttttgagggctttgtttaaagccgtcttccgtgctactcgcgttttcatacgggccctaaactggttttgccggttttccttggaggtggcccttctctaagagacgcccagtctacccccttatatgaaaattgtccaacgcggccgcccttttttacctgcgcccgagttgaggcctcggtg

SEQ ID NO: 504123 - DNA, 209 bp, Homo sapiens
tttagtatgcttcccgggcccaaaggagctgacatcattttcacggccaccgcccactgttggaggaagatttttagagatgaggggggcaaggccttcttcaagggtgcgtggtccaacgtcctgcggcgcatggggggcgctctttatctggacctgaacaaggagctcaaaaaggtgatctaagggccggggtcttctacactcac

SEQ ID NO: 504124 - DNA, 488 bp, Homo sapiens
ttgtctgcactcagccccgaccccctctgattctctactgaagagtgtgtccttccctatgtctgtatgtgtttaacacgacgcaataattcgaggccaaacttagtgtgtacgatagactcgagagagttatgggacgcttacttgaggaaaatccttaccgtgatctggttctaggaaaaaggcagtgaataattatgcaaattcgccagaagaaggggaaacacgctaatgggccttactgggtgagggtaagaaatgggtacatgggttggaggaagtacgccatcaaggggttggatggagcagccccgagcgagcgagcgagcgttctactgtgacagtgtgattgcgcagtgaggagggggctggccatctctgccacttcggcacagtaaccaccttgggactaagaccacctagatagtgagagctgaacaacaaccagaccatgtcacacaagccagaaactccagttacctttgcca

SEQ ID NO: 504125 - DNA, 207 bp, Homo sapiens
gcctcacgccagtgtcacaacaacctcatcaaggcaatatataaggagtatgaattaaatgccagaatgatggccggggcgaggtggttgtggtagaggatataaaagaagttttggagacagaattcaaaacattggttccattcaagctaagtataagcagaggaaagcagtcctagggccaagtgaaaaccatcacagagaaag

SEQ ID NO: 504126 - DNA, 362 bp, Homo sapiens
caaggcaggcacggcagctcacgctgtaatcccggcactttgggaggcgagacaggcggatcacctgaggtcaggagtttgggacagcctgaccagcatggagaaaccctactactaaaaatgcaagattagccgggcaaggtggctcatgcctgtagtcttggctactcgggagactgaggcaggagaattgattggaccggggaggcagaggtcgcagtgagcctagatggcaccgctgcactccagcctgggcagcagagtgagatgctatctcaaaaaattaaataaataatatataaaaagaacaaaaaagacttaaggaaataaaaacattatttttatttcagtgcttatctatc

SEQ ID NO: 504127 - DNA, 974 bp, Homo sapiens
cctttcacggaaagagacaggaatctacctacacataggaatggtcaaggtagaaccactgaatcttgtcattgtaatattgacagctggtatctggtcgctgggaagctttatgtgtgtgtctgtcagctcagcatcttttactcgtgtctgataaaccctcgtgacttctcgctgttggaagcatctctgggtttcttgtggcgtctggtgtggaatggccttcctctctaggtgcctgaggtgtccgctgacgggtggcctctcacccccctctagagaaagctgacatttacaagtggattgtatttgtccggcaaaaagaggcggattcattcatagagcagaaagaacctgtcggcgtaaggtcttccactagttagatggtttcttttggggaaatgttctatatttggtaacttctagaaagccagaaaatggactctgatttcatacccgattttgataaagatgccacaaaataagggctatagagagattctttacaagtcagattttttgtgccccaaatcttttaaatgaagccagtgactcccagttctcaacacatggtcccagtcagagacagaacactcatggaaatagaacccttgtaagtattatggcactctccgaatcctcctgaaggcatttcctctacagacatagtggttaaccggaagttgaagtggcaattgtgcaattttgttaaacgggagcttttaaccaaggtaatattaatgggctgttgagaacatcagtggccttattctaagattccataaggctgaggtttgcactgctgtgtgacttgcagttctgctaggcatgtcaagagtggtggactattaaaaaccgtaagaggttaatcatgacaagtcacctggaacagactcaaagaaacaggttcttctgggcaacgagacaaagaaggaatcaagtcttgtgctgtcccgtgagtgtgtcctgagtac

SEQ ID NO: 504128 - DNA, 603 bp, Homo sapiens
gcacgaggctacttgttatacggctaaatgcacttccgagggtaacctgttattcaggattatatgaacagagagaataatgatgtgagttactgcaaatagcataattactggactatattcttgttggcttatattattacaacgatatttaccattaaaagtgtctatatcttatattattgatgatctgccattgctacaggattgcacgcgactaataattgtctattaagtatatttggatgacttaacacaagaattgttttctctctcctttctgaactagccagctttatcttctttccttttatgatctggacgggaaccaattcgcctaggttctgctcaacattttttaagtcgtaaatctgtatcaaattgtcgccaacgagaatcaaatgattaccatggaagctcgcgccggtacaacaaaaatcaagtaagagaatatcctttctccaatcagacatctcaccgtagcagtttattttcactacggcttcatcataaaccaaggcaaaaaatctagattgtgatatttgaaaaaaattgaccggtatagctttgcaagtggcgatatccttttttgcttcttcagtg

SEQ ID NO: 504129 - DNA, 397 bp, Homo sapiens
gtgtacatgaaaatagtgtacatgtatacacattatttagaatctagtacaatggaatgagacacgcttgaaaacatgcagacaaccatctataccatgatctagtaacatctgccccataccccaggtaccatccagggtctcacagaaccccatgatatgtggaaaaggcagtctactatctgcccacacctgctactacctatgtccacccagatgaggtaatccgctagaattgctacataaagtggtactgtggaacatttagtaacagagaaaatcagagctagagggagcaccatccaggttagaaaagataagaacattatgttagaaaatctgaactaatctacctgtcttgattaggaggattcgagttgatgtagaatgggtctga

SEQ ID NO: 504130 - DNA, 336 bp, Homo sapiens
atctctaccccacgtgcagcagccctggccccagtctcattccctcacctcttgggccaccatttcctgacagctgtgtgctacagccccaatgccagatgtaactaattcacacaggaaccacacgcagaatctttaacttctcagctcttcacgaacctcagccattgtcaaaactggtgccactgggaggaggtgacatcttttttttataaaaggattattacaacatatgtctggttatttttctaaatgttaacaaccaggataatttgggaaagtgtgatgacacttaaaagccagaggcaaagctattttgaggcagaagaatctaaa

SEQ ID NO: 504131 - DNA, 427 bp, Homo sapiens
tggtgccttacatggtgccttataggtaaatgaggatgaaggaatccctcgtaagtgggagatattgtatatatgcttagatgatcagattgagtggggtgtggggaaaaattgttttctgaaggctcaaaagtggttgcctaaaagtgagccactatcagatttgcacatcaggagacaagaaatagggttacgtccattaggaaaatcccagttggcaggagtgcaatcacatcaaaaaaaacaacgcagccaggatgaaaggtataataaatcctcatagcggacacattgctcagggcacaggaaccgtggctcatatgaggatcacgtgtccatgcctttgtggtcaaagggtcagcacttacccacaggaacaaactaggtgtggatgggcgtggtgatgtgggcacaacataaaattcag

SEQ ID NO: 504132 - DNA, 142 bp, Homo sapiens
ttatcacttgtctgcgttttcgtcgcaaacgtccataactgaaagtagctaaggcaccccagccggaggaagtgaagctctcctaggggcgtgggttgttcgtgatccttgcatcctcgttacttaggggcaaaggcttggg

SEQ ID NO: 504133 - DNA, 104 bp, Homo sapiens
  misc_feature (43)..(43): n is a, c, g, or t
  misc_feature (58)..(58): n is a, c, g, or t
  misc_feature (94)..(94): n is a, c, g, or t
cagtaacatagagcttttagcggttcaagaaggaataaaagtncttgaaacactggtngctcttggtgaagaacaaaacagagtccagttactngctcttttag

SEQ ID NO: 504134 - DNA, 554 bp, Homo sapiens
gtacaatgattgtttatggcaacgaaatattccattgaaatattgtgctgtaacatgggaacagtgtaacatgtttttcactggtttcgtatcaactgctgaacataaacatttaattcgtgacaaacacaacacaaaaaaacaacaaacacaaaacaaaaacaaacacaaaacaaacaacacacacacacaaacagacaacacacacgagcaacgccaccaaccaacgccccacgaaccaagggcagcaagaacaaaaaggaggaggggagggcaagaggagcgctcgtctgcgcatcacggagcgcagacaagggagtgaaccgcacgcgcggctagcggaacacaacgggccggctcggcaccggcccgccgaggacagggagagcagtctcggagaaaccacaagaaaaggaaaaagagagcaagcaacaagaagacggaacagggaggcacagagcgggacaaacaggaggggagcacggtaaaagggcacaaaggagacacaacacaagggcagccgagggaaaagaaggtccagaagagaacacaac

SEQ ID NO: 504135 - DNA, 466 bp, Homo sapiens
tcattcttccccggaaccgcagacccgggttgacacgcgtgtggagaagagtgtaagcccactgtggtcccggacctacgatgctctacccacgccacgccatggcttgtgttgttccccctgacaaaagggcgtccaaaacacgacacgccgaggccgtcgttttttaccgcggctgtttgccaaaagccccccccggcttatagaatgttgttaacccccccctccagggtaagttctatttagtctgatcatgcgagcgcggaggcaggtctgcccagtgggccgagggacacaactgggtcgctctggcccccagaaggttttcggcgaatagtgcttggatagcccccaccagcggtggaaaaattgtctttcgctgggaccgcgcttttcccgaggtcgcccccgcgacaaaaccgtttgatttttaaaaaggagaaaaaccccttttttgggtcaacaa

SEQ ID NO: 504136 - DNA, 813 bp, Homo sapiens
gaagtggcaactaactaacatcctcatttggtcatggtaaaaatgactccagttgcctaggtggtactagaccttgaagatgccggttatccagttttctaggtactgaccggctaagactaagctagttaattccggactccctaggaagaggtggtctctctttttccctaatcataatccccacattgcttgaagaagccacaattcgatctaagcgcactctattttggctgcagagtactacagtgtaacatcttacaaggattatcccagcaagctgagcagatgatagatcaacacagatctctcttcatagtccggtggatgcagaagaataccagtgatttacacagtaagtctgtagttagttcacattgccaggcgtaaatttcctggatcatggtactctccgtgtatttaggtatagtggtaacagaattatgcttgtaacttaccatgttaatgggcatgcctattcatgtcaccaaaacgaccgtaagagcttatgtatgggtacatctgataacattaggggcccctcacggcttccaagggacgctatacttggtcctgacaccagggcgcaaggagggctggtgtgtggacacggctcgggcccaaagagctcagtactgtcattcgcgtcacagaacctagctactaattccaatcggcggacaacagcaccgtttccaggaaccgggttcacgactcacgctgttacaaagcggtctcccaccaaagggggaaaagacttttcaaccactgccgtacaaagcgtgcgccttggacgacaacgaacttgagaaa

SEQ ID NO: 504137 - DNA, 327 bp, Homo sapiens
gaaataaataaatgtttaggtgaacattaaaacagcaaattaattaagtaaaatattaaaataaaaagtaccgatcatttcatctcagtgtagtatttgcttttgtgccccttttccccctatgcacaagtggtttatagttgtttatcagactgagctttcactgtcttcattagagaatgaagcaaaataaaaccaaagctggccgggcgccgtggctcacgcctgtaatcccagcactttgggaggccaaggcaggcggatcacgaggtcaggagatcgagaccatcctggctaacacagtgaaaccccgtctctactaaaaaa

SEQ ID NO: 504138 - DNA, 278 bp, Homo sapiens
ggtcgacggattgcataatctaaaaatatgaaaatgtgtataaatattttgtttcttaaaaggccactgctgtggtagcttatctagtatccttgctacatttactgaaaatatatgttagagatatctgcactgctatgttcttttcagcatttttcacaatagccaagatatggaaacaaccttaacgttcatcaatgaatgcataaagaaaatgtgatacatacgcacttgcaccatgaaatattattcagcattaaaaaagaagaaaatcctgc

SEQ ID NO: 504139 - DNA, 100 bp, Homo sapiens
tgagaagcaagatgggtcaccagcagctgtactggagccacccgacgaaaattcggccagggatctcgatcttgtcgtgtctattcaaaccggcaagact

SEQ ID NO: 504140 - DNA, 817 bp, Homo sapiens
gtgctctggactgtatcctaccaccaattcgttcaactgagaagcccttgcgaactgccctactccaggatgtctcatcaaagattggtggtataggaacggtgtcggctgttggtcgagtggagactggctgttctcagggcccggtctggtgctcacctttgctccagttctgcgtcagcagacgggtgtggggaatctgttcgaaagtgcatccactggaaggcgttcgagatgggagtctcttcgctgggtgacattgtgggcttctaactgtcagggcatgtgtgctctgtcaggggcactgttcgtcgtggctcatcatttcgctggtggacggttgggacctgagccatgcaagtgggggcctgttgggcttcatctggcgtcaggtgaattagtcccgtgaacccaatcgcatggccgacgtatgtccgcctgtctgatgcatccctgtgttggctttgcctccagcgggatcactatttgctctgcagggttgtgcttcatgcgtggtggatgagatgctcggccgttcgtggtaaaaggtctggcatgatgacccgtaaattcgttgagaggtctggtgatgctgccaatggttgaatatgggttcctgggaagcgcccatgtgtggttgacacgctgtcttcaagagtatgcagctttgggtcgcttctggtgtccgggatatgtgacacactggttccctgtgggtgccttcaagcgtggacgagaaagtggtgacgcttggcaagtccaagttctggccaaaaagtccaaggcaattgatattatccctatacggcaccaatta

SEQ ID NO: 504141 - DNA, 1530 bp, Homo sapiens
  misc_feature (1437)..(1437): n is a, c, g, or t
  misc_feature (1496)..(1496): n is a, c, g, or t
  misc_feature (1501)..(1501): n is a, c, g, or t
  misc_feature (1506)..(1506): n is a, c, g, or t
aaaagctgtattttattcaagcattgaatttagaaagataaactataaatttattactgcttttcaacatgctttggattttaaagctaatggatcttttattaataccttttttcctttcatcttaacccagtgttactaaaattagatttcccattttttcccctatatgaaagataatttacatttaccttgtaaaaattatcaccctgctccacttgagaaccctgctgttgtttgcaaaatcaggaccaagcccatattttttgagagctctctagaagaatttatcttcaagaaaatatggtttggtgtttttggttttttcttttctttttcaaagtcccatggccagatatcctataatatactagatgcatgtttgctaatttttacttgaattttttttaaattgtaccaatcaaaaggttctttttctttccagctccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaattttgtataaattactttcaggctatatgtataaggtggatgtgaaacatgaattatgtaattagagtcgggtcccgttgtgtatatgcagatattccaaacctgaaatccaaaacacttctggtccctagcatttggataagggatactcagcttgtacctatatattcatatatattcactgttgttagaaatgtttaagttgctgttctgtgatgaatctaaatcttttctcttgctaccaagctatgtcactgcagtgcattataccaaagagcgaagtcagtgccactgaaaatacagaacccattaatatcgtggctatctgattacatttatattccaagatgaaccttttttatatatgctaaaaatttggggaatatgtttgggatgtattatggagctaaaactctaacctcttaatagttttatagaacttaaaaattttttatacaattacccaattggtgatatgatcttaagctttggtgtcagattatttaatatgatgacttcatgctttattatgccttattatggctgacgtattactgtggtgaaacaaaatatctttaaaagttaaaacatccagatatttaagactattttccctaagattaagtnacttgagcatgagtgtttccaggttcatagggaaactttcttacatacttgttaactgntccgngaaanaaagtaacttaaaacttgcatccg

SEQ ID NO: 504142 - DNA, 660 bp, Homo sapiens
  misc_feature (14)..(14): n is a, c, g, or t
  misc_feature (61)..(61): n is a, c, g, or t
  misc_feature (130)..(139): n is a, c, g, or t
  misc_feature (142)..(143): n is a, c, g, or t
  misc_feature (145)..(145): n is a, c, g, or t
  misc_feature (149)..(149): n is a, c, g, or t
  misc_feature (175)..(175): n is a, c, g, or t
  misc_feature (179)..(179): n is a, c, g, or t
  misc_feature (186)..(186): n is a, c, g, or t
  misc_feature (199)..(199): n is a, c, g, or t
  misc_feature (213)..(213): n is a, c, g, or t
  misc_feature (226)..(226): n is a, c, g, or t
  misc_feature (234)..(234): n is a, c, g, or t
  misc_feature (252)..(253): n is a, c, g, or t
  misc_feature (275)..(275): n is a, c, g, or t
  misc_feature (278)..(278): n is a, c, g, or t
  misc_feature (286)..(287): n is a, c, g, or t
  misc_feature (290)..(290): n is a, c, g, or t
  misc_feature (309)..(309): n is a, c, g, or t
  misc_feature (312)..(312): n is a, c, g, or t
  misc_feature (319)..(319): n is a, c, g, or t
  misc_feature (356)..(356): n is a, c, g, or t
  misc_feature (528)..(528): n is a, c, g, or t
  misc_feature (531)..(531): n is a, c, g, or t
  misc_feature (538)..(538): n is a, c, g, or t
  misc_feature (575)..(575): n is a, c, g, or t
  misc_feature (611)..(611): n is a, c, g, or t
  misc_feature (621)..(621): n is a, c, g, or t
  misc_feature (646)..(646): n is a, c, g, or t
  misc_feature (649)..(649): n is a, c, g, or t
  misc_feature (653)..(653): n is a, c, g, or t
acttccgcctctgntacctactgacaaaaatacaccacaaaattataaagcgctcagcggnttttgctagggacaacttgttattccgctttgaatgacaaatgaatttacaggtgactcagggtgattnnnnnnnnnnggnngngggnggaaaaatcagatgagagcgtttggnaggntagtttnccccatgctagtnttattacccagctnttgcatacgatgntctctgcnacacagcaagccacaaannattttcctttacatggcctgtnggngttttgtnnggnggcagtaccacatctcaanttnccaattntcccagctggttctggccctgtgggtcctggagctgncaccctgcagaactggcctccctgaaacatttgtgagaggcaggcgaatgcctgatacggttccagggaactgggaggcctggtcaaggctggatgctgcctccttgtcaggagcttctagaactcggttggggagtttggacaaatgtccccttttaacacaacgaagtgngcnaaaaganagtcccatttttcagcttcctttagaaacgatttggnattgtggtggccccaaccttcaggtctcttcctggntgtcacttgnggctcctggttggaatccgtattgntgnggtnattgtta

SEQ ID NO: 504143 - DNA, 654 bp, Homo sapiens
aaaagctgtattttattcaagcattgaatttagaaagataaactataaatttattactgcttttcaacatgctttggattttaaagctaatggatcttttattaataccttttttcctttcatcttaacccagtgttactaaaattagatttcccattttttcccctatatgaaagataatttacatttaccttgtaaaaattatcaccctgctccacttgagaaccctgctgttgtttgcaaaatcaggaccaagcccatattttttgagagctctctagaagaatttatcttcaagaaaatatggtttggtgtttttggttttttcttttctttttcaaagtcccatggccagatatcctataatatactagatgcatgtttgctaatttttacttgaattttttttaaattgtaccaatcaaaaggttctttttctttccagctccaattttttgtaaaacagaagttccagagcacagaaggtcatcatcacaagcaaactttattaaaaaaaaactagaagtgtgctttgattttgctggaatttggttgataattctatattggggaacaacaccattactgtttttttggggacttttgtcagggccattcctcccgagggattgttcttcccgtggcctttttttt

SEQ ID NO: 504144 - DNA, 116 bp, Homo sapiens
tgcagcagcgagctggcacgatcgtcgctggacacctgcggacgacccggatcggcgtacgcggtcctgcgaatcgcggtcccacagcaggcgcggctcggtaccggcgttgtccg

SEQ ID NO: 504145 - DNA, 1476 bp, Homo sapiens
  misc_feature (1383)..(1383): n is a, c, g, or t
  misc_feature (1442)..(1442): n is a, c, g, or t
  misc_feature (1447)..(1447): n is a, c, g, or t
  misc_feature (1452)..(1452): n is a, c, g, or t
aaaagctgtattttattcaagcattgaatttagaaagataaactataaatttattactgcttttcaacatgctttggattttaaagctaatggatcttttattaataccttttttcctttcatcttaacccagtgttactaaaattagatttcccattttttcccctatatgaaagataatttacatttaccttgtaaaaattatcaccctgctccacttgagaaccctgctgttgtttgcaaaatcaggaccaagcccatattttttgagagctctctagaagaatttatcttcaagcagatatcctataatatactagatgcatgtttgctaatttttacttgaattttttttaaattgtaccaatcaaaaggttctttttctttccagctccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaattttgtataaattactttcaggctatatgtataaggtggatgtgaaacatgaattatgtaattagagtcgggtcccgttgtgtatatgcagatattccaaacctgaaatccaaaacacttctggtccctagcatttggataagggatactcagcttgtacctatatattcatatatattcactgttgttagaaatgtttaagttgctgttctgtgatgaatctaaatcttttctcttgctaccaagctatgtcactgcagtgcattataccaaagagcgaagtcagtgccactgaaaatacagaacccattaatatcgtggctatctgattacatttatattccaagatgaaccttttttatatatgctaaaaatttggggaatatgtttgggatgtattatggagctaaaactctaacctcttaatagttttatagaacttaaaaattttttatacaattacccaattggtgatatgatcttaagctttggtgtcagattatttaatatgatgacttcatgctttattatgccttattatggctgacgtattactgtggtgaaacaaaatatctttaaaagttaaaacatccagatatttaagactattttccctaagattaagtnacttgagcatgagtgtttccaggttcatagggaaactttcttacatacttgttaactgntccgngaaanaaagtaacttaaaacttgcatccg

SEQ ID NO: 504146 - DNA, 199 bp, Homo sapiens
tggagagggagtctcattctccagccgggcaacagagtgagaccccatctaaaaaaaaaaaaaaagaagggaactcttggccttcttaaaagcaggaggaaactggagttcttctatagagacacagtatctaatatttataagaagcctatttatttatttttttggcccccttttttctctttttgtttccacagtc

SEQ ID NO: 504147 - DNA, 1152 bp, Homo sapiens
  misc_feature (1059)..(1059): n is a, c, g, or t
  misc_feature (1118)..(1118): n is a, c, g, or t
  misc_feature (1123)..(1123): n is a, c, g, or t
  misc_feature (1128)..(1128): n is a, c, g, or t
cgggttatcctcggcgaacgtgttatccgtgatccaaaacacttctggtccctagcattttgataaagggatactcagcttgtacctatatattcatatatattcactgttgttagaaatgtttaagttgctgttctgtgatgaatctaaatcttttcttttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaattttgtataaattactttcaggctatatgtataaggtggatgtgaaacatgaattatgtaattagagtcgggtcccgttgtgtatatgcagatattccaaacctgaaatccaaaacacttctggtccctagcatttggataagggatactcagcttgtacctatatattcatatatattcactgttgttagaaatgtttaagttgctgttctgtgatgaatctaaatcttttctcttgctaccaagctatgtcactgcagtgcattataccaaagagcgaagtcagtgccactgaaaatacagaacccattaatatcgtggctatctgattacatttatattccaagatgaaccttttttatatatgctaaaaatttggggaatatgtttgggatgtattatggagctaaaactctaacctcttaatagttttatagaacttaaaaattttttatacaattacccaattggtgatatgatcttaagctttggtgtcagattatttaatatgatgacttcatgctttattatgccttattatggctgacgtattactgtggtgaaacaaaatatctttaaaagttaaaacatccagatatttaagactattttccctaagattaagtnacttgagcatgagtgtttccaggttcatagggaaactttcttacatacttgttaactgntccgngaaanaaagtaacttaaaacttgcatccg

SEQ ID NO: 504148 - DNA, 587 bp, Homo sapiens
  misc_feature (58)..(58): n is a, c, g, or t
  misc_feature (60)..(60): n is a, c, g, or t
  misc_feature (586)..(586): n is a, c, g, or t
cccgctcttttcaaattcatcacccatactcccttccacacaagcaatactccggcantncacagaattacttacttgtctcccagatagacaacaaacaccactgtctgcaaaccgttgttcacttggttccctttgctatgaagctccactatcccaatacatccatgtttacgtctaacttctgctcgagcctcaaagggtaagtttttttgggttttttttgtttgtttgtttttttgaggcggagtgccactctactgcccaggctggagtgcagtggtgcaatttcagttcactgcaacctccacctcctgggttcaagtgattctcctgcctcagcctcctgagtagctggaactacaggtgcataccaccacgcccggctaattttcatatttttagtagagacagggttttgccatgttggccaggctggtcttgaactcctgacctcaggagattcgcccacctcggcctcccaaagtgcagtggtgcaatttcagttcaactgcaacctctacctcccaggttacaagtgattcttaggcgctcagccttctgagcagctgcaaacacaactgcng

SEQ ID NO: 504149 - DNA, 735 bp, Homo sapiens
agcgggctcctgggctttgggctggctgcagtctgtctgacggcggccgaagtggtctggctcatttaaggatgaggcttctgctgcttctcctatggcggcgtctgcgatggtccggagtcgaggcctcggcaatctgggcggcgtgtcccatgcagacgcagattaaagatgcagtacgccacggggcgttgctcaagttccagatttgtgtttcctgaggcttataggcggggtgtcatgagtgagtacatgcgcggttataagccagtgggtacccagacgttccgcattgacggagagaattacctcgcctcaaccagatatatacgcacacatacgcatctttcctgtcagtcttcaaactagtattaataggcttaataattgtaggcaatggatccttttgctttctttgtgatatgcaaggctcctagctatctgggcagtggtggccaaggaaacataatggtttatgcatgtatgatggttttcttcttgagcgatatgatatgagaaccagtgtatgtcaacatggtgcatttgagataatctcgagaatgatgtacctgtgtggtctaagctggaatctggtcaccattccatccatgcaacaactagttcaaattcttgataattgaaatgaatgctcagtgtgccatatggattcaatccccacaccatcgatcatagcaacacctatcaggactgagaactcttttgcattaagggata

SEQ ID NO: 504150 - DNA, 395 bp, Homo sapiens
tgagaaaacctaccgcaggatcttactgggcttcataggtaagcttgcctttgttctggcttctgtagatatataaaataaagacactgcccagtccctccctcaacgtcccgagccagggctcaaggcaattccaataacagtagaatgaaccctaaatattgatttcaaaatctcagcaactagaagaatgaccaaccatcctggttggcctgggactgtcctagttttagcattgaaagtttcaggttccaggaaagccctcaggcctgggctgctggtcaccctagcagctgagggactcttcaatacagaattagtctttgtgcactggagatgaatatactttaatttgtaacatgtggaaacatctataaacatataccgcagcctga

SEQ ID NO: 504151 - DNA, 404 bp, Homo sapiens
  misc_feature (58)..(58): n is a, c, g, or t
  misc_feature (60)..(60): n is a, c, g, or t
cccgctcttttcaaattcatcacccatactcccttccacacaagcaatactccggcantncacagaattacttacttgtctcccagatagacaacaaacaccactgtctgcaaaccgttgttcacttggttccctttgctatgaagctccactatcccaatacatccatgtttacgtctaacttctgctcgagcctcaaagggtaagtttttttgggttttttttgtttgtttgtttttttgaggcggagtgccactctactgcccaggctggtctcaaactcctggcctcaagtgatccacctgccttggcctcccaaagtgctggtattatagatgtgagccaccgctcctggccagattttaaaaattgggacatttcatatgaaaacactaatttggggt

SEQ ID NO: 504152 - DNA, 233 bp, Homo sapiens
tctgcatcgctaatccttttgcacggtttgggtaccgcggccgttagacatgtgtcactgggcatgcggtgcctctaatattggtgatgctagaggtgatgtttttggttaaacaggcggggtaatgcatttgccgagctccctctttactttctttttaactctttcctctatgagcatgcctgttgttggtgttgacaggtgcaggcgttatacctgaacaggatttcagc

SEQ ID NO: 504153 - DNA, 176 bp, Homo sapiens
tataattatggctcatagggatagtacaaggaaggggtaggctatgtgtttgtcaggaggttgacgaatgagtgtgaggcgtattataccatagccgccgggtcaagagtactgcggcaagtactattgacccagcgaaaacggcatcttcatcggcgaaaacggctcttcatcgg

SEQ ID NO: 504154 - DNA, 754 bp, Homo sapiens
  misc_feature (373)..(373): n is a, c, g, or t
ggcttatccccccgagtgcgtctctccgcctctgaccccgctctgttttacgtgttgataccccctactcttgtagaggatgggccccccctcctctaagagagagagagtgattcttctctgtgaagatagtgtcccgcccgcccgccgacacactctgtgtgattgtctgtgcccgcactgtcacagacccctctttgtggggagatgtgtggcgaagaagtgattctctcttgtgtttctccccccccactctcttctctcttatgccccgcgtgaaataatagatctgtgagaggagataagagaggagcgagcgagaagagagaagaattatagtgggggataaacctcctgggtgggttgttggaanccctcagaggttcttgtgggagactctctttgtggaggaggtttcttgtataacaccggggagtattttcccactccccccccctgtgggaaaatattagtatgaggtgcatattgactcgtttttaggttttcgacccatattgggaattttttccttcacaaacacttaagcccaccccctgttcagggaggggtatatttttaattttttcgcgtcagagtaagatgtttcccctctctatctggggcactctgaagaggataatatgtgaaccacatgttcacatatttgggatattttccacccgcgggtttttttttttaacatttttttagggaaaccgtggggaaaaaaaaattttttttttttatttcccca

SEQ ID NO: 504155 - DNA, 270 bp, Homo sapiens
ggggccaaattgtggactcagcgatgagtggcagtcagagagaaactgtcagttggtggaggttctgtgggtggtgctcccttggagttaacaggtttttttttatttttataacttcaccttttattttagattcagagggtacctatgcaggcttattacctgggtatattgtgtgatgctgaggtttggggtcctactgatcccatcacctaggtactgagcacagtaccagtagtttttcaattctcaatcccctccctctctcct

SEQ ID NO: 504156 - DNA, 446 bp, Homo sapiens
  misc_feature (73)..(73): n is a, c, g, or t
  misc_feature (123)..(123): n is a, c, g, or t
  misc_feature (178)..(178): n is a, c, g, or t
  misc_feature (195)..(195): n is a, c, g, or t
  misc_feature (207)..(207): n is a, c, g, or t
cggtctgtgaagctgctgcccctgagctggaggggggtctcattctacaaagagagaggtggcccccctttcntgacctcctcctccttcaagctcaaacaccacctcccttattcaggaccngcacttcttaatgtttgtgctttctctccagcctctcttaggaggggtaatgtgnagttgcatctgtaactntccttctccttngtcccctttctctgtccgcctttcccatcttgctgtaggcctcttgattgtcagtctgtgttctatccagtgattgttttggtttctgttccctttatgtctgccctaggggctcagaaccccagcaatcccttccgtttctgataccttcttttctgggggtagttggaagggtccgaaagtgttgggggaaggtagtaggcccatcaatgaagaggaaaccacccagatgaaaaaaa

SEQ ID NO: 504157 - DNA, 480 bp, Homo sapiens
tgctgaggtcactctagagttcccgaacgcgtcacaatcgaagatgggtgctacagactggcagacactttgtggcatacaataataccgtggtagaacaatagagtactttgtttcttcttgactgaaatttcttactgaattccctggctgatatttttcattgtgagttgcttatctcgatgtcctgctttgaaaagtatgtgtttagggactgtttttatttgcatcacttactcatgtttgctatggcaaaatttagaaagtaatgttcaagtaaaatgcaagcaaactcacaaccatctgtactccctccattctagcattaactcactatttagattttggggcatcaacagttttcctgtctttttacattacatacaataatagttcacatttattcacgcattttctagtaccaagtactataccaagttgctttacatgtattcgtctcatcttcgattttgacgcgta

SEQ ID NO: 504158 - DNA, 1001 bp, Homo sapiens
  misc_feature (23)..(23): n is a, c, g, or t
  misc_feature (37)..(37): n is a, c, g, or t
  misc_feature (49)..(49): n is a, c, g, or t
  misc_feature (58)..(58): n is a, c, g, or t
  misc_feature (75)..(75): n is a, c, g, or t
  misc_feature (77)..(78): n is a, c, g, or t
  misc_feature (81)..(81): n is a, c, g, or t
  misc_feature (123)..(123): n is a, c, g, or t
  misc_feature (140)..(140): n is a, c, g, or t
  misc_feature (248)..(248): n is a, c, g, or t
  misc_feature (327)..(327): n is a, c, g, or t
  misc_feature (345)..(345): n is a, c, g, or t
  misc_feature (401)..(401): n is a, c, g, or t
  misc_feature (448)..(448): n is a, c, g, or t
  misc_feature (452)..(452): n is a, c, g, or t
  misc_feature (456)..(456): n is a, c, g, or t
  misc_feature (461)..(461): n is a, c, g, or t
  misc_feature (474)..(474): n is a, c, g, or t
  misc_feature (478)..(478): n is a, c, g, or t
  misc_feature (488)..(488): n is a, c, g, or t
  misc_feature (501)..(501): n is a, c, g, or t
  misc_feature (504)..(504): n is a, c, g, or t
  misc_feature (508)..(509): n is a, c, g, or t
  misc_feature (513)..(513): n is a, c, g, or t
  misc_feature (517)..(517): n is a, c, g, or t
  misc_feature (541)..(541): n is a, c, g, or t
  misc_feature (560)..(561): n is a, c, g, or t
  misc_feature (567)..(567): n is a, c, g, or t
  misc_feature (799)..(799): n is a, c, g, or t
  misc_feature (866)..(866): n is a, c, g, or t
  misc_feature (892)..(892): n is a, c, g, or t
  misc_feature (905)..(905): n is a, c, g, or t
  misc_feature (917)..(918): n is a, c, g, or t
  misc_feature (931)..(931): n is a, c, g, or t
  misc_feature (934)..(934): n is a, c, g, or t
  misc_feature (962)..(962): n is a, c, g, or t
ttgcggtacggaagctacacagnaacacgtatagganactctccccganatcttctanggagtgacccatctatntnngtntaggaagaggaaactccgaaatgggatcgcggaagacttaangggccaggctgattttnttttcctactggtctctgaggctgtggttgctacagggtcaccacgagcttggcttacttgtctcatccttcccttgcctggtatcattttctcagttctcccaaaanccatgtcccggcccttgctcatcaccttcaccccagccactgaccccagcgacctctggaaggatgggcagcagcaacnacaacccgagaagccaangtccaccctggatggggctgcagcccgagctttctatgaggccctgattggggatnagagcagcgctcctgactcccagagatctcagactgaacctgccaanaaanaaangaaanagaaaagaagaanaatnaaggcaccancagcagaagcagntgngcannaagngagncatcaggaagacatggtacaaggngagatcccttgaggctganngataangatgactcaccggatactgagaggcagcccagagagggaggacctgcacagaacttaaggagactgctgagaaccgcatgagcgcagggaggagctgggggggaatatgaacgcccggggatgccttctggtggaccccactgatgtgtgctgctcgagcgggccagggggcagctgtgagctatctcctgggccgtggggctgcctgggtgggggtctgtgagctgagtgncagggatgcggctcagctcgctgaagaagctggcttccctgaggtagcccgcatggtcagggagagncatggagagacaaagagcccggaaancggtctctactcnctccctccagtnntgcgagaactgtnaanccacttccaaattccaccaccgacatcnctgctcactgctgtatatcgcgggtctcagctccaacct

SEQ ID NO: 504159 - DNA, 179 bp, Homo sapiens
agacccggcgaccgtacttctcccagcctaattatttaggacattaacctagttatgcagatgggtctcgcacaatcagtgatgtgacaaaagccagatcctgcaaggccaccttttctaattgttcactgtttaaaccacatcatgattactgaaggtatcgagaaagtacggttgca

SEQ ID NO: 504160 - DNA, 112 bp, Homo sapiens
tgcttcgagtcacggtcagattgctccctctttctttctttttttgagacagggtctcactctgtcacccgggggggagtgtggatgacactagtcatggctcactagcagc

SEQ ID NO: 504161 - DNA, 266 bp, Homo sapiens
aacctaattacgacattaaaggagcattgatgggaatacaataataatagaagactttaacaccccacttacatcaatggatagatcctctaggcagaaaatcaataaggcaacaggaatcctaaatgacacaatataacagttagatttaattggatattttcacggacattacatccagaaaaacccacgaatatatattcttctacaaagtgcacatgcgaacattctctcaggatcgaccacatcaccgtaattacgggttt

SEQ ID NO: 504162 - DNA, 126 bp, Homo sapiens
cacgaagtggctgcccatctgcccacaagtggagtccgtcaaagaggtatctttactattaaagctattgtgttagctaactcatattaagttgttggctcaggagctttgacacttcgtgggcag

SEQ ID NO: 504163 - DNA, 199 bp, Homo sapiens
gcctaaaaacacaaaagacacaaaacacggaaaaacaaagaaatacaaaactccagtgttcccatcgtggcttaacaggttaagaacctgacatagactagatagcaatgagatcctgctgtatagcacaggaagctatatctagtcacttgtgacagaacatgatggagcctaatgtgagacaaagaatatgtatatg

SEQ ID NO: 504164 - DNA, 171 bp, Homo sapiens
gaagtgcacccagacctgagagtgtacttgtaaattgcttatttaaaagaaaaaaaaaactgtatcatgagcatagtttcatcttgacaacaatctgacacatcttttggtgttttggtagacatcacttcattgcagtggatggcatcagtgatttatttaacgcaattt

SEQ ID NO: 504165 - DNA, 567 bp, Homo sapiens
  misc_feature (85)..(85): n is a, c, g, or t
ggagctaaaccaatctggttttcaacgattttggaaaagcccccaggggtcccccccggtttgttgagggttggggtggttagangcgctctccaaagttagacgtccagtcacgtccttggagatgtccttggctcccatgagaaatttgaaggcccgcttggataacaaccttagggaggtggaggcccccttcgcccttcagatggaacagctcaacggggtccttctgcccctttagtcaaagctggcccacacccgggccaaggggcagccgccggcccccgaggtttagggcccttcttaccctcaaggccaagctggggggttagatcgccccccccccccccctcctggaaaatggcgagggcttttattttggtgatgccttgggcagcagcaactccctgcaaacccttcaaaagaccccccccccccggatagtggatggcaaagtggtgtttgagacccattccccccaagtttttgggcctttagccccccaaagcaggggtccctttggggggccgggggcccataaaaagttccgggttccttgggtggcca

SEQ ID NO: 504166 - DNA, 347 bp, Homo sapiens
ccccgggagttcataagcttgaaattcagactctatccatccagttcaaatgaacgcccacataactgagcctacatgtctaaactggtttaggtgttatagacagcgtatctgctcctaattcacagccagtctaagatcttttacatgttggttataagcaaaaggcagcttgacttccagttgctcgccatttgaccctcctcggcaaatcaggtctccaatgccacattcaagcattcttcaagagtctggtacatcaaccaacagagcttacggcgcctctgttgttgacatgtgcgtgtatttcgcgagctccccgtgcacagtgtgtgtcgtcatgtgcg

SEQ ID NO: 504167 - DNA, 863 bp, Homo sapiens
  misc_feature (27)..(27): n is a, c, g, or t
  misc_feature (194)..(194): n is a, c, g, or t
  misc_feature (224)..(224): n is a, c, g, or t
  misc_feature (268)..(268): n is a, c, g, or t
  misc_feature (270)..(270): n is a, c, g, or t
  misc_feature (272)..(272): n is a, c, g, or t
  misc_feature (274)..(274): n is a, c, g, or t
  misc_feature (360)..(360): n is a, c, g, or t
  misc_feature (406)..(406): n is a, c, g, or t
  misc_feature (491)..(491): n is a, c, g, or t
  misc_feature (493)..(493): n is a, c, g, or t
  misc_feature (512)..(512): n is a, c, g, or t
  misc_feature (545)..(545): n is a, c, g, or t
  misc_feature (547)..(547): n is a, c, g, or t
  misc_feature (554)..(556): n is a, c, g, or t
  misc_feature (565)..(566): n is a, c, g, or t
  misc_feature (568)..(568): n is a, c, g, or t
  misc_feature (571)..(571): n is a, c, g, or t
  misc_feature (576)..(576): n is a, c, g, or t
  misc_feature (619)..(619): n is a, c, g, or t
  misc_feature (649)..(649): n is a, c, g, or t
  misc_feature (742)..(742): n is a, c, g, or t
  misc_feature (750)..(750): n is a, c, g, or t
  misc_feature (760)..(760): n is a, c, g, or t
  misc_feature (798)..(798): n is a, c, g, or t
  misc_feature (855)..(855): n is a, c, g, or t
tgcaataaaaatcagcatggatcttanatgatctagaatacactgtgttttgaaatccacagctggttgcatttttaaccattatgaaaaaccagtactcctattccatcaaatgtgttttataagcaataataaattctgatccactgtattatgcaacatacatctttggaaagcaacataaacagtgagancagatcagtagaaatatacacagttaaaanatatacacaaagtactgttgttttattaaaaactactacttgananananatctttccacaaatagcataaaactgtagaatgatgaaaggttttgggaaagctttacaaaagcgtaattccaattgtatcccccngagggtggtggcaaagggtatttccttccttctctgggataccccngtcccccgccacgaccatctcgcccgggtggatacccaccaggcccagcgagcatctggcaccggtttggccggaaggcggcatncngggtgggcagcatccggcnccatgggagcagaggttcagccccaacgcctcngncaaaccnnngcggccggnnanccnggggnggacctcgccaggcatcctggggcctcatatttgacataagtnttggaatctgggcttgtcctctcaaaagcngcctgtataagtttccctggtaagtcacaggtggtggtgcagcattgctgtaaatgccagtccctgagcctcttggcatcacatggcccaaantcctgaangctgcctganccaggtgcacaggcctccggtcacggttaaagcaagcngaggctccactgccgtccattgctgggattttcccagtcacaaggttcagtactgcngcggcttc

SEQ ID NO: 504168 - DNA, 201 bp, Homo sapiens
  misc_feature (43)..(43): n is a, c, g, or t
  misc_feature (78)..(78): n is a, c, g, or t
  misc_feature (131)..(131): n is a, c, g, or t
ggtgccctcctcaggtgaaggaagcagcaacgaatctaatttntttccaaaacactgcacagagcctgaacgccagcntcaggcgggccagcagctcgaggctccgtaaacgggctccatcccggcttctnaccgggtaccggggggttttcaatgacagcaaacagcgtatgattttaccagtaagcaaagcagcctatt

SEQ ID NO: 504169 - DNA, 98 bp, Homo sapiens
cagtactatttatgttgagagaggcaaagggacaagttttggttttgccttcttcacaagtttgtttttaacgacaactaacaccagaccttttccat

SEQ ID NO: 504170 - DNA, 174 bp, Homo sapiens
caggtggagcagaatagtgcagaggctctccgttccaggcccatttatgacagatggcgggacaggaaatgcaatagaccagcctgcaagaaggacatgtgttttgatgacaggcagtgtggccggatggaacaagcacaggccttggaaatccaataggactgaatcagtaac

SEQ ID NO: 504171 - DNA, 298 bp, Homo sapiens
taccagcgttatgcctcacgtctgcctttaaactggataataaatgcggtactcctactcccaatatgagcacacacgtttgcaattctcatgtttgactgataacacaaactgtaatggtgaatgtgaaaactacagtctgtgtcatgacactgtcagtctttttcctattctccaattcattaagttcactgacgtaacctaaatttagacaaatccttttttctgcattatttatatgaatgtgcgcattattgtactaaatgtcatagctgatttgaagctttgtaactgtggt

SEQ ID NO: 504172 - DNA, 101 bp, Homo sapiens
tagaggatcccccagctactcgggaggctgaggcaggagaatcgcttgaacctgggaggtagaggttactcatatcactatgagattgttttttgttcttg

SEQ ID NO: 504173 - DNA, 192 bp, Homo sapiens
gtgcggaagactccactgtaggtggaaggcgtggcttgagacgggaattggaggccgagaaggaccttcccgttgggggaattcgtgatgatccaggtcccccaaggttggtgctcagtttttgataatcctagaacggctttagttccactggatgcagctctgctcgccccaagctagcggggaagggcc

SEQ ID NO: 504174 - DNA, 268 bp, Homo sapiens
  misc_feature (16)..(16): n is a, c, g, or t
cgccctataatccctngcacctttgggaggattccttgaccctctggagtttgagacgagctggggcaagatggtgagaccttgtctttacaaaaaaaaattcttttaagttagctgggcatgggggcacactcctacagtcccaactacttgggaggctgaggtgggaggatcctttgcactcgggagtttaaggcagcagtgagctatgatcacatcactgcactctagcctgggtgacaaagtgagaccctgtcttataaaagag

SEQ ID NO: 504175 - DNA, 193 bp, Homo sapiens
  misc_feature (71)..(71): n is a, c, g, or t
catgatctcagctcactgcaaccgcgactactgggtaaaagcgataaaactgccaaggactactgagtagntgggattataggcacgcaccaccacgcccagctaaaaaaaagtatttaaagtggagacagagtaacaccatgttggccaggctggtcttgaactcctgaccttgtgatccacccacctcggc

SEQ ID NO: 504176 - DNA, 383 bp, Homo sapiens
gagaggactgacagtggaggcacctactgtgttatctgcgccttcgatgaagtgagaaccttgtggagaacgggctgtggattaaggagtggaatgcaggcttgggctagacactgggctgggatcttctgggtcatgtgactgtgtatccaggagcagaaacttgtattctcaggattcaggatctaaccaggaccaaagatgtattttcaggagaacagacctagaaatgggcctgtctggcatttcagagtcaggcaaagcaggcagggcagggagcttctgtgggtctacacaagaaggttcctgtgagggctatcagttgttgccttctagcttgctggtaactttggggcctccgcaaagacctgtcagagtcccct

SEQ ID NO: 504177 - DNA, 131 bp, Homo sapiens
gacatgatatgaagtttgaggtgtgtactgtaaagtgcagcatattcatttgcaagctagagggttgggtgtcgggattctgtggcccagtgttgagctggtgtagcacctatttcttttgagtgttgtgg

SEQ ID NO: 504178 - DNA, 481 bp, Homo sapiens
gccgggacaaataagggaatagaagctggccaccccagccaacagcaggaacccgctgggtccaccttccatgctgtgggagctttgttcttttgctcttcatgataaatcttgctgctcctcactctttgcctccctaccacctttaagagctgtaacactcacagtgaaggtccacggtttcattcttgaagtcagcgagaccacgaacccactggcaggaacccactccagacacatcatgagacactaaaggagcactatggaggggctcacatgggtgaggaactgatttctttgagccatcttggaaatgtattttttaacctgaggcaaaccttcatatgattcctgccccagctgacagattgactgcaaagttatgagagatcctgagctggaaccagccacccagctaagatgctcatcaattcttgacctacagaaattgctaaagaataaatgtttgttgttttaaaaa

SEQ ID NO: 504179 - DNA, 186 bp, Homo sapiens
  misc_feature (7)..(7): n is a, c, g, or t
  misc_feature (55)..(55): n is a, c, g, or t
  misc_feature (72)..(72): n is a, c, g, or t
  misc_feature (83)..(83): n is a, c, g, or t
  misc_feature (107)..(107): n is a, c, g, or t
ggcacgngggtatcttgggtgttctcaagtagctaagtaagacaagaagaagggnggaaagacaatgtgacnagggtattgcnaaggataaaaggaaccccctgggngttttgtacacagatacataaaaggtggcaaagagcacaggaaagatgcacagtgagcacggtgttgggaccacgagtt

SEQ ID NO: 504180 - DNA, 363 bp, Homo sapiens
tgtttgctgctaaaaaacccaagattttgccctttttaaaccccccgtccctgtgatacccctttgaaaaaacttttaaaaatctctgagggaggggctctttttttcccaaagaaattatggacatctgggatgttttccaggggggcccccttttaaccaggggacatattgggcccccctgaaatgtcataaaccccttctctccttaaaattggttatttcctgtgggttcctttcccatgggtttttgggtggtgctgttttctccccgaaaacgggtttcataaaaagccccctgggatgggccatttttttgtaatttgccataaagtttgaagaataaagatctttaaaagttta

SEQ ID NO: 504181 - DNA, 589 bp, Homo sapiens
  misc_feature (6)..(6): n is a, c, g, or t
  misc_feature (13)..(13): n is a, c, g, or t
  misc_feature (26)..(26): n is a, c, g, or t
  misc_feature (28)..(28): n is a, c, g, or t
  misc_feature (43)..(43): n is a, c, g, or t
  misc_feature (45)..(45): n is a, c, g, or t
  misc_feature (53)..(53): n is a, c, g, or t
  misc_feature (60)..(61): n is a, c, g, or t
  misc_feature (67)..(67): n is a, c, g, or t
  misc_feature (72)..(73): n is a, c, g, or t
  misc_feature (97)..(97): n is a, c, g, or t
  misc_feature (103)..(103): n is a, c, g, or t
  misc_feature (124)..(124): n is a, c, g, or t
  misc_feature (132)..(132): n is a, c, g, or t
  misc_feature (137)..(137): n is a, c, g, or t
  misc_feature (158)..(158): n is a, c, g, or t
  misc_feature (446)..(446): n is a, c, g, or t
aaactnaaagagnacaaagtggcgtncnaaggtccacctcaangnactaaagnaacaagnncaaccnaaccnnaacccagcagaagaaaggaaatanccaagntcagagcagaactaaatgaancaatcaancaacnaaatatgaaagataaatgaancaaaaagccagttctttgaaaagataaatataattgatagatcattagcaagattaaccacgaaaagagagaaaatccaaataacctcattaagaaatgatacaggagacattacaactgacaccactgaaatacaaaagaccattcaaggctactatgaacaccttcacacacataaactagaaaacctaggaagagatggatagttcatggaaaaatacaaccctcctagtttaaataaggaataattagataccctgaacagaccaataacaagcaacgagattnaaatggtaatttaaaaattaccaacaaaaaaaagtccaggaccagagacactattccatgagacagagaaagaaggaaccttccctaactcattctatgaagccagcatcaccctaataccaaaaccaggaaaggacataacc

SEQ ID NO: 504182 - DNA, 819 bp, Homo sapiens
  misc_feature (79)..(79): n is a, c, g, or t
  misc_feature (191)..(191): n is a, c, g, or t
  misc_feature (226)..(226): n is a, c, g, or t
  misc_feature (242)..(242): n is a, c, g, or t
  misc_feature (250)..(250): n is a, c, g, or t
  misc_feature (257)..(257): n is a, c, g, or t
  misc_feature (282)..(282): n is a, c, g, or t
  misc_feature (331)..(331): n is a, c, g, or t
  misc_feature (335)..(335): n is a, c, g, or t
  misc_feature (349)..(349): n is a, c, g, or t
  misc_feature (369)..(369): n is a, c, g, or t
  misc_feature (378)..(378): n is a, c, g, or t
  misc_feature (386)..(386): n is a, c, g, or t
  misc_feature (397)..(397): n is a, c, g, or t
  misc_feature (401)..(401): n is a, c, g, or t
  misc_feature (423)..(423): n is a, c, g, or t
  misc_feature (436)..(436): n is a, c, g, or t
  misc_feature (439)..(439): n is a, c, g, or t
  misc_feature (445)..(445): n is a, c, g, or t
  misc_feature (447)..(447): n is a, c, g, or t
  misc_feature (449)..(449): n is a, c, g, or t
  misc_feature (452)..(452): n is a, c, g, or t
  misc_feature (455)..(455): n is a, c, g, or t
  misc_feature (633)..(633): n is a, c, g, or t
  misc_feature (641)..(641): n is a, c, g, or t
  misc_feature (647)..(647): n is a, c, g, or t
  misc_feature (651)..(651): n is a, c, g, or t
  misc_feature (655)..(655): n is a, c, g, or t
  misc_feature (657)..(657): n is a, c, g, or t
  misc_feature (661)..(661): n is a, c, g, or t
  misc_feature (679)..(679): n is a, c, g, or t
  misc_feature (681)..(681): n is a, c, g, or t
  misc_feature (686)..(686): n is a, c, g, or t
  misc_feature (690)..(690): n is a, c, g, or t
  misc_feature (692)..(692): n is a, c, g, or t
  misc_feature (694)..(694): n is a, c, g, or t
  misc_feature (703)..(703): n is a, c, g, or t
  misc_feature (708)..(708): n is a, c, g, or t
  misc_feature (753)..(753): n is a, c, g, or t
  misc_feature (803)..(803): n is a, c, g, or t
ctgcaaccccaggcatgaaccaaggtttctgaactactgggcgggagccaacgtctcttctttctcccgctctggcggnggcttgtcgctgcgggctgggccccagggtgtcccccatggcggggccgcgggtggaggtcgatggcagcatcatggaagggggcggccagatcctgagagtctctacggcnttgagctgtctcctaggcctccccttgcgggtgcngaagatccgagccggncggagcangccaggnctgaggcctcaacatttatctggantggaaatgattcgagatttgtgtgatgggcaactggagggggcagaaantggntcaacagaaataanctttacaccagagaagatcnaaggtggantccacacngcagataccangacngcagggagtgtgtgcctcttgntgcagtctcatgncgngtgtgntntnttntgncttctccatcagaacttcatttgaaaggtggaactaatgctgaaatggcaccacagatcgattattacatgatggtctttcaagccagtgttgaaaaatttggtttcatatttaattgtgacattaaaacaaggggatattacccaaaagggggtggtgaagtgattgttcgaatgtncaccattnaaacantggnaccncntaantttaatcgaggtgggtgngnggatnaagnananaggaagagntttcntcgtcggtgttttgcctttaaaatagcaaagatatggcagcggcncagttagatgcatcagaaaggagatccgggatttgtatgttaacatccanctgttcaagaactaaa

SEQ ID NO: 504183 - DNA, 437 bp, Homo sapiens
gagtgaacaaatatctgatgtgtgtgtgtgggtgtagtgatgacaaatatatactcagtctatcacagcataattagtacagaaactgaaaatcatacacatttccagttagggatcctaatttttccccatcactgctatataaattgaacaggcattaggcttatttaatagtttttatacatcagcaacttcagaaaagccacactgccgaatttaagaaacagtcaattcataactcattataaatatttaaagagcattaaatatggaggcagatatggtcccaaaaataatattccagatattgtgatagatgacataatataatgtttagtcccatactttctaaaatcagggcttctcaaacttttccattgaaactgcccctcttgacaaaatatcctaataaaaaggctgagagggaacatatatcc

SEQ ID NO: 504184 - DNA, 119 bp, Homo sapiens
ggcaggtcaaaaagaacctttattactttttatgattggcgacaacgactctcttgccaaatgccatggtagcaggtgcagtctggtgtcgtccttctatccccttctgtcgtcttctc

SEQ ID NO: 504185 - DNA, 572 bp, Homo sapiens
  misc_feature (8)..(8): n is a, c, g, or t
  misc_feature (24)..(24): n is a, c, g, or t
  misc_feature (120)..(120): n is a, c, g, or t
  misc_feature (129)..(129): n is a, c, g, or t
  misc_feature (539)..(539): n is a, c, g, or t
agatgtgnggaggtgctggatgcnttgatcaggaataaaaaggaagtgtagggagtctgtctcagtacccgtgtggctttcactgcaagtcaaaagtacgatcttgcacaggtcatagcngtgttcagnttgggcaagaaataaggctaattttttataggtataccgtactttccaaattgtgggttatgaaccattaatgcatcatgaaataaatgtagtgggtcacaatcagcattctttttaaaaatgagaagtatatgccatgtagtaacttacatgtaaattttgtttatacacagacaaaatgtgggtgtgtactgggtcctgacatgagacactgttcccattgtcgcggatcagggatagttctttgtggttttagttgttgagttctgtttctttgttattcctttcgtggcagcactacattgtagcgtgctcactaagtgtcagaggtttacctcacgccagttgtgttcatttggctgcaggtaactgaagacccaacctaaggcaaagcagacttctttattttngtaagacttcattaagagcagtttcagattctc

SEQ ID NO: 504186 - DNA, 415 bp, Homo sapiens
atgtttccttcactcactcctaccctctcacagagtttatgcactggctgttactggttgcaaaagtcataataatatctacagatagtctgtgtgtgtccaagacatgctcgctcctctgagaatctcaaacagccagaagcatctcgtcccacggactgccaggcgccagtgcggcttcacggtgcctctttctcgaccattatcacttaaaagcactgtgagtagaatgagctgagccgttgctgccacaagggagacagcctggtcaagaggcgtggcttgggatgcaataaggccactgcatggcgcacaccctaccgtacacacctctttctcctcttaccaatgaccatatactatgtgatccgtctcgacaaatgctgtccgctgctgagctgaagttcgggctagt

SEQ ID NO: 504187 - DNA, 145 bp, Homo sapiens
caccgcgggaacccacgcccacccccggcctctcctactccttaactacctctctcctttacaacctggcggcacccctcactctaccttactacaacacaccttctgtgtactccacttcccacgactaggctcacgggtgtac

SEQ ID NO: 504188 - DNA, 134 bp, Homo sapiens
aaattctattgttccattttatgcagaagatattttgtggtttgaaagattatgatgataagtttagatttcttatttttaagattttttgtattttgatggtgtagatttattattgttctattatatatatg

SEQ ID NO: 504189 - DNA, 1186 bp, Homo sapiens
  misc_feature (486)..(486): n is a, c, g, or t
gctcggcacggaggccacggatgccacatgcttcgcggtcgtccctggaactcgcggtgttcatcctgatatgatccgcgctctaacatgccgctggaagttcgaccagcgaacgagatcaaagtcggtataccgtgaggtgcagccggaggtgaagtcggcgtgccaggtgtctgccctggcccccaagatctggtcgccctggctcgtgtctccaaagaaaagttggtgatgacatttgcctgaggcacacgggtgactgcaacgggcactgacggacttacggcggcaaagtgagccattcagagcagcacacggcccacgatcgacggtggatgcctatctgcctctgcccctgaatcagtcaaacgccctcaacggaactcacccaccgacgaccagcaaacgacaagcacgtaacagcagactagtttagagcccaccaagcttgcggcacctcacttctaccttgtctttggacctgangcacttggctcgaccccacgtgttgacctcggcgcacgggactagcgcgcacacgcgcatttcgctataacgccccaggcaaggaaagcttcctcgtgaggaaactcccagtattcacccactgaagcactcccttgtgcggaaccctgacccccatagggtccacgtgtgcgggacctgggtaagaatcggcctctgtcacttggtgtgcctggtgcgtaatctctttcgtattgtaaaccgaatctagttccggctcttcgcacagttcgaaggcccaggaatggggtatgactatgcattgtcgcaacacgtgtgtccgcaaagtccgccacgtgctctcacacatgggcacccagaaactggaggaacaacagacgcaagttatgtcacaatcttaaccccgggggaagtgtccactcgtgtggaacccacaagtcgttcgtggcctcggcaagcaggaccactaacagatagacagcggaccaacagcacacaaccagaaacagagaaacacgggcggccgagacagacaacaacaagcgaaaagccactctgcacgcacctaaagtgcgagtgaccagcacacaaggacagagcagcagcagtaggggaaggcggccagatagcagaagagaagggcgcgagccatcaaagagagcgttcccgcacgtagagaacaagatgggataacccacgg

SEQ ID NO: 504190 - DNA, 370 bp, Homo sapiens
gtagacttttctatacataatatcctttttcccacagtagatttgtttttctgttttgttcttccgtttttttttttaaagtctagccgggtgcagtggctcacgcctgtaatcccagactgtgggaggccgaggcgggcatatcacgaagtcaagagacggagaccatcctgcctaacacgttgaaaccccgtctctactaaaaatacaaaaaattagctggacatggtaacgggtgcctgtagtcccagctaatcaggaggctgaggcaggagaatggcatgaacccaggaggcagaggttgcagtgagccgagatcgtgccactgcactccagcctgggtgacagagcaagactccatctcaaaaaa

SEQ ID NO: 504191 - DNA, 811 bp, Homo sapiens
  misc_feature (98)..(98): n is a, c, g, or t
  misc_feature (213)..(213): n is a, c, g, or t
  misc_feature (237)..(237): n is a, c, g, or t
  misc_feature (256)..(256): n is a, c, g, or t
  misc_feature (307)..(308): n is a, c, g, or t
  misc_feature (327)..(327): n is a, c, g, or t
  misc_feature (346)..(346): n is a, c, g, or t
  misc_feature (357)..(357): n is a, c, g, or t
  misc_feature (382)..(382): n is a, c, g, or t
  misc_feature (427)..(427): n is a, c, g, or t
  misc_feature (586)..(587): n is a, c, g, or t
  misc_feature (605)..(605): n is a, c, g, or t
  misc_feature (608)..(608): n is a, c, g, or t
  misc_feature (611)..(611): n is a, c, g, or t
  misc_feature (648)..(648): n is a, c, g, or t
  misc_feature (654)..(654): n is a, c, g, or t
  misc_feature (658)..(658): n is a, c, g, or t
  misc_feature (675)..(675): n is a, c, g, or t
  misc_feature (730)..(730): n is a, c, g, or t
cgggagaagccactacggctaggtcgaggcctggtgttatagaactcgtggccaggctgacgatagcctgaaaaactccacctggagctcacggaaanctgtctggacatgatggctcgatacgtcttctccaacttcacggctgtcccgaagaggtctcctgtgggcgagttcctcctagcgggtggcaggaccaaaacctggctggttggnaacaagcttgtcagtgtgacgacnagcgtgggaaccgggaccnggtcgttactaggcctggactcgggggagctgcagtccggcccggagtcgnngctcgcagccccggggtgnatgtgtagacagaccatgnaggctgccggnctagctggtagtcccaggctgggcngccaggtgtcccgctggtgcccgggatcgggtccgttccatgtcntgggggccatggtcttcgagttggcgccctggacgtgcctggtctcccagttcctgtggctgtgctgcttctccaggaccatggactgaccaggcgcgaaatctgagaaggcctcagctggcacccgggttcctgtgcaggagacgacgaacctggtgnnctatgtgcccctgctganccnggnctgggcggagatcctggtccggaggcgcacagggaanaccagntggntgatgagcctggagaanccgtcagccctttctcctcggacatcaacaaatgcccctgcaggagctgtctaangcctcatggcggtagagcgcttcaaaggaggcaccgggacacaagccctgttaccagtcacctgtcgttgccggcaagcag

SEQ ID NO: 504192 - DNA, 438 bp, Homo sapiens
  misc_feature (62)..(62): n is a, c, g, or t
tgtacaaataatataatatgtaatttgtgtattagtgacaggtgaagctagttggatttttngggtcgagtggggctttggagaacttttttgttttacaagaggattgtaaaatgtacctattagtggtttgtaaaacacaccaattagtgttctgtagctagtaataggtttgtaaaatgacccattagtattttgtaaaacgcaccaattagcattctgtaaaatgcaccaattagcaggattttaacagtagacaatcacagggaggattgaaaaaaagggcactttgatagggcaaaaacggaacatgggaggggacaaataagggaataaaatctggccaccccagccagcagcggcaacctgttcaggtcgcctgctgctgtggaagctttgtccttttgctcttcataataaaccttgctactgttcaaa

SEQ ID NO: 504193 - DNA, 250 bp, Homo sapiens
gtatcggcggaattcgactaaaacgttgctgatcggtggtgtcgggctatccttatggagaaaatgatccgagaaattagtagataaataaaaatataggtaaaacgttatttacaggtttatagaggagtgaatacgttgtatgatacatgtaaaaagactgctagaagcgtttctcctttcagccttgacgctgcttgtgcttcttgttcgacttgcagtagatgtacactcgcccttttcttctacc

SEQ ID NO: 504194 - DNA, 418 bp, Homo sapiens
gccggtcccttataatgggccagaaatttcacttatcctatagctagcattctagtagcttggccaagttatctcgtaattctgttagttcaaatatactattccatccacgcatttctacagagtgtctatacaggttatatagcgaacaagctatctatgtaacatatctagacttattctaccagaacgtatgctactaagtacagaacagtatagtaccccccagagtctatatagtatccagaatttactactatacctagtaagtattctagagtacaaaagaataccctactagtatctatgtaagtatactactaggacatatatacacattatactatgtattataaacctataactaatattacctactatacctatacaaatatttctagatggccccaatatatac

SEQ ID NO: 504195 - DNA, 127 bp, Homo sapiens
gcacgttgtgaccacccgctcagcctcccaaagtgctgggattacaggcatgagccactatgcccagcaaaaagcaatgtagtactttaaatgaatctactggtaaggtgggtatgataaacaaaag

SEQ ID NO: 504196 - DNA, 472 bp, Homo sapiens
atgatggagtggctttctcctaccgcatcccaccactgctaaaccacatgagaaatatttctaataggacaccaggaaatctgccaaaagaaacagtttcttagggaggctgaggactgagggtcctgtcttatagatcaccccagctgccaggagagaattactgtaggatggaaggtatttgtttaccacagcccctgaagtccgcctcctctgggagagaagtggtaccagccccctggttactcatgcaactctgtggtcatataaatgtcagtgctgatttgttgaaaggtcccttcacctgggatggagagcgcagcttgtttgtctctagtgccagtacctttttcaggccaccctatcagaaacagtcttatttttgaaacagttaagagaggcctctatttttaaagactgacttgaaatctttctttttttctgtttaagtaatcatcaacaggattttttt

SEQ ID NO: 504197 - DNA, 208 bp, Homo sapiens
cctccctctatacccccctgtggctatggttctcccccacagggctggcctcacgtttttcctcaacacggcctgggggcaagcccttctccctgcccatgtccccgcctgaggtgcccagccccccacaccccgcctgccgccccctgtcccaggttctcctcccccccacccagtgaaattaagcatcccccccccccagtttcca

SEQ ID NO: 504198 - DNA, 989 bp, Homo sapiens
  misc_feature (989)..(989): n is a, c, g, or t
cacttcctgtatggagagtcagaagcttccagtgcctccaagggtccatggtaccacctactgagactctgcccactcccagggagaggaacctagcatccccatcaccttccactctggttgaggcaagagaggtggtgggaggcaacttggtggtcctgagctatctggaggtccctcgaggagagagcgaggagacaggaagctccgagggtgccccattccctgcttccagccacactgggcccctgagggtaccagtggagcatggaggccccctctgaagataattctggaagaactgccccagcagggacctcagatgcaggcccagaccagatgcatgacccactgacagcgccagacacgaggatggagatggccgatgggtccccgacatcaggatgacctgatgtccccagacccctgaccacaatggtgggacatgctatagaggaggaggaaggggtccagatgcctatgtactgcctggctatagaggaggaggaccatgtagcgacatgtaaggcacatcacgcttcatgcaaacaccggcatggagacgacctacacagggacagcactgaatacaagacacaaaaccaacacgacaggaagcaggagaggaggacaaaagaacacagaagacggatggataacgcgaacgcaatacagaaccagcgaatacaaaagaaccagaaggaaacaggacatcaaacaacaaaccaggtaaccgggaagtaacagatgaatcggaatcaaagacaagaaaaccaataagaaatgcaaacttccattatgcaggggacagaatatggaagtcacaacattggagcctatgagaagacacttgtgaaacacatagagaatagcctaggaaagataacataaccaaggttcttgtgaaaaaaaaatggagtagaacaatggagtaatggaatcataattaggaacaaaatgagataagaaagtgcaacgggaaaattagn

SEQ ID NO: 504199 - DNA, 463 bp, Homo sapiens
gtggcattcattgtcctccagcgttttggagggttctgtctactattatagactattcgcttctaagcgaaggcttctcatatcattaaaattattaatattactgctgtttgagaaatgaatgatcctacagattataggatgtttcatgtggtgtatgcatcggggtactccgagtaacgtcgtgactttcagaactctccgagaaagtgttgtgggaaggttaggtctacctggcaggtagacctaacgtctttacgtgggtacttgcgcttactttgtagccttcatcagggtttgctgaagatggcggtatataggctgagcaagaggtggtgaggttgatcggggtttatcgattacagaacaggctcctctagagggatatgaagcaccgccaggtcctttgagttttaagctgtggctcgtagtgttctggcgagcagttttgttgatttaactg

SEQ ID NO: 504200 - DNA, 1616 bp, Homo sapiens
  misc_feature (1290)..(1290): n is a, c, g, or t
gcacacatacattctagcgcgaccaagattgacctctgtgcgctagattagaatattagatatcggaaaagggtgaagagatgacaaatgttgtagaactcaagacgatccaacatagctaagggagcattaaactcccgtgataacctgttctgactagtctagtggatagtgtaactatcctacatatgcttcaggctatgagcgagaccaccgtcctattatgcccacgcacaaacagtgatgcagtgctcaccatacgtacaccagatttagaaagagatagctgcgaccaccgtcctcatagcttatgcgcttagatcaggtgggcagcaatggatatcttaggtagcgttgagcacggccaggtacacacatagcatggacacggcatgctttggagataggaatgaagcatatggtatagtgccctaagtgattgaaggacatctatatactttacgaaaccctatgtagtagtataatggccctccatggaatgcaaaagccacgtacttgatagacttgcgcgcgcttctgattagacacttatgtgatagcgttgttgtaaagggtacgcaacacacggaaggagtataagcgaaggcagtccagttattagcgtgatcaaccataaatggtgaagaactaaacacctcgtgtggttgagcaccgcaagaagggtcaccaaaaggaaaactatttgacccacccaccgtctccaataagtcttaagccgtgccgttggacacgagatgggcccacggacacaaaaccaccaaagttccagatgccgacaagcaggccagctatcccgagaaggacgggacgataaccataaactggaccaaactgtaaactcggttacaacatccagattgtcaccttccagagaaccagttgaaatagagaggcgctgcgaatacgatacgccgaacaaaggaaactctccgaaaattggggggtgatcgcccataggtacattgaagttcgagcagcccttaaattagggaaaaggaaatagcggtaacacgttgcttttcacggagtaaagttaaaagcgcatagagccaggtgggaatataagcgactataccgtgtcgcaatctacagttcactacaggggccccatgagccgcgtccagggcacttggactgggaaactatcggtggagagcccgttttggattgacacgtataaaggcgcacgttcgcgcgacaggataaattcttatccccgacatccgaagcccccgagacgagaatagcgtcgaattcaacatgtacacnctgcgtccctacttgggattgaaaccaccaaaaacaacataggggtgctaatatgcaaacaagtataaggggggaaacatctgttgacaactaccaccacgtatggaggtgggtaaacacactcgtgtgacatagttcgtgtatacccaccgagccgtagataacacgcacacaaaatatcgaacccaccaaacgacttaaacccagcgatataaataaagagagagaatgcacaagtcaccatagaggacgacgacatatgaattaatacgggtaacgtaagacaacccttacacaagcgggatcacaaggaacaagcataacaa

SEQ ID NO: 504201 - DNA, 225 bp, Homo sapiens
gctgctcctgcggtcgctctagcggtccccctcgcttacggtgtccttctttcgttttcccggtgcttctttgacccggctcttcctcctcctcttcttcctcctcctctatcatcttcatcatcatcatcttcatcctcttcgtcgtcgtcgtcctcctcgtcctcatcatcctctacttcatcttcatcctcagccccgttcttggctttccaccaggcacac

SEQ ID NO: 504202 - DNA, 569 bp, Homo sapiens
  misc_feature (158)..(158): n is a, c, g, or t
  misc_feature (336)..(336): n is a, c, g, or t
  misc_feature (348)..(348): n is a, c, g, or t
  misc_feature (360)..(360): n is a, c, g, or t
  misc_feature (385)..(385): n is a, c, g, or t
  misc_feature (387)..(387): n is a, c, g, or t
  misc_feature (410)..(410): n is a, c, g, or t
  misc_feature (445)..(445): n is a, c, g, or t
  misc_feature (475)..(476): n is a, c, g, or t
  misc_feature (513)..(513): n is a, c, g, or t
  misc_feature (522)..(522): n is a, c, g, or t
  misc_feature (546)..(546): n is a, c, g, or t
agggtgcacatgtatccctgaacctaaaatataagttatagaagaaaaaaattcactcaagtctgtactatacaactactcttgtgtttagtgacctctagctactccaaagtgacttggtagtccatacctgatttcttcatgtctacctctacggnggctacctctttttctgatattctgtcaaaagtgagacagttcatgatttcatctctctttggtgagacttgtcacttaatttttaatggatgggttccttgtaaacccagggctctgaagggctcaagaaaactgagaaatttaaagcttaatttggctttttatcattaattattngggaaccaatanatctatcccagntttttaatgctctaaaatgaaagcngnaaggtacttaattggggcaattnattttggggttaatgcctttaattggggaatagcnattcaccatatctaaaaaattcccaatttnnaaataatgtaggttaaggtggtggtttaattttcacnggatcatgnggccatactacctttcaacttccngaatatttctataccccggcccc

SEQ ID NO: 504203 - DNA, 877 bp, Homo sapiens
gttgaagggggaaggctccactgcattcttggctaaggcctgaatgctggctgcatctgtaagatctatactcgaggttttgttatccttttaaaattctttagggagagagggatggtttctcgaggggtcctgaaagtatgattcaatgtgcaacatacaggtaggtcttcagcataagctgaagatatatgcatgtaaaaacttgagcatcttttggtctgaattcccgcactttcttcttgaaacttgacttctcgttttgtccccccccagtcttacagaagttgaggccaagggagaatggtgggcacagaagagacgtggcaagactgctctgtgcgtttgcaaagccaagagtgttccccacccgaagctcccaaaattgtactaagcagccgggccagtctggtagggggggcatgggtgttctacaagccaaattctgggtttgttcttctttctttaaacatagaggtaccaccaaagggatgccctactctctcgcaggtcttgaaagcatctgtttgagggaaggtctctgggcaagcagtggttattgggatgtgcttgcttccctttttccacctgggacatggcaatcataaaataaccgtaaattccaaacctcaaaatattatgggctgagcaccaggtgaatctagcagagtttactcttctgcccctgtgtggcactataatcaggtgcgcgggggtcgaacagagccgaaaacggtatgccagttgcgtccggggaccccctggggggtcccggtagccaggggggcccccctccacaagggggggccacgagggggggggaggccagagggggggccccctgtagaaaaaggggcggacagcaaggcccccgaga

SEQ ID NO: 504204 - DNA, 568 bp, Homo sapiens
ggagaaccagaaacatatctattatatcacaggtgagaccacggcaccaggtagttaagtcagcctgttggtgtaacgtcttcggaaacatggcttagaagtgatctatatgattgagcccattgatgagtactgtgtccaacagctgataggaatgggaggggaagactttagttgtcagtcaccaagagaaggcctggaacttccatgaggcatgaagacgagaaaaatgaagcaggaagagaaataagaacaaagtttgagaacctctgcagattcatgacagacatgttgggaggaaaaacgtggaacgcggtggtggtgtcaaagcgatgggtgacatctccagtgctgtatgtgtcacaagcacatatggctggaaagcaacgatggacgagaatcatgaaagctcaagccctaagagacaactcaacaatgggtttacatggcggcaagagaaacaccgtggagataaacccgtgaccattccattatggagaccttaaggcaaccaggcagaggtgagaatgaacgacaagtctgtgaaggctctggtcaaccttgcgga

SEQ ID NO: 504205 - DNA, 172 bp, Homo sapiens
cgatgttatccccaacactttattacaaaataggctttgggctgggcgctgtggctcatccctataatcccagcagtttgtttggccaaggcgggtggatcatgaggccaggagatcgagaccacagtgaaaccccatctctactaaaaatacaaaaaaattagtcgtcatg

SEQ ID NO: 504206 - DNA, 636 bp, Homo sapiens
atctttcctgccggatcgactctatacgatccccccatgctgtcttcatgatgctatcctgtctttttagaaaagctgctaacttattcagtgtattgcagttggcatagcaggccttgactgccttggaaattttgtcacggagacatagtaaagccattctataggcggctggtttggcagactgcttgctgtacctagaattcttcagcattaatgcccaaagaaatgcattagcaattgcacgctaattgctgccatagtatcacgccagatgaatttcatattgtggcagattcactcccattgctaacccaaaggctaacacatcaggattaaaagtcagtacaaagcacttgcctttgttttgcacgcctagtgtacaacttccagcatgaggagaatttactccagcaggttgcttccaaagatctgcttacaaatgttcaacagctgttggtagtgactccacccatcttaagttctgggatgtttataatggtggttcgcatgttttctctgatgtgttccaactgtccaactttagctgttcaacttatgaaacaaaacattgcagaaacgcttcactttctcctgtgtggtgcctcccatggaagttgtcccgaaccgattgat

SEQ ID NO: 504207 - DNA, 175 bp, Homo sapiens
  misc_feature (170)..(170): n is a, c, g, or t
atcgtcaaagccggattgaaatgtggacccattacatcaactacaaggttcatttttgagaaaaaattggctcaggctttactggagcaagaaagaagacagccttcctccttgctccagtaaagcctgagcaaggaggaaggctgtcttctttctactaccatgaggcnggtgt

SEQ ID NO: 504208 - DNA, 381 bp, Homo sapiens
aactttggacaattttattagtatttttgttttttattttagagcagcaatgtagggtaagaaagaacaagaaattgaaatcaactgtctcctgagttcagactgatttcactgcttgttagctgtgtgatcaataacaagtgccttagtctttctgatccccagtcgcctgcaaagtgaaaataatgtttaaatgcattttaatggctaagtgacatgatacacgcaaattatttaagagaatgactgacatgagatttggccgggtgtggtggctcatgcctgtaatcccagcactttcggaggccgaggcgggcggatcacaagatcagacgattgagatcatcctggctaacatggtgaaaccccgtctctactaaa

SEQ ID NO: 504209 - DNA, 891 bp, Homo sapiens
  misc_feature (356)..(356): n is a, c, g, or t
  misc_feature (372)..(372): n is a, c, g, or t
  misc_feature (416)..(416): n is a, c, g, or t
  misc_feature (434)..(435): n is a, c, g, or t
  misc_feature (438)..(438): n is a, c, g, or t
  misc_feature (446)..(446): n is a, c, g, or t
  misc_feature (449)..(449): n is a, c, g, or t
  misc_feature (451)..(451): n is a, c, g, or t
  misc_feature (476)..(476): n is a, c, g, or t
  misc_feature (480)..(480): n is a, c, g, or t
  misc_feature (493)..(493): n is a, c, g, or t
  misc_feature (504)..(504): n is a, c, g, or t
cgcgccgtgggggagtcgtgcgcaggcgcggacagcgctgcttccgcggcggttggggtggtggggccccgggcggcgttgaccatgacccagcagggcgcggcgctgcagaactacaacaacgagctggtcaagtgcatagaggagctgtgccagaagcgggaggagctgtgccggcagatccaggaggaggaggacgagaagcagcggctgcagaatgaggtgaggcagctgacagagaagctggcccgcgtcaacgagaacctggcacgcaagattgcctctcgcaacgagttcgaccggaccatcgcggagacggaggccgcctacctcaaaaacctaaaaaactcccaaantttcctcaacattatnaaaaaaaaaactaaaaacctaaccaaactacaaccccaaaccanaaaaataaccactacaannacntttttttnttntncgtccaattccttcctcctttttcncctnttttcaacccctncaaatttttantcaaaacatctttgttcttcacggcagcagctaccttccctcactgtctcaggtgccgagaggggcaggtgccagcctccactggcatcagtgacaagcccagggcacagcccacccgggggtcctcgcttcatgctcacacaggctatggggatggtgggctccaggtcagctctgcaaggggcttgtctctgtggcacccacactcctgccctgccagggaggctctggttgtctgagcaccatgggggccccctcaccttgtccctcctcagccagcagaggcccagggcaagggacaggaggacaggggttctccttcaccacagaacccaaacctcaggtctcacccctgtggcctgtgattatgaataaagattatctttg

SEQ ID NO: 504210 - DNA, 731 bp, Homo sapiens
ggtggaggccatcagtggccttcatagcacaggagtttcaatggtgaaccatgcctctttgggtagagggctgcgcacaaggctgtgtgcaggaatcatggttaggagtgagtaagctggaccaggttggtgtccacgatcaacaggctgttgcgcctgtgcatggctgatcgcaagagaatacagtggtggtgtcgatggcactcttcattcagtgactggtagagatgcaatgggcacgttagagcgcgctggtagcgtctacggcagagatggtcgtccgtgggagcaagatagaccacttcgaccgtattatcatctaggagccgcctactggcttttctgttgcgttatcatgtgctaggaaaccctttgtctttgaaggcttccttgaggtaacgtgcggccgtcttgatgtatctattctatatgtattgtattggtcaagtaagaggcgatcagttctagagattccgtcattctgtattttaatggcccgtcagcaccaggatccaggacattccatgctaggttttagcagtgagagatagcgctctcaagaaacatgtcgaaagcgactacttataggaccagaatccttgtctaagctagtcctagccttacgacaaacatctttaatagggttagcagctcttgttgctttatatattgatacctgtaccaagggactcgtataatgagtgtacaggcgcactctagaatgacaaggc

SEQ ID NO: 504211 - DNA, 992 bp, Homo sapiens
cgcgccgtgggggagtcgtgcgcaggcgcggacagcgctgcttccgcggcggttggggtggtggggccccgggcggcgttgaccatgacccagcagggcgcggcgctgcagaactacaacaacgagctggtcaagtgtgagcggcgcagccgggacggggaggtcgggagggccgcagggccgggttcccggctcgcagcggggtgcccctggacccgcctcgctgcgggcatcgcgcggctgagcagagccctccgtgccggaggccgggtgtccgtggcccgagccctcgctggctcgcaggccccgcgccgggcgctcgggggtggtgcctgactctggcttcctcgggtggaaggaggcccgccctccgccgccgcgctcctgccctgggcccacagcgccgcccctcccggcccccaggcatagaggagctgtgccagaagcgggaggagctgtgccggcagatccaggaggaggaggacgagaagcagcggctgcagaatgaggtgaggcagctgacagagaagctggcccgcgtcaacgagaacctggcacgcaagattgcctctcgcaacgagttcgaccggaccatcgcggagacggaggccgcctacctcaagatcctggagagctcccagactttgctcagcgttctcaagagggaagctgggaacctgaccaaggctacagccccagaccagaaaagtagcggcggcagggacagctgaccagaccacgggcagggcctgcctccgtgtgcccctcagctcagccccagcaagtgtgtgctcagagcatctttgttcttcacggcagcagctaccttccctcactgttctgagcaccatgggggccccctcaccttgtccctcctcagccagcagaggcccagggcaagggacaggaggacaggggttctccttcaccacagaacccaaacctcaggtctcacccctgtggcctgtgattatgaataaagattatctttg

SEQ ID NO: 504212 - DNA, 829 bp, Homo sapiens
cgcgccgtgggggagtcgtgcgcaggcgcggacagcgctgcttccgcggcggttggggtggtggggccccgggcggcgttgaccatgacccagcagggcgcggcgctgcagaactacaacaacgagctggtcaagtgcatagaggagctgtgccagaagcgggaggagctgtgccggcagatccaggaggaggaggacgagaagcagcggctgcagaatgagatcctggagagctcccagactttgctcagcgttctcaagagggaagctgggaacctgaccaaggctacagccccagaccagaaaagtagcggcggcagggacagctgaccagaccacgggcagggcctgcctccgtgtgcccctcagctcagccccagcaagtgtgtgctcagagcatctttgttcttcacggcagcagctaccttccctcactgtctcaggtgccgagaggggcaggtgccagcctccactggcatcagtgacaagcccagggcacagcccacccgggggtcctcgcttcatgctcacacaggctatggggatggtgggctccaggtcagctctgcaaggggcttgtctctgtggcacccacactcctgccctgccagggaggctctggttgtctgagcaccatgggggccccctcaccttgtccctcctcagccagcagaggcccagggcaagggacaggaggacaggggttctccttcaccacagaacccaaacctcaggtctcacccctgtggcctgtgattatgaataaagattatctttgtaaaacaacaaagacaaataaaaaaaaaaggggggggcctcaaagattcca

SEQ ID NO: 504213 - DNA, 370 bp, Homo sapiens
  misc_feature (39)..(40): n is a, c, g, or t
acttagaggatccgccacggtagattggctgggcgatgnncgttactcatcatgatcgccaggatcaccacttccaccaataccgcggcgagggtcaggatcatggtgccgtaggggtcgccgactttttccgccaactgttcggcgtgatgggccacgcgcatcgacgccatcacgataaacgcgatcagcgcaaagccggccagcaacgcaaccagttggccgctgtggagcatccagtgctccagcgggtaggcggcgatggcggcaatcagcgccagcagcatgaatttttcttgcttgagggatgtgagcattccgggccttttcgtacagcgaatcagtcattgatggaaatctaccggtgggg

SEQ ID NO: 504214 - DNA, 412 bp, Homo sapiens
cgcgccgtgggggagtcgtgcgcaggcgcggacagcgctgcttccgcggcggttggggtggtggggccccgggcggcgttgaccatgacccagcagggcgcggcgctgcagaactacaacaacgagctggtcaagtgcatagaggagctgtgccagaagcgggaggagctgtgccggcagatccaggtccaggtcagctctgcaaggggcttgtctctgtggcacccacactcctgccctgccagggaggctctggttgtctgagcaccatgggggccccctcaccttgtccctcctcagccagcagaggcccagggcaagggacaggaggacaggggttctccttcaccacagaacccaaacctcaggtctcacccctgtggcctgtgattatgaataaagattatctttg

SEQ ID NO: 504215 - DNA, 230 bp, Homo sapiens
tgtccttccccagtgacgggtcatggcatcttggtcaaaaatcagttgattatatttgtgagagtttattttggggttcttttttcttcttcttttctttttttcaggttggatgggtagtgctgacatcataacaaggttcaagaatgactcatctcacatgtgtgtgaaacacccaggtatcatactgatgaactacagaagatctgggctctctatggttttatatg

SEQ ID NO: 504216 - DNA, 288 bp, Homo sapiens
ctgagaagccaggctggctgctggtgaatgtgaacgctccagctaaggctcggaggctgctgcggtcccagacccttcaccggcccttgggacccaaggctaggcgtaacctgttggtgctgacccccaaaacgcaggcttaagtccactccccgccctaagatctctgtgtgtgtactgggggaccagcatcactgtgacgaggctaaggccgcggatatcccccacatggacatcgaggcgctgaaaaaacttaacaagaataaaaaactgtgtcaaaagcttgcc

SEQ ID NO: 504217 - DNA, 150 bp, Homo sapiens
cttttctgcgtttgtgccatgcatcatgtttgcggtttcgcatgcatgtggtctttggcagtagcaacactgtgcaggccaaggtcattcctagctcaatgctcaggcttgcccaatggtgcagggcaggttgcaagtgcagcagcgtca

SEQ ID NO: 504218 - DNA, 256 bp, Homo sapiens
acaggaactgatagcaagtgcattaaaaacatgaatttatgtgcacacatggtctcatgcttccggctcagagcaggatgatatcctctcagcgtatttccaaacagcttttttgctgagcagaagactcctcctggctacagagggggttatagttgtctctgcttccttatatgtagtctcttcccagtcttaagagatcctccttgatatgacgcttgtccctccctttcccatggtgtatgctcgcgctttg

SEQ ID NO: 504219 - DNA, 659 bp, Homo sapiens
  misc_feature (525)..(525): n is a, c, g, or t
ttcgagtcaggaggatggccaccgacgcatcctcctcttctctggagaagagctacgagctgcccgatggcgcaggtcactcaccattgggcaagtgagcggtatccggctgtccgccaggcgactgatatccagacctctacctatccgtgggctatggtaagtctctgcgagacatccagcgagcaccatccgttcaagcgtccactctatgagagtgtagacgtggagcagtccgcaacagacctgtacgccaacgacggtgctgtcgggcggaaccaccatgtatccggggcattgctgacaggatgcagaaggagatcaccgccctggcgcccagcaaccatgaagatcaatgatcatcgcagcccccagagacgcaagtactcggtgtggctcggatggactccatcctggacctcactgtccaccttccagcagatgtggattagcaagcaggagtacgacgagtcgggcccctccatcgtaccaccgctaaatgctatctaagacggactcagcagnatgcgtaggcatttgctgacatgggtacaagtggacgaatagacaatttgccccgtggcaaagtgcacacacctcatgctagcctcacgaaaactggactaagccttcgaaaagagattgtccttgaagcttct

SEQ ID NO: 504220 - DNA, 161 bp, Homo sapiens
tccataatgtgtgcccaccaccacacgggctaacttctgcattcttagtacagacgaggcttcaccatgttcgccaggctggtcttttttcttctcagataaaatgttttaatttcagagattggtctctattttatttgactgggacacacattatggag

SEQ ID NO: 504221 - DNA, 125 bp, Homo sapiens
tatattagcactccttttcttcacatcctcaccacatctgttacttttgactttctaaaaatagcccttctgactgtgtataagattggtatctcctagcatttttccttatctctgcatgatat

SEQ ID NO: 504222 - DNA, 1773 bp, Homo sapiens
cagtttgggaggctgaggctggtggatcacctgaggttgggcagtttgcagcaccagcctggctcaaccatggtgcaaaccatcatcgctcactcacacacacatcccagcacacattcagcctggcatgacagcaatgcagcacccaccatctcgtcaacacaacacacacacacacaacacaacaacacaacaacacacacacacacaacaagcaacaaacatagaaaacaaaaggtgcagaaggagacaagacagagagagagagagggagacacccgcgcacgctttacagacagaacacacaaaacacacaacaaaaacaacaccaacaaccagacaccacaaaacacacacacaaacaaaaacgagcaccactagcaacacacaacagactagacacccgcaagagcggagagcgggagagagacaagagagcaaaaccaaagagagagggagcgacagaaacaaaccacacaccccagacacacgaaagcagataagatagaaaaagaagaggaacggggaaagaagaaaaacgagaagcgataaaaatatgacaacaaccaacaagaagacccgggaagacgaccgaagaaggacacacaaaacaaacacaaaagcgagagggcagcaggcgcgcgccacaacggcgcagacgagactgcgagagagagtcgaacacagacagggagagtgcacgcagcacagagacaacgcaaaaggagcgaaagctacgagactacacaacaagagcgcagggagctcgcgcaacgaccaacagagcactcacagagcacaagaccgaagcgaagaagcacagaagcagacaagagagcaggaggagaagagaaacacaaataaaacgaaggaccacagaccagacgacgagcaggacttacagcccactcagtgagcagagaacaagcagacagaagacaacgacacgcagcacaagaaccaagcgcgacaagcaggaggaaggctcacgagagagaccacgtatcgacaggcgcacgacatcacactgcaaggcgaaagaaagaggcaaagccagacagcaagaaacaacacagcaccacgcataaagaaccgcgagaccagagaacaggaatcacaacataccggtaaagcaaacacagacgcacaggacaagaagcacagacggaaacaagaaaggaaagacaacagcaaataacgaacaccgagaacaaagaagacagaagcatcaacgagaagagcggagacagcaaaggccggagagaagccgaagagacacaagaggagccagcgagagatacaacagacagagacgaacgagagggaaagaacagcagatctgatgcaggcgagagagggacggaggcggcagggcgcgcgcgcgagcggagaagcgcaccaagggcagagaaagagacacaagaaaaaggaagcgggaaagagggcagggaaaacgaggcaacacagcggcagcgagagcacgaccagcaggacgcaggcgcagacaccggacacaacacgaacagcaagacggcggcacaggaacggagacccgaagggagaaaacaaggaacgagtcacgggcgcgtacgcgacaaggacgagatagctagagagcaggccgaacacgaagagaggcgacagacaaaggaggagggacacacagagacgaagcagactggcagcagtggcagaaagtagcaagcggacgagagcaaccgacacgaaccagcggaggagcgaagagagagcagggcgacagagcgcaaacgg

SEQ ID NO: 504223 - DNA, 475 bp, Homo sapiens
acatgcattctaaaaagcagcacactaaacagtatctacaaccaaggactgggtctacctcactcccctgccacctccatccaagcaagtgctggcatccatgcctgggagacctgaagacagatcacatcacaggactctttgcagacattccctagcaccagcgcagagcctggtagtcctgctgggtggctagacccagaagagaaataagattcactgcagtccagctcttaggaagccccatcctcaagaaaagggggagagcaccacatcaagggatcaccccatgggacaaggaaatctgcacattaagacttgagttccacacctttccacttaaacagactaccaaaatgagaaggaaccagaaaagtaattctgggaatatgacacaacaggattctacactaccaccaaaagatcacaccagctccctaacaatggatctgtacctagaagaactctctgagat

SEQ ID NO: 504224 - DNA, 447 bp, Homo sapiens
  misc_feature (7)..(7): n is a, c, g, or t
  misc_feature (18)..(18): n is a, c, g, or t
  misc_feature (59)..(59): n is a, c, g, or t
ttttggnaataacccccnggtttaaaacccaccccttcatggaatccaagtccccatcnaaatagactgtaactattccaagggagaaaactagtatgtttccccccttgaagaacatggaattaacagtgttcctcaatccccaaatgtgtcatattagttatagaagaaattatggggtgggtgcggtggctcgtgcctctaatcccagcacttcaggaggccaaggtgggcaatcacctgaggtcaggagttcaagaccagcctggccgacatggtgaaactccgtctctactaaaaacacaaaaattatccaggcgtggtggtgggcacctgtaatcccagctacttgggaggctgaggcaagagaactgcttgaacctgggaggtagaggctgcagtgagccgagtttgcaccactgctttccagcctgggcgacagagcta

SEQ ID NO: 504225 - DNA, 258 bp, Homo sapiens
cattttgtgaagctgccacactcatccattctatcgctgatggcatttgggtgttttcagtttggcactatttttagtttttggctattatgaatcatgctactatgaacaatctttgcttttttaatgactatggttcaaattccttaggttatctactatatacaatagggaaggccagccatggtggttcacacatgtcatctctgcactttggaaggctgaggcacatggatcacttgagctcaggagttcaca

SEQ ID NO: 504226 - DNA, 660 bp, Homo sapiens
ggggaaaaaaaaaaaaaaaggatataaaaaaaaaaatttaaaaaaaaaaaccaaaaggcaaaaaaaaaaaaaaaaaaaaaaaaaaaaaaatataaaaaaaaaaataaaaaaaaaaaaaaaaaaaaaaaaaataaaaaaacaaattaaataatttgaattaaataataaaggctcaaaaataaaaaaaatgaatgattaatatataagataatataacataatttatatggactttaataacatgtcatttttacctgtatcacttgatttttttggagttgcattttgtttgacatttcacatatttgttcaatgggagtggcattttaaaattggactcatctttatgtcactctgtgtcgggaaaaaccttgggtgtatccatttaatttgttatttgtacagcctgatttttagaaggtctttacgattaataggtgttcattggagtatgttctagttcacattgtttttgatacaatgtctaatgtcattttaagtgtgcttctacttaagaaatttatagactgttttcatttcattgtcttttttataagcattctgctaaatgggaatttgttttttgattttccgaggtcacattttgtttacctttgggacttcatgtttttctttatggattttttttttccagttgtt

SEQ ID NO: 504227 - DNA, 394 bp, Homo sapiens
tctgtagctatgtcatgccccctgagtcccctgacagcgagggtgctgctctcctaactccaggctcccccatcatcttgaccataggttcgggtaggtcagttccccctgctagaccaggagctctcttgtgtcattggccggatcttgttcatcttggcgtcctgacaagctcagactctctgaagcccagctcctggggccaatgcgggatcagcactgggcatcttctctccagctgtcttcctgccggcccccgcaacttctgctctgctagaatcctgtgcggtgactcagcctctgggcgatgttccttcttccagttccccaatttggggaaatgacttcgacccacagcaagcatctctagcttacccaggaggatctgtcttca

SEQ ID NO: 504228 - DNA, 270 bp, Homo sapiens
  misc_feature (33)..(33): n is a, c, g, or t
  misc_feature (49)..(49): n is a, c, g, or t
  misc_feature (86)..(86): n is a, c, g, or t
  misc_feature (140)..(140): n is a, c, g, or t
tcacacgcatgggacactcattcaaatgcgtgnctcaatgtatctaatnatactgaaacaactactaactcactctcactactganctgctattatcatggggtcttttagccatataagagttattatatgcagacatntaaacagaaaaaaattggcttcagtagactaagaagctggaccttaaaactactttctttctcgtgggagctgagtattccactcagaaatagatgtataactccgatattctgcccagttgcgggtgaa

SEQ ID NO: 504229 - DNA, 623 bp, Homo sapiens
  misc_feature (118)..(118): n is a, c, g, or t
  misc_feature (180)..(180): n is a, c, g, or t
  misc_feature (402)..(402): n is a, c, g, or t
  misc_feature (501)..(501): n is a, c, g, or t
  misc_feature (571)..(571): n is a, c, g, or t
  misc_feature (618)..(618): n is a, c, g, or t
ggacgcccaaggaccacctgaacatgggggatcctaacggggaacctcagttgaacaggaggtatttccctcaataactcagaaaacctcccaagccccaagagtttgagtggatttnagcgaaggccctaccccgttcccttgagccaaatgtttcaacaccaagtgaagtatattccnggggatccccccacaagttggagatggttcagcgccaaggcgattcctgtccctccgggaaagtgtagaatacccactaagctatctctatattccttccaagtaaccaagctgttgacgtttcttgactacttgcagtagcctgtccccaacttttccatccagtgcgtaagcctaaagaactccttaactctgccgtgacctgaggaagaccatgctacnctggtgttattttgtatgtaccctgtgcttgagtctatagcagtaaaccccatacgcaggtgggagggaggaacaccggtgcctcggtcactctggggncagtttagatgctgtgaaattgaacctgtactaagtgtacttgtatgaactgattgtattgtaatagaanttgttgaatgtagtaattaggaatttatgaatatagtgctgtaatgnctggc

SEQ ID NO: 504230 - DNA, 971 bp, Homo sapiens
gatgtcgatcagcccagtctcctcgcgaagcagacatttatgacgatcgcaaggtaccaacgatgtggcacacctggtaaactctgaataaagaactgccactagtcttgcaagttggggatgtccctatagtttgcttcgagagtagtgcattccggcagacagctggacgcctcacgggcacccgcacaggcgagctggcccgcgaacagccccagtcagagaactgcagcatgcgcgatcgtcgtcggtgacagagatccgagagatagatatgcaactatagtaggcttcccagacgtagaacagttgaatttattgtcgaaaagtttcttgtgtgtcttagagaatggcgcggtatactttatgacatatgtgggtggcgttgcataggagctaacaatatgattctgtggagtttggaatagtccttcaaccacattggagtaaactttttcacgtagtgcacacgatggcgcccagctcagatggcctaccggagtagcgcgacaacacaacacaagacacacaaagcataacgcaaagcagcggcgaacactcaccatattcaacgactggcagacattttccctctagatagctctatcggacggaattctcacaagggtaatgctgccacatggcgcagggctacaagcccagccattgtcctgcttcgatcctagcgctcgcgaacagttcgggttgcagtatagttccgcacgaaaagacctacttttaacccccctctttgcggggagttaccattacctagcaagctaggtaagcgcacaacagttggggagactccttggctttcgggacaccttttgttgtcccatggcacctctatcctacttcccggaacgccgggtgcccacatcccgatcataaggccaatccctattggtgtcaggtgattgccccactattccccatcgcaatccccgtggagtgacacgcaagacggc

SEQ ID NO: 504231 - DNA, 512 bp, Homo sapiens
  misc_feature (377)..(377): n is a, c, g, or t
  misc_feature (472)..(472): n is a, c, g, or t
ttttgtgtatgtgtgcatgtgtgttaagttctgtgcaatcttaccacttacataggtttgtgtttccaccacagtcaagatactgaacattcccatcatcacaaggctccctcttgttgctctttaatagctacacccacttccctcctgcccgcaccccctccattatcctggcaaccacaaaacagttctccatttctgtgactttttcatttcaacattgttatataaatagaattatacaacatgtcacctttgggaattgtcttttttcactcagcataattccctggagattcatccaggtcgtgtgtatcagtagttcactccttttcattgccaagtagtaagtccacagtatggatgtaccacagtgnggtttaaccattcacctggttaaaggacatctgggatgggtttccagtttaaggctattaataaagctggcaataaacgtgtgtgcaaggttttnggtgtgaacacagtcttcatttctctgagataattggccc

SEQ ID NO: 504232 - DNA, 147 bp, Homo sapiens
taaggcttggaatgggtgctcattctattattgcactagaaacagcatagaaagcaagagaagtgggaatttattctaaaatagaatggaggtgtcatctacagcagcactcctcactcctctgttgccatttttagcaagtactcc

SEQ ID NO: 504233 - DNA, 572 bp, Homo sapiens
taatcctagcgctctgggaggccagggcgggaggatcccttgagcccaggagtttgagatccagcctgggcaatatagtgagacctcatctttacaaataactgagctaagctgggcacagtggcactcagctgtggtcccagctactcgggaggctgaggtgggaagatcacttgagcccaggagacagaggctgcagtgagccaagattacaccaccgtactccagcctggatgactagagtggcactcagctgtggtcccagctactcgggaggctgaggtgggaagatcacttgagcccaggagactagaggctgcagtgagccaagattacaccaccgtactccagcctggatgactagagtgagattctgcctcaatacaaagttttaaaaaagtaaatacacgacgggcactcctggcttacacggtgaaaatccgtttttactaaaaatacacagaattgtctgggacgtgcttgcgggcacttatagtcctagctactcgtgacgggtgaggccgggagaatagcatgtaacccggtatacccagctgctaagatgcttaaga

SEQ ID NO: 504234 - DNA, 326 bp, Homo sapiens
ctgagtttgggggccgggccaaccggcagcccccaaggttgccccgctacccaaggaggcccgccctttttccctcaaccccgggccaggccgccctggccgcccgcctgtcactgcaaccgcccctgccctgggccggggtggggtcccctgcctccccagccaaccgctgacctttcgggtttcccttgggcaaagggggccctttgggggggctgcttgttttttttggttttggggggggggagggatgggggtcctggaccccccccccccctagtttttttttcccgcccaggggaataaagttttggttcccttttcca

SEQ ID NO: 504235 - DNA, 872 bp, Homo sapiens
ggagagagagagagaactagtctcgagttatgatgtttttgaatttttaatctggggaaaccggctccattctggggtctgagttaaggagctgggggctgtagtgggggagctaggagtcccatgggaaggggcctgcagcgacgggctgtggatgcgcacaggctgggcccatggtggcccgtgcagcagtggcgccaaataagccaaatgtcagcggccgagagcccgggcactacaaccaggtcagggtcaaaagcaggggtcgaaggtgctcaaatgcggcgcggtagaaggctggggggatgccacaaggtggcggaagcgcagggtgaggctcgggcagtgagcccgaaggcgctgcagacacatgcccagaaagacgtcgcacgagggggaagagctcgacctgggcacaggcgccagccagggggtcgcaggcgttgggccccggaaagcaacaaagccacggacgcccgcgttaggccggatacggggggaggccgaacagggcctcggggatgaacggactggcaaagcccgagtagcggatgacgccgcgcatgcacaatcaggtcaccagcaacgcgggtcttgcacgccggggcccggcggcgccgaggacactccaggggaggattccccacggttaaacaaaaacaccctacgggagattcgccctttcaaaaaacgacggcgacacgtccggggcaaaaaacgtgaggcccgggtagaacaggggaccaacgggagggcacagggcaaacaacggtggcgccgacgcgccaaagcagaagcccgataagcaaggctccggccgaaaaggggcgcaggggataggcgcccccaataccgccggccagctggccgga

SEQ ID NO: 504236 - DNA, 221 bp, Homo sapiens
aactctcaaggattcatcgacggctgagaaataagggattagtacaaacgagagaaatttaaagcttggtgtcccacggggagacacgccatgtttgcaggttccgtgatgccccgagctgcaaaacagccagttttattattggatttcaaaaggggaggggagtacgaatagggtgtgggtcaccagagatcacatgcttcccggtcgaacggggtacc

SEQ ID NO: 504237 - DNA, 433 bp, Homo sapiens
cccgttttggggggttttaaaaaacttgggcaaaaaacctggttcccttaaacatagaggatttatgggcctttccagggtttttttttcccttttaaaaaagcccgccccatccaaaggattccaggggtccccccttggttggggaaaaatcacgcccccaactttttttttttttaagggggggggaaatttttttttccttaaagcccccctattaaggtcaaagtttttaggggggttgccgccccaaaaaaaaaatgttttaagggggggaaacctggttttagggcaagggccccctccaccggggtttcccttcgggggggttttttttggataataaaaaccctttttttacctggtgccggttgaaggaaaaaattttccaaaagggtggccccccaaaatcctttaaatgtttgccggggta

SEQ ID NO: 504238 - DNA, 356 bp, Homo sapiens
cgactctcgccgccgcgcgatagaggcgcgccaggttcttctgtcctgagagccggaggtttctacggccccgaggccatcgaggcgcgatacgatgtccggatcgacgctcgtagccgtgagggtggcgttctctggatgccaactactacggttcgctgactcaggcggtcaccgtgagcctgggtctggacgccgatgccatgaggtgttcgtacccttcagcgcggtgctgcccatggttggctgcgccaatcgacctcgtgttcgatggctgggacatctcgtcgctgaacctggaccgagggtgatgcggcgctgcgaaggtgcttggactgggggctgcaggagcaact

SEQ ID NO: 504239 - DNA, 195 bp, Homo sapiens
tctcacacgtgactcagttttgtaaatccttaatcatgtgatgtagctcactaagtcctcatgccttgtctatagggtctcatataccgtggggttctttaacaagtccttaacccctactttactagacaccatattatagattccattacattcccgatcatatctccgtagagagtatcttccggggggtac

SEQ ID NO: 504240 - DNA, 758 bp, Homo sapiens
tgtattcagtactgcacccatcactcaactccattgaattacatccaacacctgaaggatgaatgccgaacttatggtacaccctgtgtatctagcctcacaccgttaacaaagagtatgtggcaagagacatataccacccgatagtgcttcacaaaatgcacttctattggagccagcgtttattgtagtaaattattcttaataagactcagtcactgtttataagtgttgtggtatgcattctttatagtgaatgtgttaatacatcacaatcttatttattttatgcaaaatcgagtatatttactgtatttaagttataagaaaattaacttagtttgtaaagatttatttgcaaaatatactttactttttccatttggcactatggtttgttgtctacctagtctgcatctatatatgtcagcttatcctaaggctgtcgcacgtacttaatttatttaagtgttcattttaagtaagcgtgcgtcacgtgtgtataggaatttgtatttggaggtgcttgatctatctacaaagaaaaattacttaggaattactttattataaaatgctcctagaagtcgttacttgtgtttattctgttgaaaaaaagcaaatgttagacttgtgtgcagtggacagtattaaggtacatcattattgtaggtttgaaagttgtacatgatacgacatttggttctactgtatgttggtatggatgatctattccccatccaggggaagcgtgatta

SEQ ID NO: 504241 - DNA, 404 bp, Homo sapiens
gccaccctgtgtcttctggtgagtctggcggaactctcaagggtttcgacctagggaggtcagagccaggctgggcatagcagcgacggctcaggtttcgggtgttcagcttgtcacaaggccctttgtccagaaaggccctggtgcttcagagacaataggaggcattctgcatgctgctattgctactgtcattattattagtattagtagtagtagtagtattctctgtgtcctttggtgcaagaagaagacaacatcagctgcggagtccaggtgagaaaacggggcagtggctggagatggaaggactcctctctgggcagaagggtcccctcatagctcctgcacaggatagacatgttggtaacaaggtcctggaacagggggatggacattggggg

SEQ ID NO: 504242 - DNA, 125 bp, Homo sapiens
cagcacagatgacgtgaatgatgcaataagacgccttagatacactagaaaacagtgctcagcgcgacatttaccttctataatatattattaacaccacttatcgactcataccagtaccctta

SEQ ID NO: 504243 - DNA, 167 bp, Homo sapiens
  misc_feature (100)..(100): n is a, c, g, or t
ggtttaaagcaagcgtttgcaggtaattggaaaaagtggttattggttgtgagtgtgtgtgttctttatcgaatgattaagtggcgttacaagggatgtnggtttgaccttccccgttccttgttactaatggccggttgaacaaaatttaatggaatttgtttttg

SEQ ID NO: 504244 - DNA, 267 bp, Homo sapiens
ggatctgagtctgtccatgtctgagggggtaggatgtggtactggtgtgaagatctggctctctccatgtctcacgaagtaggatctggtacaggtattgggatctgggtctgtccatgtctaaggagttatgaatctggtacagatataaggatctgggtgtgttcgtgtctgaggaggtaggatttggtgcatgtattaggatctgggtctgtccatgtctgaggagatcggatctggcatggatatcaggatctaggtctttta

SEQ ID NO: 504245 - DNA, 282 bp, Homo sapiens
ccccctgagatggagtttctccatcacccagtctggagtgcaatgtgccatcccggcttactgcaacctccccctcaggttcaagtgattctcccgcctcagcctcccaagtagctgggattacaggcacctgccaccacgcccagctgatttttgtattttcatagagacagggtttcaccgtgttggccgggctggtcttgaacttctgacctcaggtgatctgcccacctcggcctcccagaatgctgggattacaggcatggccatgcccggccaagt

SEQ ID NO: 504246 - DNA, 178 bp, Homo sapiens
aacgaagtacagtggcctcagtgatggctacggttcaccaccgacctgtacgggagagacctacagcgactgtctctccggaatgtatgaccacagatacggcgacagtaagttcacagtgcagagcaccacaggccacctgtgtccacattaaggggcctgccgtacaaatgcgacc

SEQ ID NO: 504247 - DNA, 356 bp, Homo sapiens
  misc_feature (34)..(34): n is a, c, g, or t
  misc_feature (141)..(141): n is a, c, g, or t
ccatgaactaccctgggactttcatctttcacanacaaatgacttgttttgatcctactcaaaaaatgatttataatcagctataggattttgacaagtgttctcagtgcaagattccattaactctggagattatgacanttgaaaaaaatacagtactcatgaagaactgaaatgttcatgaatatcaagcagaacaagagaacagaatggattgaactaatagaaaacaagtattatttttaacctttttgcttaaaactttggtgatccttgctttgtttttctgagtcaaggatacttattttgaactatttaaagcctttaataattgagtaaactatatgcctgtgaac

SEQ ID NO: 504248 - DNA, 258 bp, Homo sapiens
tttttccccccccgggggggggggttttggggaacccccattttttttccaaaggggggcacgggggggggggggggaaaccccccccccccccttgggttcccttttttgggggaattgggggggggggggggggaggggttttttttttttttccccccccccttttttttttttttttccctttttttcccccggggttgttttgggggggggggggggggccccggaaaaaaaccccccctttttcccccccca

SEQ ID NO: 504249 - DNA, 955 bp, Homo sapiens
ccaccctctcccaacaaaaataactatgctgttgacagtgctattcaccttacaatagaaatgatcaggtctgctatctcttcatccccaggatgcccactacatattttggaatcatcactctgattgtaagctgaatgttaccatcactagctgctttgtctatgaacccaatattgtagcctggtgtctttacatcagtacttgtgcactgcacgacagctagtattctgtgtctatggactacaacagaagacacaccttgtactgatagtgccgattctatcttttttaaaacataaaaaaatagctcaagttgcttgccagactgggcggcagccaatttggaggggctgacgaagcaagatgatagctgttccgcataaacaggtacactcatcgtaatctgacctgtgcgtcatcaggtatgatatccctaagcatggtcctgtccatcacgtgttttagccacagcttaagtatacatctcagttcctggtgtgccccagacagggcctcgtaacccctgggcaagaccacagacgccctggttcgtacactttgttcgttccactcctgcctgtgggctgtcactgcacttggatcattatgctataaatgaatcacagaatccttgtcacacgttcggagaatcctttagtttccgttcaatgactgggcaagcctccttataactggagcgagaacattgttcctcacaactgtggtcttgtgcgacacaaacgcggggtttccctgcaacgcgacaatgcccacaataccgtaccattgaggacatggcagattatgccaataacacacgtgtgtgttgaacatcaaaacaccagcacaacgatggggtgagtgaatctgccataataaacaggcgcgcccaaaaacggtgtgtctgatgggaacctgtgagcctctcctcccctcctctctcgccttcaca

SEQ ID NO: 504250 - DNA, 291 bp, Homo sapiens
cccatctcgtttgtagcagctactcagagaggctgattgtatgagaattgcttgaacccaggagacagaggctgcattgagccaagatcacaccactgcactccagcctggtgcagcagagcaagactccatctcaaaaaaaaaaaaaaaaaaaaaaaaaaaaggtttattctttcagttaatggaggtggaatgaataaagcttgttggatgtaaaggtggttacgggagggagtgcctttgaaacactttgtattccagaactctccttgaagtttccagtaccattat

SEQ ID NO: 504251 - DNA, 145 bp, Homo sapiens
  misc_feature (94)..(94): n is a, c, g, or t
  misc_feature (142)..(142): n is a, c, g, or t
ttaagaggcctgtttggctcatcaggaacctctggttcactattctgaatattttgtcctttgccttcaaaaaaaaaaaaaaaaaaaaaagagngatctactacatcagttttaagagttctgtggagtgctcataccagtnctt

SEQ ID NO: 504252 - DNA, 124 bp, Homo sapiens
gggttggttttggtttttgtttttgttttttgagatggagtcttgctctctgtcccctaggctgcagtgcagtggcgcgattgcagtgaaccaagatcatgtcactgattgcattccagcctgg

SEQ ID NO: 504253 - DNA, 139 bp, Homo sapiens
cggtgaccgtttactgccctctgaaaatggggatggttcatagtactaatctcataggggtgttgtgaggaaggaataaatcatggaaagcacctaaaagagtgctgggcccgtagccttcccacgggataaggtggag

SEQ ID NO: 504254 - DNA, 203 bp, Homo sapiens
ctagaggatcccctgcgagcctcatatgaaagtctcaaggtggcagaaataggtcagacttatccattgtcctgttttccattagaagcactgacagtcaagtagcctaaggtgtagaacaaatactgacatgtaaggggagtttcactctcatgtctttgtgaagtgaagaccttaagagagattttttttctagtattata

SEQ ID NO: 504255 - DNA, 241 bp, Homo sapiens
gaggatcccagagacgcgaagactagaaagggaaggtgaggggatgtggggagagagtgggcgaggtgcctttactacatgtgtgatctgaaaacccggctggttctgagctgcgtctcatgacatggtaaagtaataccaatggctttttatcatttccttcttccctataagtttcacttgaaattttaaaaatcatggttatttttatcgtagggatctttctgtcttcgggtcgtta

SEQ ID NO: 504256 - DNA, 467 bp, Homo sapiens
gccttttaccactccagcctgtcccctaccccccaattggagggcactggcccccaacgggcatcaccccgctaaatcccctagaagtcccactcctaaacacatccgtattactcgcatcaggagtatcaatcacctgagctcaccatagtctaatagaacacaaccgaaaccaaataattcaagcactgcttattacaattttactgggtctctattttaccctcctacaagcctcagagtacttcgagtcccccttcaccatttccgacggcatctacggctcaacattctctgctaccacaggcttccacggactccacgtcactattggctcaactctcctcactctctgcttcatccgccacactactatttcactctccaccccaacaccactttggctccgcagccgccccctgataccgccacttcgtagctgtggtttcactacttctgtacgtctc

SEQ ID NO: 504257 - DNA, 112 bp, Homo sapiens
gctgtatcccagctactcgtggaggctagagactgatattgcttgaacccaggtggaagaggttgctttgagccaagatagcgccactgcattttctctgagacgctgtgtc

SEQ ID NO: 504258 - DNA, 403 bp, Homo sapiens
cgcccaacgtctgtttcccaggcaggccaagggccccaattggggccatcccggttgggtcccaagaagcatctgaagcgggtggcagctccaaagcattggatgctggataaattgaccggtgtgtttgctcctcgtccatccaccggtccccacaagttgagagagtgtctccccctcatcattttcctgaggaacagacttaagtatggccctgggacccaagcgaaggaattggaaacgttaaaacgaaagcatttgcattgcagcggttcattaaaatcgatggcaaggtccgaactgactataagcctaccctggctgcgcattttccattggggccaattgggttccaatttccaggccattttggaccaaggaacgggcagcagaatttcccgtg

SEQ ID NO: 504259 - DNA, 256 bp, Homo sapiens
ggaaattttgattttttagccaaagggttttcccaagtgttatttgaagcccattcagatgccttaaaaggggggcccgggcacgggctttcaaaaaaatgttttcgggacactgggttttttttttgaaaggacattttttcattggttttgccgtgaaaatcctggggagattttgcaaagaaaacgcacccttacatttggtcattaaagacagatttccttcccaagtcgccatgaataaaatgagagggta

SEQ ID NO: 504260 - DNA, 160 bp, Homo sapiens
cgacctctagacggactccctgacgacgaccgtgttgaatgggacggccgggcgagatttaccaccctcttccccggattttcacagggccagcgcgtggtccaccggactgcgctgaaccgggaccgtttccagggcaggggcccttctctgggggggt

SEQ ID NO: 504261 - DNA, 290 bp, Homo sapiens
  misc_feature (34)..(34): n is a, c, g, or t
  misc_feature (93)..(93): n is a, c, g, or t
  misc_feature (177)..(177): n is a, c, g, or t
  misc_feature (243)..(243): n is a, c, g, or t
  misc_feature (259)..(259): n is a, c, g, or t
tactcctgattctactgggacagagaaaacctgnaaggactttacgataaaaacgtgtcaattccttagcattggcccgaaagaggtaagggnaccgtattttgcacttctaatgagagaaaaaagacaccgtttggccgcctataaggttggaatatggttaactgcttgcagagnaaatatcttgggttggactttccaattcaaaatctctttatttccccctttcttgggccctctggnaccaggtcacctttcnaattttttttgggggtccgggcctttctggg

SEQ ID NO: 504262 - DNA, 870 bp, Homo sapiens
  misc_feature (795)..(795): n is a, c, g, or t
gcttcccaaagtgctgggattacaggtgtgagtcactgcacccagccgagttgctttcttactaaatcctattaaaatatgcaaaaataagtcagattttaaggcaaataaagtgacataaggtgctttatattttattttggtatatttaaacagtgaaaaactaactgaaagcacatgaagagttgtaacttgggggaaaataggtaaacatagcttctagctaacacaggagacctattcttagcctttactaatttcaagcagtgtatcccatatggtatctcttgctcttccttcaactccaataaatttaatgactaaatgccaagttaacaaatcaacttccatttggattgtaggtgtgaaggcacaactctaattgctattagtctacatgtatttctgtaatagtattgtgtcatatcaatttttaagatgtctaaattttatggtcacaagttatccctcctcagtatgaaaaataaattagatattgaaaaatgtctaaacttcagtgatggaaagaatatttcaagaagttttttaacctaaatacttttattttgaatttaagtctttgcacataaaatatagcaagcttacatattaaactatttacgtaaatggaatgtaagccatgactttaactgaagtgttcacattcactaatttgatagattgctgtccttaataattttggaggaaattaagccaaatgattattgtactacagtattttcagaatatgggaaatcaattaaaaatgtaatctaatctagtttaagattttgnttaatcatcatggggtcctacctggataatttaactattaagacaaaggattttttttaaaggacccacctgaaa

SEQ ID NO: 504263 - DNA, 355 bp, Homo sapiens
gcatgatttgcctaggtggagcacgtggtggtgacggagccggagccctagctgcgccaaccgaccgtgtggctgagctaccagtgctgggaactgatattgcatcgcttccgtgattacctgctctgggtgcacacactgtctgagcagactcaagtagagcgtgctcagttctcaggacactcaggaactgagcctgctgaaggacgagacctttaaggggccagagaacctacaacatgtaatctgcaggaactactgacccggccggtctataagtcgtcgacgacactatccggagctttgtgcatctcatctctcctgccatcccgatcttggtgatgattcttgtgct

SEQ ID NO: 504264 - DNA, 633 bp, Homo sapiens
tatcgatgccactcaacatactttacattcagccaaatactgaaggtttcaccatggaaaaacacttttatcacttttaaagtaacttgactatgttcaccctgagtgctcttgcctcagtatggcaactgattatgagttcaggttaagagcaacaccagggaatacagaaacccacgttaagttggccattctgacatgaatctatacttgaaaatgaaaacaatcccaaagaaaacctgtatgtcaaaaacagaactgttcctgcctttcaccccaaaatatttaaaactaaatctaagccacttttaaaatgcatgctggccgggcgcagtggttcacgcccgtaatcccagcactttgggaggccaaggcaggcggatcacttgaggccaggagttcgagaccagcctggccaacatggtgaaaccccgtctctactaaaaatacaaaaattagccagatgtggtagtagatggctgtagtccgagctgcttaggatgttgaggtgggaggaaggcttgaggctaagaggttgaggttgcagtgagctgtgattgtgccactgctctctagcctgggcacagagcaagacctgtctcaaaaaaaaactgtattaagaaggactattaa

SEQ ID NO: 504265 - DNA, 167 bp, Homo sapiens
atgtttatagatttaccatattgtcttccatctacaggcttggtccctggattatggttgtatcctaccctttaaaatgccagcagatattttctttaaagataggttttaagtattggctagaggatttttctatatttacttacgttgagacagcttaagacttc

SEQ ID NO: 504266 - DNA, 252 bp, Homo sapiens
agtgtgattcagtttactcaatgcggtatatgaggagaggtaagggtcaaggtttatatattgatgggagacagagtcaggctcggtctccgggccagagtacagaggcgcgatcgtggctcacggcaaactccaccggccagattacaggtgcacaccaccacacccggctaattttggtatttttagtagagatggggttgccccatgttggccaggctggtctggaactccagacctcaggtgatccgc

SEQ ID NO: 504267 - DNA, 220 bp, Homo sapiens
tagaacaggacttatccaatctccgggtctagagcctgaagggacattagaatgtagaagcttcattccatgatgacaagttaatccaggtagggcatggcggatgcacaagggtcgaaaatgagacaaactcggacaggcgtggtggctcatgcctttaagtctcagccactttggtaggctgaggtgggtggatcgactggagttagagaccacgcct

SEQ ID NO: 504268 - DNA, 1292 bp, Homo sapiens
  misc_feature (269)..(269): n is a, c, g, or t
gcctgcagggctgtacaccttccccgttatgcgtgactcgggaccttaccgactgtctaccgcgtacccgaacggccgtattgtgacgacacgccccgtgtgagcagctactattgagtcgctagagtggctagacaggcagatagtgcaccttggaagactcggccgagacgaatcttgagagctcaatccaatcggacaaagccatgctagtccgcatcttagacgatatccagacgaaagcggcgtgtagcacagcctccaaaacncggagaaccatgggctttttcaaaactcccgcatgttcatagcgcgccaccaattgaaccacagtcaactggtcgacgctttggcgatcagatgcctagcttactggactcatagaaattccgcacggatccagagattcagcacagttggtggggacctaaatactcagataggttcagtttgagggagtcagcccgtcggagagtacttgccattgacactcggagacccattggttggcgcacactagttgtgactatccccttgttgcgaacgaaggacgggcaagctttttcagacccggagtaccgtcctggggaaacatggcattggagctcgacgtaatccaagcaagtacaacccggcgtgccccaacgtagtggaacctacctattactcgattccccccctagtttcccccacagactgcctgaacccgaacaaagctgtgcccatagcatttccccaagttctcgcaatagggccacgttgttacaaccacacaaagccgtaccttgagtatttgtgtcaacggctgtttgccctgaacgtgggcctagggaatggcttggtttgcggaacccagggtacacggggcagtgacagccggttgaaaccgtcgtgacactgtgatttgattgtaccttgaagcccggcccacagggcgtggtgcgtgcgacatcagagaaccattgttccacctacaagccctttaggtctagagccgaggcctatcttgcctcgaagcaattcctgcatgggcccgttggcacaactcaggtggactcacggggacaggttcccagagcgtttccccccatgtaaattaggtacctatgatagctccattgctaccgtgcttgccttgcggcggtgtaccactatgacgttggctgagttccaagaaattccacggaggtccctaggtcgttccgggccttgactgatcccaacaaaggtttttcccatcaaaagttcctgcgctattcccccctttgctgcaggtagtatgcctcccgtca

SEQ ID NO: 504269 - DNA, 511 bp, Homo sapiens
acggcaggattcggttaggaggaacagcacagcatgctgggctctggatttaacacgctgagcgcttaagagtgaatttgagattagtcactacaatcgccttaaactactggagcaaaaaggataaacggcacactggcccagcagaagcaaggcaaggagattgcgtgactatctggctgctggcgaacacgatgaacgagctcggatccgctgctggagcacatctatccgggcacagacgtaccgtcgtgcgaggccacctggacgactcctgcgacgctgctagctgatgatcctgcatgcgtggcctcgccgtatccggcctctagtccagatcataatgacaggaactatgattctggctctggctgaatctgtgtctacattgatctgggcatgctcctcgactccagtcagaagctggctgagttgaaaatagttgctgatcagctctgtgccaagtatagcagaggaactatggcaacgctagtgtagcgaccaatcacga

SEQ ID NO: 504270 - DNA, 412 bp, Homo sapiens
  misc_feature (112)..(112): n is a, c, g, or t
acagagggccaggctggagtgcatggcatgatcacggctcactgaagcctcgaactcctgggagacacccatactcgacacctcacagccagcaccatcagcagatcctgcncaactgctctacaaaactcggccggcgggatgcggtggctcacacctgtaatcccagcacgggaggccgaggcgggcggatcacctgaggtcaggagcgagaccagcctgaccaacatggagaaaccccatctctactaaatatacaaaattagcctggtgtggtggcacatgcctgtaatcccagctactcaggaggctgaggcaggagaatcgcttgaacccgggaggtggaggttgtggtgagccgagatcgtgccattgcactccagcctgggcaaaaagagcgaaactccgtctc

SEQ ID NO: 504271 - DNA, 388 bp, Homo sapiens
gcagcattctggatacctggcgaagcctcatctctactataaaaggaatatcccgattagccgggcgtggtggtgggtacttgtggttccatatgctcgggaggccggggcgggagagtggcttgggccctggaggcggaggttgcattgagattgcactattgccttccagcctgggcaacggagtgagactccgtctcaaaaaaacaaaacaatttgatttttaggtaacgttttaaatgtacctttattgtaagactatgggatctgggggagagtatgtcttttaatgccattcttcttacttgagtctccggtgacacatgtttacttgtgggaatatttcacttatcagtacttttaaagaccttttgctatacgcttgctc

SEQ ID NO: 504272 - DNA, 374 bp, Homo sapiens
  misc_feature (48)..(48): n is a, c, g, or t
  misc_feature (90)..(90): n is a, c, g, or t
acagtatgcctgaaggatgtgctgtctgggaaaagtgtctgctgacancaacggtgggccgctttcttgatgagccttgtcaaccaagtncccaagataggttcctgatgactttgagaccatgctcaacagcaacatcaatgacctgctgatggtgacctacctggccaatctcacccagtcacagattgccctcaacgagaaacttgtaaacctgtgaatgagccccaagaggcacttgtgctggtcgaggttttcaccacagggctgagaccgaagtggaggcaaagggtttctttgtggtcttgagtcacggtgactcagtcagctgcttgtgactccaaataaacatagcttaccttttgtaaatgaaa

SEQ ID NO: 504273 - DNA, 397 bp, Homo sapiens
gcatctctctgtccttggccagatggtctcgacacgtgcgggcacctctaacccagtgctatgccatacctttctcttgtgtacattcggaaacagaagccatctctgacccgcccagctcttccctggcgctgcaaagcactggctttactgacaaacgtctccaccaaagaactcatctgactgctttcatggacagtggcattctatcacatctttcaaaggaaatgtggaaagttccttaaatgggctacttatccacccattgccgttgaaacccccatttggttcaccttccatttggatccccaaagccaaggattctggtggtgctgctgttgctgctgtttcagtttattcagaagtttggcaataaaaagatcacgtggttaaaaaa

SEQ ID NO: 504274 - DNA, 852 bp, Homo sapiens
tcgacccacgtcgtcgtttctgagcggcatgaaggcacctcccaggcggacgagcgtgccccggacgcgcgtatcatggtgcgaggtgacctggtcccgactgagccttggaggcagctcgcgataatgcggcatgctagatgcgactcctgcagagcgcgagcatgtggccagcgcgagagccagtgacgtcacacctgagcatggcccggagagcttgctgtgtggtcctgagtagcagatggccttgatgatccaggtgtcttcactccaggcagctctaacgggcctgagtagccctgggaggccattcacgaaatgtgcatcccgggtggccttcaggggaccaaggctgcccgggagtgcacagcccccatgcccaccatagcaggtcttggactgtgatcatggctagatgaatgataaacagtggccaacctgtgaagaaatgcccctgggcaggtgggcttttctcagcatgtgtagctcaaccaatcgacgtgcccacggaaaccgtgtcagcaccttcctgacaactcgcaagacgccacacaaggcccaacgacaggccccgtgagaaatgcccttttgcttccttggagctgccccctgtggcaggaacagtcgactgaacgccggcgcccttgtaaattaccctagtcctacatgccccacttgccttccacccatatactatcccgaaaccccagagtgaacttccttgaccacctgtcccctgtaacaaaaccatttctaagatcactcagcatgcatccctcccacttgcacataacgaccttatgctatatgcacacatatgcaacaagatcttcaagtaacatgttcactgct

SEQ ID NO: 504275 - DNA, 275 bp, Homo sapiens
ttacatgccagtcctggacccattgctcttgaatatcaggaacttgtatgcatgagtccttgtcagagccttttcataaatctccttgaacaaaaagcaattggggactgtagctgatggtaaatactttgaggaagaacgacagcaactgtctgacagtcttcctgaaatacagaaatgacatcacggcgtgctataatggattaaggccaggaagatgtcctgtacctgaaggagcagagacttggactgtcagcgatgtgcagctttcctcg

SEQ ID NO: 504276 - DNA, 690 bp, Homo sapiens
agcagtgtctcacacctctaatcccagcactttgggaggccgaggtggacagataacctgaggtcaggagttcaagaccagcatggccaacatggtgaaaccccgtctctactaaaaatataaaaattagctacgcatgggccgggtgcggtggctcatgcctgtaatcccagcactttgggaggctgaggcgggcagatcatgaggtcaggagatcgagaccatcctggttaacatggtgaaaccccatctctactaaaaatataaaaaattagccaggcatggtggtgggcgcctgtagtcccagctactcgggaggctgaggtaggagaatggcatgaacccgggaggtagagcttgcagtgagctgagatagcaccactgcactccagcctgggtgacagagcgaaactccgtctcaaaaaaaaaaaaattaacttggcgtggtggtgggcgcctgtaatcccagctactcaggaggctgaggcaggagaatcactagaagctgcgaggcagaggttgcagtgagctgagattgtgccagtgccctcctgggcaacaagagtgaaactctgtcttacacatactataaatttaagcgtcttttatatgttcgttgaatgaataaattggttcagtcccccaatatatttaaagggctcaaggaagtgtttattattagtttcctcc

SEQ ID NO: 504277 - DNA, 128 bp, Homo sapiens
acgtttcgaaggatatcggccaaatctagccgagtcgtgtccatgtcgacagtaccgagcctatgttttaacgcattccggcgaactctacgagcgtcccgagcgttcagacaggcagatttgtgttt

SEQ ID NO: 504278 - DNA, 580 bp, Homo sapiens
caggctggtctcgaactcctgggctcaagtgatcctcctgctttggtctcccaagagtgctgaggagttataggcgtgacgacagccagatcacttcgtttgatgactacatatgacaagacacatagagatagcattacatagaaaaatatactctttaagaaatcatggttctcaagtgatacgactctagagcacattaggacacaataagacataattaatagacatggataaaaatttattaaagcaacaacgtaaggtacttagatgactgacatgaagtataataaaccatgtcgaaatacagtacaattcattggctacaaacaccaaacttgaacaaacaaaatgagcaatctttccttaccaagcagatggaccaaatcaatcagagttataatacccaaaatactcattacacttggtgccagcaaattgttgaggagatctataccatctacccacatacgaacaaatgcacctataactgtctaactaaaacgacacaaatagctgagctaagtatgactaaaatctataaggactgaaagaactacgatattcaagctcacctaga

SEQ ID NO: 504279 - DNA, 165 bp, Homo sapiens
gaatgccttctaagccactcttggagcatcttccgatgacagtgggggatctgaagggggctcccttgggtgctaatggtctttcagaaggctctgtagtgctctgtgggttggccctgggggggcctgatctcatttgagctgattttccattaacgctgaaga

SEQ ID NO: 504280 - DNA, 154 bp, Homo sapiens
gataaggtgctcaaaaactattctgtcttcaaatattgactcggctcaacttttctgtctgatagtcagtgactacctatcaggccctgccagcaggtcctccatgtgtcatcttgtcatcccatgttgtgtgtaggcatgtcggagagggagg

SEQ ID NO: 504281 - DNA, 1323 bp, Homo sapiens
aaaaccgagaagcaacaattgcatgatgaggccgtgtgtttactggcacgaggcaaagaatgattttgctggcccacgagaaactctctgttcctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaacatccagtgcctgcaggacgtggagcgctgcctccgggacacgggtgtgcagggcgtcatgagcgcagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacacgctgcaggtgcaccaggagctgcgagaggagctggccaaggtgaagaccctggagggcatcgctgctgtgagccaggagctgaagctgcggtgtcaggaggagatatccaggcaggagggagcgaagcccaccggcgacttgcccttccactggatctgccagccctacatccggccggggcccagggaggggagcaaggagaaggcaggtgcgcgcagcaagcgggccctggaggaagaggagggtggcacggaggtcctgtccaagaacaagcaaaagaagcagctgaggaacccccacaagaccttcgacccctctctgaagccaaaatatgcaaagtgtgaccagtgtggaaacccaaagggcaacagatgtgtgttcagcctgtgccgcggctgctgcaagaagcgagcctccaaagagactgcagactgcccaggtcacggattgctttttaaaaccaaattggagaagtctctggcctggaaagaggcccagcctgagctgcaggagcctcagccagcagcacctggaacaccaggtggcttctccgaagtcatgggcagtgccctggcctgaaggcccacaacccccacccccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaagtgaacaataaatcatttcaaagatg

SEQ ID NO: 504282 - DNA, 299 bp, Homo sapiens
  misc_feature (5)..(5): n is a, c, g, or t
tgtanctatacaagagcacccaggtcataaagcaagttattggagaccttcaaagagacttagactcctacacaataatagtgggagactttaacaccacaatgacaatattagacacatcatggagacagaaaattaacaaagatattcaggacctgaactcagctgtggatcaagtagacatgatagatatctacagaactctccaacaaaaaacaagcgaatatacattcttctcatagccacatgacacttaccctaaaactaatcataaattaggaagaaaaacactcctcagc

SEQ ID NO: 504283 - DNA, 555 bp, Homo sapiens
  misc_feature (135)..(136): n is a, c, g, or t
  misc_feature (172)..(172): n is a, c, g, or t
aaactttgaacttggaacaagccccggccggggtgggccccttaaacaatagcccggtagccccctgccctcttagcccaaagggccagggccctgccttggcctttggtgccctttatccattgtcaaataaanncgctcagcccattaaaaaaaaaagtgccgctgcagnctgcccaggtcacggattgctttttaaaaccaaattggagaagtctctggcctggaaagaggcccagcctgagctgcaggagcctcagccagcagcacctggaacaccaggtggcttctccgaagtcatgggcagtgccctggcctgaaggcccacaacccccacccccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaagtgaacaataaatcatttcaaagatg

SEQ ID NO: 504284 - DNA, 367 bp, Homo sapiens
agcggaggtaggttcgtgagacggggatgggggacgctcgtcacagtcctcttgctgcacccatcagctgtatcttgtctgaagtgattaaggagatgggggagagcctcccagcgctcgtggtcgtgtgcgccattggcgcgcttagagaaggacttgtcgcgctcgtccgagtcctcagtgttctcatctggaagaatagagtgtggcaaggtccattgtactcgctatcacacgtcatgagccctgaatgtggaagaaagtggagttccatgtgcatgacaagccagggactagatttatggcaagaagaacctccagattctgtcttagggttcccagtgcatttgctcgcttgtactcgagg

SEQ ID NO: 504285 - DNA, 555 bp, Homo sapiens
  misc_feature (135)..(136): n is a, c, g, or t
  misc_feature (172)..(172): n is a, c, g, or t
gcgtggcacctgggagcaggacccctgccggtggtgcgcccctaaaacaatagcacgtagggcccctgctcctcttagcacaagaggcccaggccctggcgtggccttcgtgccctttattcattgtcaataaanncgctcagcccattaaaaaaaaaagtgccgctgcagnctgcccaggtcacggattgctttttaaaaccaaattggagaagtctctggcctggaaagaggcccagcctgagctgcaggagcctcagccagcagcacctggaacaccaggtggcttctccgaagtcatgggcagtgccctggcctgaaggcccacaacccccacccccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaagtgaacaataaatcatttcaaagatg

SEQ ID NO: 504286 - DNA, 173 bp, Homo sapiens
aatcacttaacatcctttcgacggtgtctggtatgatgctgcgatcttaccttttgcaggatcagcgcgcagtgctccatactgtgtgtgtccccagcccgtgacccagatgccttgcggctggacgacatgggaggcgtcggcaggcagatgggccgcaccatgggtgctgt

SEQ ID NO: 504287 - DNA, 1864 bp, Homo sapiens
agcggggtggcggcgcggagccttgggcccggctgcggcccggcggcggccccggcgcggtgcgggcgttcgcggcgccccgggagctgcaggggccccgggcggcggcgaggccggagaggggcgggcccgggacaccggcacccggcgccctcggagccaaaggcgcgcggcggacacggcggggccctcgcgcgcctggagacgatgccaaagctgcagggcttcgagttctggagccgcaccctgcgaggggcccgccacgtcgtggcccccatggtggaccagagcgagctggcctggaggctgctgagccggcgccacggggcacagctctgctacacgcccatgctgcatgcccaggtctttgtccgcgacgccaactaccggaaggagaacctgtactgcgaggtgtgccccgaggaccggcccctcatcgtgcagttctgtgccaatgacccggaggtgtttgttcaggcggctctcctggctcaggattactgtgacgccattgacctgaacttgggctgcccacagatgatagccaagagaggtcactatggcgcctttctgcaggacgagtgggacctgctccaaagaatgattttgctggcccacgagaaactctctgttcctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaacatccagtgcctgcaggacgtggagcgctgcctccgggacacgggtgtgcagggcgtcatgagcgcagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacacgctgcaggtgcaccaggagctgcgagaggagctggccaaggtgaagaccctggagggcatcgctgctgtgagccaggagctgaagctgcggtgtcaggaggagatatccaggcaggagggagcgaagcccaccggcgacttgcccttccactggatctgccagccctacatccggccggggcccagggaggggagcaaggagaaggcaggtgcgcgcagcaagcgggccctggaggaagaggagggtggcacggaggtcctgtccaagaacaagcaaaagaagcagctgaggaacccccacaagaccttcgacccctctctgaagccaaaatatgcaaagtgtgaccagtgtggaaacccaaagggcaacagatgtgtgttcagcctgtgccgcggctgctgcaagaagcgagcctccaaagagactgcagactgcccaggtcacggattgctttttaaaaccaaattggagaagtctctggcctggaaagaggcccagcctgagctgcaggagcctcagccagcagcacctggaacaccaggtggcttctccgaagtcatgggcagtgccctggcctgaaggcccacaacccccacccccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaagtgaacaataaatcatttcaaagatg

SEQ ID NO: 504288 - DNA, 1032 bp, Homo sapiens
  misc_feature (830)..(830): n is a, c, g, or t
gctgcacctctgtacctggatcctgtcctgttctccatgctggtgtgtctgaccgtacccgggaggctcctgatgggcgctctgacagtgacactgatggtgctgatgcgtccccactgctctttggctgggcgactccggacaacgtttacttggtagcaggttaccacatgagtgtcatttcttcacgtgtgaacccgaggcggtgtgcggttccgtggtacagaatcttcgtatcgaccacatgtaggagtcgctgcgcttcgacagcgacgtgggggtgagtacccgggcggtgaccggggcgtggggctggcctagcgcccgagttactggaaccggcagaacggacctccctgtgagcagatccccccggcgcggctggagaccgtactgcgggactcacctacgggcgttgtggggatgccttccctgtgaagcggtgatatctatcctgaggtgacgtgtgaatccttgcaaagacccaagacccttgtctatgcaccaggaatctcctggtctagctcttgtgagatgttatgctaatcgcaggccaagcaattgaaggtcaggtggttcccggaacgggcaggacagagaaaacactgggggtggtgttcacgagaggcgtgatcgaggaaatggtagacttgtaactgccagagcctcgtgatgctgaaaacagttctcgggagtgaaaatcgttacccctgtcccatggagcatcgaagtctgaggagtccgtcacccgtgagtgagagcaccgactgaggtctgcctgagaaaatgctagtgactcggactcgtgtgaccagcgcttcctgaggggnggagcccttttaaaaggggaagagattggtgtgcaggaccgacccgagaaactacgctatagaaggccgatatatgcgcgggagagaaactcaaggggaaagctccgaaagttcaagcggggaaaacttaatgtcattacaaaatgagaagtgtgcagctcgggccaactctgaactaaagtgcatagaaagttacataggt

SEQ ID NO: 504289 - DNA, 2147 bp, Homo sapiens
agcggggggagtctcgcgaggggcgcccctgtggcgtttcgggccagccgggccgcctggccgggtgcggagaaggaagctctgcccttcccctggcccggcgcggagccgattctcccgggaaggggccgggggtcctaacttcaccgccgggcggcctgctcagggccaggcccgcggggacgctggcgtcaaggtttcttcccccttcacgccagtcccctaccaggccgacatcgagtcccgctccccagggagggtcaagtcccaggggtccagcggctcccccgaggtccgctaggaggtggcggcactggagtggccgttctccagcctgcaccgacccccgcctttagtgcccccgcgtgtgacccaacggtggtactggagcggccttagaagggtgaccgctgcctctgagttgagtcttaagcccctcgttgggcctggctgaaccccgggtctgcgcctttcccccagcctggagacgatgccaaagctgcagggcttcgagttctggagccgcaccctgcgaggggcccgccacgtcgtggcccccatggtggaccagagcgagctggcctggaggctgctgagccggcgccacggggcacagctctgctacacgcccatgctgcatgcccaggtctttgtccgcgacgccaactaccggaaggagaacctgtactgcgaggtgtgccccgaggaccggcccctcatcgtgcagttctgtgccaatgacccggaggtgtttgttcaggcggctctcctggctcaggattactgtgacgccattgacctgaacttgggctgcccacagatgatagccaagagaggtcactatggcgcctttctgcaggacgagtgggacctgctccaaagaatgattttgctggcccacgagaaactctctgttcctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaacatccagtgcctgcaggacgtggagcgctgcctccgggacacgggtgtgcagggcgtcatgagcgcagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacacgctgcaggtgcaccaggagctgcgagaggagctggccaaggtgaagaccctggagggcatcgctgctgtgagccaggagctgaagctgcggtgtcaggaggagatatccaggcaggagggagcgaagcccaccggcgacttgcccttccactggatctgccagccctacatccggccggggcccagggaggggagcaaggagaaggcaggtgcgcgcagcaagcgggccctggaggaagaggagggtggcacggaggtcctgtccaagaacaagcaaaagaagcagctgaggaacccccacaagaccttcgacccctctctgaagccaaaatatgcaaagtgtgaccagtgtggaaacccaaagggcaacagatgtgtgttcagcctgtgccgcggctgctgcaagaagcgagcctccaaagagactgcagactgcccaggtcacggattgctttttaaaaccaaattggagaagtctctggcctggaaagaggcccagcctgagctgcaggagcctcagccagcagcacctggaacaccaggtggcttctccgaagtcatgggcagtgccctggcctgaaggcccacaacccccacccccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaagtgaacaataaatcatttcaaagatg

SEQ ID NO: 504290 - DNA, 1823 bp, Homo sapiens
agcggggtggcggcgcggagccttgggcccggctgcggcccggcggcggccccggcgcggtgcgggcgttcgcggcgccccgggagctgcaggggccccgggcggcggcgaggccggagaggggcgggcccgggacaccggcacccggcgccctcggagccaaaggcgcgcggcggacacggcggggccctcgcgcgcctggagacgatgccaaagctgcagggcttcgagttctggagccgcaccctgcgaggggcccgccacgtcgtggcccccatggtggaccagagcgagctggcctggaggctgctgagccggcgccacggggcacagctctgctacacgcccatgctgcatgcccaggtctttgtccgcgacgccaactaccggaaggagaacctgtactgcgaggtgtgccccgaggaccggcccctcatcgtgcagttctgtgccaatgacccggaggtgtttgttcaggcggctctcctggctcaggattactgtgacgccattgacctgaacttgggctgcccacagatgatagccaagagagcaaagaatgattttgctggcccacgagaaactctctgttcctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaacatccagtgcctgcaggacgtggagcgctgcctccgggacacgggtgtgcagggcgtcatgagcgcagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacacgctgcaggtgcaccaggagctgcgagaggagctggccaaggtgaagaccctggagggcatcgctgctgtgagccaggagctgaagctgcggtgtcaggaggagatatccaggcaggagggagcgaagcccaccggcgacttgcccttccactggatctgccagccctacatccggccggggcccagggaggggagcaaggagaaggcaggtgcgcgcagcaagcgggccctggaggaagaggagggtggcacggaggtcctgtccaagaacaagcaaaagaagcagctgaggaacccccacaagaccttcgacccctctctgaagccaaaatatgcaaagtgtgaccagtgtggaaacccaaagggcaacagatgtgtgttcagcctgtgccgcggctgctgcaagaagcgagcctccaaagagactgcagactgcccaggtcacggattgctttttaaaaccaaattggagaagtctctggcctggaaagaggcccagcctgagctgcaggagcctcagccagcagcacctggaacaccaggtggcttctccgaagtcatgggcagtgccctggcctgaaggcccacaacccccacccccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaagtgaacaataaatcatttcaaagatg

SEQ ID NO: 504291 - DNA, 151 bp, Homo sapiens
aggtcggaccgctgaggtgtctccatctctgcctcacttcatgggactgagctgtacctccccgtagctgtacctcacccgtagctgtacctcacccgtagctgtacctcacccgtagctgtacctcacccgtagctgtacctcacccgta

SEQ ID NO: 504292 - DNA, 928 bp, Homo sapiens
gttttttagccatttcccccccctctgttaatatgggtataatcccagggcgttcccaaaatgttgttgtgtaaaccccggttgcttttttttgttgggctccacatcttcggggcgcaattttcctccattgcgcttttcctcagaagggaggtcctcctggtaaggtcgagtgcatgtattataattcgggccgggcctgcctgtaggtcactttcttggttgtccccccaaacccttctggggtttatatatgccctgcagtgcgcacacacgttgtaattgttcgaactctattattcccccctttggggacaaaaaccactaacttctgaagacccttgctttctggagccaccgcctctctaacccccgtggtgaccctggtaataatactggttaggcccccgctgtttcacaagcccaaaaaaaattccttttttccatcgagaccacactagtttcacccgagtaaagtcttcgcttctcccccacactcgttgttaacccccctttcttcgtgtccataaagttaacatacggggccgctcccccgtgccccctctgcgtcttattttcgaacgccccccatctccccatcaatcgtatttcgacccccctctcctcaaatagtccccctccttcttacttcttaactacgctggcacctcgttcttatcatacagcactaatacatcgcatattgagagaagacatatactttcgctgtgtatcgctcataaatgactccccaccccatttcttgattaaaaattcagctcgtagattatacacacctttattaataattcaatagtcccggccagatgcaccccacaaaaatactatttgtgtcattgattgaatcctatacttttaaatagcgtataattttggccccccccaaaaaaaaggccttcacaaaaca

SEQ ID NO: 504293 - DNA, 2228 bp, Homo sapiens
agcggggtggcggcgcggagccttgggcccggctgcggcccggcggcggccccggcgcggtgcgggcgttcgcggcgccccgggagctgcaggggccccgggcggcggcgaggccggagaggggcgggcccgggacaccggcacccggcgccctcggagccaaaggcgcgcggcggacacggcggggccctcgcgcgcctggagacgatgccaaagctgcagggcttcgagttctggagccgcaccctgcgaggggcccgccacgtcgtggcccccatggtggaccagagcgagctggcctggaggctgctgagccggcgccacggggcacagctctgctacacgcccatgctgcatgcccaggtctttgtccgcgacgccaactaccggaaggagaacctgtactgcgaggtgtgccccgaggaccggcccctcatcgtgcagttctgtgccaatgacccggaggtgtttgttcaggcggctctcctggctcaggattactgtgacgccattgacctgaacttgggctgcccacagatgatagccaagagaggtcactatggcgcctttctgcaggacgagtgggacctgctccaaagaatgattttgctggcccacgagaaactctctgttcctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaacatccagtgcctgcaggacgtggagcgctgcctccgggacacgggtgtgcagggcgtcatgagcgcagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacacgctgcaggtgcaccaggagctgcgagaggagctggccaaggtgaagaccctggagggcatcgctgctgtgagccaggagctgaagctgcggtgtcaggaggagatatccaggcaggagggagcgaagcccaccggcgacttgcccttccactggatctgccagccctacatccggccggggcccagggaggggagcaaggagaaggcaggtgcgcgcagcaagcgggccctggaggaagaggagggtggcacggaggtcctgtccaagaacaagcaaaagaagcagctgaggaacccccacaagaccttcgacccctctctgaagccaaaatatgcaaagtgtgaccagtgtggaaacccaaaggtgagtgggttccggctgcaagccaccaaggcttcagctttgggggtgggcagggtggtctctgcactgcttggggtggcaggtctggtgcccgcccagctgggtttgcaacgtggctcaaggtggcatggatgcctcaggacggccccttgcttccagccaagcccctgcccaggcctggaggggaagagagtctgggtgggttggggtgagggagaggcatctggcttgggagcagttcccagggctgcatccaggccgtgggcatctggcagaggcttccccagtggggctgctcccctgctggccagcctggccccgggagtggtgctggccacaggctcccgagatttcctgtgcccagggcaacagatgtgtgttcagcctgtgccgcggctgctgcaagaagcgagcctccaaagagactgcagactgcccaggtcacggattgctttttaaaaccaaattggagaagtctctggcctggaaagaggcccagcctgagctgcaggagcctcagccagcagcacctggaacaccaggtggcttctccgaagtcatgggcagtgccctggcctgaaggcccacaacccccacccccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaagtgaacaataaatcatttcaaagatg

SEQ ID NO: 504294 - DNA, 831 bp, Homo sapiens
  misc_feature (41)..(41): n is a, c, g, or t
  misc_feature (67)..(67): n is a, c, g, or t
  misc_feature (99)..(100): n is a, c, g, or t
  misc_feature (106)..(106): n is a, c, g, or t
  misc_feature (108)..(108): n is a, c, g, or t
  misc_feature (113)..(113): n is a, c, g, or t
  misc_feature (150)..(150): n is a, c, g, or t
  misc_feature (166)..(167): n is a, c, g, or t
  misc_feature (178)..(178): n is a, c, g, or t
  misc_feature (209)..(211): n is a, c, g, or t
  misc_feature (213)..(213): n is a, c, g, or t
  misc_feature (234)..(234): n is a, c, g, or t
  misc_feature (239)..(239): n is a, c, g, or t
  misc_feature (248)..(248): n is a, c, g, or t
  misc_feature (275)..(275): n is a, c, g, or t
  misc_feature (277)..(277): n is a, c, g, or t
  misc_feature (282)..(282): n is a, c, g, or t
  misc_feature (286)..(286): n is a, c, g, or t
  misc_feature (295)..(295): n is a, c, g, or t
  misc_feature (297)..(297): n is a, c, g, or t
  misc_feature (299)..(304): n is a, c, g, or t
  misc_feature (336)..(336): n is a, c, g, or t
  misc_feature (342)..(342): n is a, c, g, or t
  misc_feature (348)..(348): n is a, c, g, or t
  misc_feature (362)..(362): n is a, c, g, or t
  misc_feature (424)..(424): n is a, c, g, or t
  misc_feature (556)..(556): n is a, c, g, or t
  misc_feature (565)..(565): n is a, c, g, or t
  misc_feature (591)..(591): n is a, c, g, or t
  misc_feature (643)..(643): n is a, c, g, or t
  misc_feature (652)..(652): n is a, c, g, or t
  misc_feature (702)..(702): n is a, c, g, or t
  misc_feature (824)..(824): n is a, c, g, or t
ctaacaatggaaggctctttctttcttgtaattcataattntatctggaactctgcctctccctttnaacatcattttgtcaggatagacatgaactgnnccaaangnttggntgtctggagctgtttcaataactccttctaggttgangtggtatacaccaaanngttcctcagtnttgccaccatcatgggtgtgaccagcaaagnnncncaccacacactcatggggccngatgnctgcccggncctctctgtcgttcccggccaggcccncnttgtngggngcgtccggngngnnnnnngggtggcaatcaccaccttttcttggtttgtntcaganactgtnagcccttcattcanccagtttagctgttcttggctgagtcctccattaaactggacagactggggctcagagagtncatggttgtccatactataatgctgaataggagggagctgaagaattttaagacaatctattagattctcagctcaaagggataattcaccttgagggctattcagttccgtatttgggttgtgctccctcnatatcttcntacactgctcgtattttggagaagantgatccacgcccaagacactcaagtcatatgcatcaagtaaaatgaaccggnatttagggnatggtacaaaatgataagcataataatcttctgaaggcatggtctcaggntgatgtacaatctgatcttctagaaacttagtgttaagtttagagtgtgttaaatactctctactgaagttatagaattcatggtttccccatgtatgatgaactgggactttaagcatccngggaatt

SEQ ID NO: 504295 - DNA, 2144 bp, Homo sapiens
agcggggtggcggcgcggagccttgggcccggctgcggcccggcggcggccccggcgcggtgcgggcgttcgcggcgccccgggagctgcaggggccccgggcggcggcgaggccggagaggggcgggcccgggacaccggcacccggcgccctcggagccaaaggcgcgcggcggacacggcggggccctcgcgcgcctggagacgatgccaaagctgcagggcttcgagttctggagccgcaccctgcgaggggcccgccacgtcgtggcccccatggtggaccagagcgagctggcctggaggctgctgagccggcgccacggggcacagctctgctacacgcccatgctgcatgcccaggtctttgtccgcgacgccaactaccggaaggagaacctgtactgcgaggtgtgccccgaggaccggcccctcatcgtgcagttctgtgccaatgacccggaggtgtttgttcaggcggctctcctggctcaggattactgtgacgccattgacctgaacttgggctgcccacagatgatagccaagagaggtcactatggcgcctttctgcaggacgagtgggacctgctccaaagaatgattttgctggcccacgagaaactctctgttcctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaacatccagtgcctgcaggacgtggagcgctgcctccgggacacgggtgtgcagggcgtcatgagcgcagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacacgctgcaggtgcaccaggagctgcgagaggagctggccaaggtgaagaccctggagggcatcgctgctgtgagccaggagctgaagctgcggtgtcaggaggagatatccaggcaggagggagcgaagcccaccggcgacttgcccttccactggatctgccagccctacatccggccggggcccagggaggggagcaaggagaaggcaggtgcgcgcagcaagcgggccctggaggaagaggagggtggcacggaggtcctgtccaagaacaagcaaaagaagcagctgaggaacccccacaagaccttcgacccctctctgaagccaaaatatgcaaagtgtgaccagtgtggaaacccaaagggcaacagatgtgtgttcagcctgtgccgcggctgctgcaagaagcgagcctccaaagagactgcagactgcccaggtcacggattgctttttaaaaccaaattggagaagtctctggcctggaaagaggcccagcctgagctgcaggagcctcagccagcagcacctggaacaccaggtggcttctccgaagtcatgggcagtgccctggcctgaaggcccacaacccccacccccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaagtgaacaataaatcatttcaaagatgcgagagcccacagcctgtgaccactgccctctcagacgcagggaggcatgagccggggcaggtgcggttggggccagtgggggcttctgaacaacaggatacatctaaatgaaggcagcatctgggtagacaaaagtgggggcttaggtcccctccccacctcccctaggcgcctccataggcaagtggccaaagcctccgggagcttcggatgcctcacagccttggaagcaccgcctgcgaggccacagtggctgctgctgggggctgttgaatctga

SEQ ID NO: 504296 - DNA, 296 bp, Homo sapiens
tcacagggctcccgggtcttggacaaggatggcaagggttatatcagggcagaaaaactactgtcacgtgtcatggacaaatcttaggagaaaaaaatctaacaagatgagaaaaatgtaagatgagaaatggatcaagaaaacgcaagattattggatgggaaacgggacaatgtcaatctatggaaaaattcgtacagatgatgatctggcaaataggaaaacctatctttcaatcccctttttccccctctctaaaaaaatcaatatggaattctttaatctaaccttctggc

SEQ ID NO: 504297 - DNA, 190 bp, Homo sapiens
cacgtgtcgcaactcctgacctcaggtatcaccctgcttgcctcccaaagtgctggtgattacagtgtgtgggccacgcgcacctggcctaaattagtcctttctttttttttttttttgcaataaattctcgctttgttgcccaaactgaattgcattgcggcaatcctggcatcattgcacccccggt

SEQ ID NO: 504298 - DNA, 1924 bp, Homo sapiens
agcggggtggcggcgcggagccttgggcccggctgcggcccggcggcggccccggcgcggtgcgggcgttcgcggcgccccgggagctgcaggggccccgggcggcggcgaggccggagaggggcgggcccgggacaccggcacccggcgccctcggagccaaaggcgcgcggcggacacggcggggccctcgcgcgcctggagacgatgccaaagctgcagggcttcgagttctggagccgcaccctgcgaggggcccgccacgtcgtggcccccatggtggaccagagcgagctggcctggaggctgctgagccggcgccacggggcacagctctgctacacgcccatgctgcatgcccaggtctttgtccgcgacgccaactaccggaaggagaacctgtactgcgaggtgtgccccgaggaccggcccctcatcgtgcagttctgtgccaatgacccggaggtgtttgttcaggcggctctcctggctcaggattactgtgacgccattgacctgaacttgggctgcccacagatgatagccaagagaggtcactatggcgcctttctgcaggacgagtgggacctgctccaaagaatgattttgctggcccacgagaaactctctgttcctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaacatccagtgcctgcaggacgtggagcgctgcctccgggacacgggtgtgcagggcgtcatgagcgcaggtgggcagtgcccaggacagcagccaggccccatgcacacggcctgataccaccgcccagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacacgctgcaggtgcaccaggagctgcgagaggagctggccaaggtgaagaccctggagggcatcgctgctgtgagccaggagctgaagctgcggtgtcaggaggagatatccaggcaggagggagcgaagcccaccggcgacttgcccttccactggatctgccagccctacatccggccggggcccagggaggggagcaaggagaaggcaggtgcgcgcagcaagcgggccctggaggaagaggagggtggcacggaggtcctgtccaagaacaagcaaaagaagcagctgaggaacccccacaagaccttcgacccctctctgaagccaaaatatgcaaagtgtgaccagtgtggaaacccaaagggcaacagatgtgtgttcagcctgtgccgcggctgctgcaagaagcgagcctccaaagagactgcagactgcccaggtcacggattgctttttaaaaccaaattggagaagtctctggcctggaaagaggcccagcctgagctgcaggagcctcagccagcagcacctggaacaccaggtggcttctccgaagtcatgggcagtgccctggcctgaaggcccacaacccccacccccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaagtgaacaataaatcatttcaaagatg

SEQ ID NO: 504299 - DNA, 1416 bp, Homo sapiens
agcggggtggcggcgcggagccttgggcccggctgcggcccggcggcggccccggcgcggtgcgggcgttcgcggcgccccgggagctgcaggggccccgggcggcggcgaggccggagaggggcgggcccgggacaccggcacccggcgccctcggagccaaaggcgcgcggcggacacggcggggccctcgcgcgcctggagacgatgccaaagctgcagggcttcgagttctggagccgcaccctgcgaggggcccgccacgtcgtggcccccatggtggaccagagcgagctggcctggaggctgctgagccggcgccacggggcacagctctgctacacgcccatgctgcatgcccaggtctttgtccgcgacgccaactaccggaaggagaacctgtactgcgaggtgtgccccgaggaccggcccctcatcgtgcagttctgtgccaatgacccggaggtgtttgttcaggcggctctcctggctcaggattactgtgacgccattgacctgaacttgggctgcccacagatgatagccaagagaggtcactatggcgcctttctgcaggacgagtgggacctgctccaaagaatgattttgctggcccacgagaaactctctgttcctgtcacgtgcaaaatccgtgtcttcccggagattgacaagaccgtgaggtacgcccagatgctggagaaggccggctgccagttgctgacggtgcacggacgcaccaaggagcagaaggggcccctgtcgggtgcagcgtcctgggagcatatcaaggctgtgcggaaggctgtggccatccctgtgtttgctaacgggaggaagaggagggtggcacggaggtcctgtccaagaacaagcaaaagaagcagctgaggaacccccacaagaccttcgacccctctctgaagccaaaatatgcaaagtgtgaccagtgtggaaacccaaagggcaacagatgtgtgttcagcctgtgccgcggctgctgcaagaagcgagcctccaaagagactgcagactgcccaggtcacggattgctttttaaaaccaaattggagaagtctctggcctggaaagaggcccagcctgagctgcaggagcctcagccagcagcacctggaacaccaggtggcttctccgaagtcatgggcagtgccctggcctgaaggcccacaacccccacccccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaagtgaacaataaatcatttcaaagatg

SEQ ID NO: 504300 - DNA, 961 bp, Homo sapiens
gttgcccaccgtattcacaaaccgtttgaacgtcctttttactgtggaccaaggaggccccagatatacgagctggtggcacagactgttgtcggagcggaaaaacttgttgtgctctcatcactgaggactgccggatccctgaaagtgccctgcgcgctgcctctcgccctaagccccggcccagcccgagcagcacccgagaacccctcctcagcagctctgagaacggcaatggtggccgagagacgtctccagctgatgcccggaccgagagaatcctcagtgacctccggcccttctgcagaccaggccccgagggccagctcgctgccacggcccttcggaaagtgactgtaccctgaagcagcattcatgttatccggacggaggaagacaatggggcggggcctccatcgagaatggggtaatggggtcccaaggcggccggccacaccgagcccagcacggacccaggaaatccaggagaacctgctcagcttggaggagaccatgaagcagctggaggagctaggaggaggaaccttcgccgcctgagacccctccttcgtctcagctataggggggaacatctgtacccccagcctaggctagcacattgaggttcccgacccaggaagagcctatgttgcaagaaggagagcgaatggggcgagaggacgtgagggaccacccccaccgacacagctgcactgcagcatctcacaccccgagggccgtagacggagagggagctgtgggccacgacatgggagagggcccagactcggggttactggcacccgtcatagacgacctcgtgccatctctccactcctgccctctgacttggggtatctcagggctccattctggagggcaccacgctgacccgggccatctcagatattgcctgtggggccacccctccaccccataccccgagtgccttcgctctgat

SEQ ID NO: 504301 - DNA, 320 bp, Homo sapiens
tcggcctcttatttagttacactggtttgcaggcctcttcaataaaggtggggctgtgcgtagagcacttggtcgatgcagcaatgatcaagacagactacataaattgtcccttcaaagaagagccgtccttctggtgtgtgagattgacagtatgcaggatgaattagtgctcgagagcaccacgtttgtgtcgttgcggataaagcctgcgaaggaggatgttgagtgtcccctggtggtagccagggaaggcctccctgagatggtggcagtcgcagctgctgctagccagaacctgctgtcatgcatcttacttt

SEQ ID NO: 504302 - DNA, 250 bp, Homo sapiens
ccatatacgtggagcccgaggacaggcgcgagcagtaacgcaacccctgtgagtccgacgagatgagtcatcagcaaaaactgccctgtgagcaagcgcggcgcacgactgtgcggcgccccttggatctggaccgtcgagatgatccctattgcccgtaacccaagcggccaactttggatgaaccctatcattatgactttaacacccaacacggctttcacgaatttgagcacagggaccgcggccg

SEQ ID NO: 504303 - DNA, 503 bp, Homo sapiens
tagatgcactttagcctcttgatgttagcagttgagtcctccctgcgcacaaaatacatttgtggtaatgaatgcccagaatctcactggcacacccaagagtagttaaactaaaattgctactaacacaacattgtagaattcgttgccttaatggatgtgatcttctaggcttactgtgtcttaacaagcagtcttatatatatttatcttgcccagaaagtacacttgtagaatttaacatttgctcctttctccaaacagattaaaggttatgcagctgaatgattctgtgtcccattttaaaggtccaggctatcccctagatttagattagttcctaaaaaatcttccagtctgaatcctgacaaatggatagctaaattaatttccactcctcttctctcttgcactgtttggtacattacagccaccattagccttaaaagctgcagcagccaaattcggtgacagtaacataaagcctgagcttaaaaaaaaaa

SEQ ID NO: 504304 - DNA, 433 bp, Homo sapiens
taatgcaaataaatcccactttagatcttacagctaactgtgtgccttagaaaccagataccttgcgcaagtggcctatcagctaatccagtgtcttgaagagccatcactccaagtcttacgtgaattttagtggcaaagagatctgattattttaagattacacaactctcgtgcaaaggctcagtcttatagagcttcattttttcccccatcgtctcattatttttgcttaccacagaaacataaggtatgtgggggcttatttaaaactgtatctaaatacagcataaaaacaatataataacatgaaagaatgcttccctgagttgaatgcaaaggacagattgggaacccatttaacatcatctacaggtagattttttggtgacctgagtgaaaagtttattttgagagaaagtatgtaaccaaa

SEQ ID NO: 504305 - DNA, 863 bp, Homo sapiens
tgccaagctagacgcctcaaactccagcatttaagcattaagtgcattggtacatttaggccactggatccagatttatattggcagttccatcgagggcaaaatgcaagtatattgtaacagaatgtataaatattgtgataaaacagtctatattggattaaaaaatgaattataacactaaagctgtacctcaaaggtttcaaataataatttgatgaaatattttatacaactctttgcaaaggatccgtctgtggctttgttatactctttgagggtggtctttttagaaaccatgatttccatggcctgtagtttaagtggtttggttggttgatttaatatttttttctcctaatctatgactttatatgttttttcttagtttagtaatagcatctttgatcctgtgcttagcatgttagggtcattatacctcaggaatagcaagctgttaagtaaccatactgaattaactatttaattacagtgagctcatctcttaaaaatctgttcaggtgtaaattccttatgagaaaacatgaaaaaagcacacttgatttatggcagagttgagctaaaaacatttataacatacttggctgggatgttaagccatcttttcaatgtactctgagaacaattaacattgtccagagatcatttatattacctcccaattgtattacccagaaccttgggagaaatccttagatggggcacacctgtgttcaacgtctttaaaatgccgtaattcctcggcaaggcacagagacatagtaatgctgtaatacagtggaccacttaaaacacataatttggggcgcgccttggccaacaacaaagtgtaaaggtcgcga

SEQ ID NO: 504306 - DNA, 171 bp, Homo sapiens
agctggaatgttcctcaagtacataatgcaggattttaattttaataagaagctggaagttgaacaaatgatatcatttaagacacatgcctgccttagggacctggtttttggcttcctgtttctggcttttataagggtaacgaatataatagccacccgacttgtacc

SEQ ID NO: 504307 - DNA, 193 bp, Homo sapiens
  misc_feature (119)..(119): n is a, c, g, or t
gctatgatgctagctactcaggaggctggggagagaggatcagttgaaccctgggaggtcacggttacagtgagccctgattgtgccactatactccagcctgggcaacagagtgagancctgtctgaaaaaaaaaaaattaccctgtgtactgcccgatgcaaataaaaatttagattaccaattccttgct

SEQ ID NO: 504308 - DNA, 1426 bp, Homo sapiens
  misc_feature (33)..(33): n is a, c, g, or t
  misc_feature (76)..(76): n is a, c, g, or t
  misc_feature (752)..(752): n is a, c, g, or t
  misc_feature (870)..(870): n is a, c, g, or t
aggtagatgttagtgttacggtgttatagaaanatagataactaccccctgggcggggagaccccacttgtggtgntttgttgcaccacacaaagcgggagccgcagccaccccagtcggaatagtaatatggttgggtagagacttttgtttgggttagtaaatacgattttttttataagtagaaagattggggggacaccccaccactgtataaatagagaaaaaattggggtgggtacgtattataatcatgtgatgggttggtagtattatatacaaagcgtccctgcatgaaagagtagtggtttatcttttcgctcacgagtgggttcccgcgtaaaaatatatattgttcttatcgacaaacaggggaatcaacaccgctgttgtgtgttgtagaggaaaacagtttttattagtatgtacttccaacaacacctttgtgtagtagtatcacgcgggggccccaccatgtggagacaacaacactgtgggagacctctcattgggctacattgggggggaaacatcgcgtttaatagggtgtaataaatgtgtcgtcgtggtggaagacctccccacatagcccccctttttaaaattatctgcccacacacattgtggagtgttatcacaggcgtcttcactccttctaacattgcacacacccacacgtttattttccatataatagagagcctctcccaccttggggaagacacactttgtagagacgccttgtctataanaaggggaaaaaaacaggtgtttataccccctctggggagagccacacaggagagacacatatcacaggggtttttggccttttggggagagacactttgagagagagggtataagagncctcacagggggtcatatagagcgcatttgtgtgcacacaggggccccgcggcgacagacacactgtgctatatacttttgtggaagagggagaggcgcacactgtgcaacacccttgtgtatatatatataggttatattataaacaaagtatatatacattgttgtgggcttcgtgggcggcacacacatgggctctcacacgcgctcgtgaaattccccacagcacactctcttggggagagttctcgagaggacactgtccggagtcacacttggagaggtgtcacagagagagtttcgagagagccacaccccttggccacaatatatggtggaaaaccccacttttgtatctataaaaatacacaccacaaagttatagccggggcgtgtgtggcacaggcgttctgtaaatcccacagctgtcttgggagaggctgaaggcacaggaagaatcacacttgaaaccctggagaggtggcggttgcaatgaggcaccagatcaagccacctgcaactccaagcctgggcaaccaaacgagacttcgtttca

SEQ ID NO: 504309 - DNA, 223 bp, Homo sapiens
ggaatccgacaggatgttggcgtaaacagcggtcattttatccatgcaattgtgtgcttcgtttggaaagcttgacgtgagtgtgtgcctttcttggtctgaggcattctcttgccggcagacaacttcttggatgtcccgacaccttgatcactgggggcggcttaggacggggtacccgaagcctccgaaatttcgtaaatccattggtccatagccttgt

SEQ ID NO: 504310 - DNA, 917 bp, Homo sapiens
  misc_feature (46)..(46): n is a, c, g, or t
  misc_feature (63)..(63): n is a, c, g, or t
  misc_feature (128)..(129): n is a, c, g, or t
  misc_feature (239)..(239): n is a, c, g, or t
  misc_feature (260)..(262): n is a, c, g, or t
  misc_feature (267)..(267): n is a, c, g, or t
  misc_feature (269)..(270): n is a, c, g, or t
  misc_feature (273)..(273): n is a, c, g, or t
  misc_feature (281)..(281): n is a, c, g, or t
  misc_feature (286)..(286): n is a, c, g, or t
  misc_feature (289)..(289): n is a, c, g, or t
  misc_feature (315)..(316): n is a, c, g, or t
  misc_feature (320)..(320): n is a, c, g, or t
  misc_feature (465)..(465): n is a, c, g, or t
  misc_feature (508)..(508): n is a, c, g, or t
  misc_feature (535)..(535): n is a, c, g, or t
  misc_feature (546)..(547): n is a, c, g, or t
  misc_feature (557)..(557): n is a, c, g, or t
  misc_feature (571)..(571): n is a, c, g, or t
  misc_feature (585)..(585): n is a, c, g, or t
  misc_feature (594)..(594): n is a, c, g, or t
  misc_feature (598)..(598): n is a, c, g, or t
  misc_feature (643)..(643): n is a, c, g, or t
  misc_feature (748)..(748): n is a, c, g, or t
  misc_feature (835)..(835): n is a, c, g, or t
gcaaacgggcaggctatattattatttcaggtaataagttggtganaattcaacgaagttgcntatcaaaacaataaggtgccatgctggggcaggggcactgccagctgcacaagccccaggcaaanntggtatttggtaatgggggctgtctctcctttgctctaggggagtccgctcatcctcgcccaagttgctttctttttctcccttgattttcctgttgccaggggtttgtntcatttgggctctgttttttnnnggggntnngtnggcgatgnttggngtnggctttctttccttatgttcttttanngccnggttttcccaaatccggttcttctttttctctgttgttttcttgttgccttctgctcctctttttctgttctttcctagtttcttgtttttttctccttcgttacccccttctcttcttggggggggtgtttctgcgaggttgtnctgtctttttgtttcacacagcctcaggggccttcggccagtngttctgcttcccattatttgtgtgtcntcacctctccnntgtctgcgcngtctccaggctganagatgcagcatgtnataattttnaganatgtacatccacatcttgatgaccagaaatggggatccacaaggnacatttcaaagttcttatccaaactagtctacctcccagttccacatcttaaaatcaacttgtatgcccttgtataaattaccccaaatcaagaaaacaaagacncagaaaactttctttcccttctaagttagtgacctcattgattttgtttcacagcttatggaagatggtggggtgacacttttggtnaacaggatgttggcaacaaagagaaaatatctctcctcagactccaccaactctaacctgccagcctgttagtacctgtgta

SEQ ID NO: 504311 - DNA, 236 bp, Homo sapiens
  misc_feature (3)..(3): n is a, c, g, or t
  misc_feature (9)..(9): n is a, c, g, or t
  misc_feature (39)..(39): n is a, c, g, or t
  misc_feature (61)..(62): n is a, c, g, or t
  misc_feature (69)..(69): n is a, c, g, or t
  misc_feature (80)..(80): n is a, c, g, or t
  misc_feature (90)..(90): n is a, c, g, or t
  misc_feature (92)..(92): n is a, c, g, or t
  misc_feature (94)..(94): n is a, c, g, or t
  misc_feature (133)..(133): n is a, c, g, or t
  misc_feature (213)..(214): n is a, c, g, or t
  misc_feature (219)..(219): n is a, c, g, or t
  misc_feature (226)..(226): n is a, c, g, or t
  misc_feature (233)..(234): n is a, c, g, or t
tgnttatantcagattttattttaaaagccatgctgttnaacaagaaaaagcacaaaaganntccagantcctggttcancattctgtancntnctcactttttcaaggtatctattttgtgcataaactaantgttaactattcatggaacagcaagccctgttaataagacttgaccaagctataagccacgtacatattcagtatgtgtnnttaantcctcanagacctnnat

SEQ ID NO: 504312 - DNA, 266 bp, Homo sapiens
tacgctatagatttacacaggcgcgcagtggtcctgcctgtaatcccagcacttcgggaggcgaagacgggcagatcacttgaggtcagaagctcaaagccaacatggtgattcaaaaaattagctgtctctactaaaaattcaaaaaattagccgggcctggtggtgcacacctgtagtcccagctactcgggaggctgaggaaggagaatcgcttgaacccttggggggcaagaaattgcagagagcccggggatggtgccacg

SEQ ID NO: 504313 - DNA, 366 bp, Homo sapiens
tggaatatttgtatagacaatcggagttatcttaagaataaaacccaactctaaaaatgaaattcatttatgtttcatgtatgccttattacacattgcctgaatataactttatacaacattttaaataattttatatatgaaacaaagtttgtttgcattaaaccatcagaaactaaatgtttcattatctcagccacccataaggacaatctgtggttgtgtgacatcaccatcgttcctgacactgaatttatatgttactaataagcaatcattttcttataataattcatacgtaagtactgaatggtaaaaaaatatgtcataccactaatacagtgaaaaaaataataggtgcagggt

SEQ ID NO: 504314 - DNA, 640 bp, Homo sapiens
  misc_feature (273)..(273): n is a, c, g, or t
gccatgatggggacgatttttgggccctcccccaccccctggtttccagaacccagaaaacgccagttttttctccataaccagcttggtttggggtggacccagttccggctggtagatatggttaggagaccctgcaaaacggtgaagggaatttatgctttgtcatgatgaagaacatgagaacctgtttgccctggttcgaagaatgttagaatatgttcccaccccaagaattcccttggatgaagccttgcagcctcccttctttgncttattaaaaaaaaaatgaaatggggacccgtggtcttcctatatacttctctagaaaagatttcttaaggctggggccggcccctaacccttttaatatttttggaacccttaaattattttggcccgttaaggggaaaaattggatgttttggctccaaagcataattaccctgttaagccaggatggtcttgataatgccttagaaaaattaaaattaatttttctttttggaattcccctttttaaaaccccttgaaaaatcccttggggcccgtgataaatgggattggtcttcccctttggccctggggggcccccctgaagggattttttttgggtaaaaggaaattttggctcctttta

SEQ ID NO: 504315 - DNA, 252 bp, Homo sapiens
tcccttcgtgtttgtgcatccgaggtgctggtggacagcgcggaggaggggtcctcgctgcggggggagtggcgtcagaagcgcgaacagagactgcgcaattccgggagctgcacctgatgcggaatgaagctcgtaaattacatcaccaggaagttgtggcagaagataaaagactaaaattaccctgcaactttggaaggcaaacaaagctcgttttggacgtgggaacctacaacggaacgacggacc

SEQ ID NO: 504316 - DNA, 259 bp, Homo sapiens
  misc_feature (219)..(219): n is a, c, g, or t
cttgtgtagaaggttggccgaactgcagggtgtcgcgccaaaacgcacatagaaaccggcttccacaacgcatgctggctcgaatggacgcacgatggcatctccatcacgtggggaaatctgaatcgcacggccaggccgtagttgcgaatgtcgatcacattcttgcttgccttcaaaccgtgcagcgctttctcaacagtgcggcgcgatttcggntaaccctctgcacccaaggtttcttttcttgcaacagggt

SEQ ID NO: 504317 - DNA, 890 bp, Homo sapiens
ggagagaactagtctcgagttttttatttatttttttccctcgtgctcagggatttaataacacaaatagtggcggaaagggcctcagcccagcccaccctcacctgtctttcccagcccacaaggggggacgactcagggcccagcaaaagcgatgctgaaaggggaacacagtccagagtccaaacagcaaaactgggggaaagcggctcggggtgggccaggaaccataaacatagtgtataggggccgggggctttcgtgcccgaagggtctcccgctgggaccaggacgccaggatagggacggggaaaccttcagtatagttcctcacaccacagcacattctcagaagaagtgaatgtggcgttcaattaaccttctttacaatagcccaaagttgggggagaatgaggcgtgttacccgtggggaccagaggggggcctccagggagctccaagcggggggctcaaaaacaattaggaccacacaaaaaacatgtacaaagagtggcaccacacctacagaagtatgttcccactgagccaagaagccagaaaagcgtgtaacagtggcccccacctagtgggagcatttgtgaagaatagcgccacagaggaggagtatcccccccacgagactaattaacaaatgttcttaccaacaagaaaacggtctagcaggaaatctctatgtctgccggcgaccaacacacaaccaacagggcgtgtaataaactgtacacaggcgacgagggagaaattgtagtaccttccgcggcgtaactactcttacccctcttcatgctctaacctacaataattccgacaccactcttggaggacaagaaccaacaacaaacagaggtcttaccatgctaacccataag

SEQ ID NO: 504318 - DNA, 125 bp, Homo sapiens
tgtctcgtctagaggatcccttgggctggggcgagagggagaacagtgcggagtgctccagctcctcatggtgcagatctgcgaggcacacatgacccgcagtgtccccaggtgacgcctcatta

SEQ ID NO: 504319 - DNA, 674 bp, Homo sapiens
tgagttgcatgtgagagtagaggaaaaacgctgttacagagtattttccagataaaaccgcccaacccaaaagccttcctgtcagccctagggttagcagacgagcttaaccaacatggcaaaaccctatctctactaaaaatacaaaaattagccgggcatggtggcaggcgcctgtaatcccagctacccaggaggctgaggcaggagaatcacttgaacccaggagacagaggttgcagtgagccgagatcgcgccactgcactccagcctgggcaacagtgtgagactctgtctcaaaaaaaataaaaatacaagatgcccaatgtaatttgagtttcaaatatataaggactgatttgtaatgtacgccccaggcagtaggtgagacatactaaaaacattttttgtttgttttctgaaactcagattccacctgagttttatctggcaactgtagttagcaacagccattggagggtgctcctggatcctcatgactgaatcaggcctggggtaggcttccccacccatgctcccaacctgtatcaccaaacagatcccactagaatgtggctcctaaggagatagggataaggctgctttggccagtctgtcccctttggtatgggtgccttggccagaggcctttggccctgcagatgcagcttcc

SEQ ID NO: 504320 - DNA, 395 bp, Homo sapiens
  misc_feature (361)..(361): n is a, c, g, or t
  misc_feature (379)..(379): n is a, c, g, or t
  misc_feature (389)..(389): n is a, c, g, or t
attctttacactgccggtttacactgtttctccaagacatcacagctgatatctcctggtgctatccccaaactgccactctaaactcttgaagtaaataaataatctttgctggcaggactctgctgaatctccttaggcactctctaatcagatatcctaggtcctcccaattcttagaccttttatacctgtttttctccttctgttattccatttagtttctcaattcatccaaaaccgtatccaggccatcaccaatcattctatatgacaaatgtttcttcttacatccccacaaatatcaccctttaccacaagacctcccttcagcttaatctctcccactctaggttcccangctgcccctaaatcccanttgaagcagncctgag

SEQ ID NO: 504321 - DNA, 413 bp, Homo sapiens
  misc_feature (4)..(4): n is a, c, g, or t
atgntggtggaccccaagcaccaccgccactttgttatccgcagaggccaggtcttgcgggagattgctgaagagtatggcggggtgatggtcagcttcccacgttttggcacacaaagcgacaaagtcaccctcaagggcgccaaggattgtgtggaggcagccaagaaacgcattcaggagatcattgaggacctggtaggcacttgggtgttcggggaggggttttcaccccccagtggccactcaccgaagccgtgtatgagtgttcgctcccccctgtagggaggtgactccctcatacagccctggaaggcttcagaaggggctttttggggctcgcttttttttcctcagcctgtttggcctccttcctgatagttggtgagaattctgcctgcgagaagccctta

SEQ ID NO: 504322 - DNA, 200 bp, Homo sapiens
acaatcgcggtaaatacaggatccgcatatggccgctaccctccggaagatggtgaagaaaattgagactcggccattcaacgcctccggccattcaacgcctccgggccattcaacgcctccggccattcaacgcctccggccattcaacgcctccgggccattcaacgcctccgcctccgggccattgaacgcctccg

SEQ ID NO: 504323 - DNA, 122 bp, Homo sapiens
aggctatctatgtgcctgctgatacttgactgaccctgcccctgctacatacgtttgcccatttggatgctgccactgtactgtcgcgtgccattgctagagctgggcatctatccagctgt

SEQ ID NO: 504324 - DNA, 385 bp, Homo sapiens
ttttacgccttatttctagatggttaccacaggctcgcggcacatggtatgccactgaagcgaaaatgtgtggttacaatccgggcttttgcaatacgtattgctacgtgaaatgtagggcatcatatcgccagataacgaaatttcacgatagttagtcgcaggccattgcaaataaagtcgttttctcccccgatttagccaagctgttgattttgcagcgagttgcaccggggcggattgggggtatcgctgggagtgtcgaaagtgcttcggagcattggaatccggcatgcgcatcatgttggacagcagcgtccacgaccttcccaacaaacgtcagttaccaaagccaaaaccggaagtcggttgacgttattcgatc

SEQ ID NO: 504325 - DNA, 125 bp, Homo sapiens
cgggccagtacggatgtgagggccagtacggatgttccctaagcagcaggcatacgcctaaggtctcggggcaattctgacgttaccaaacaggatccactactaaaatgccacatccgtacggg

SEQ ID NO: 504326 - DNA, 100 bp, Homo sapiens
actatcaatccccagctgtggaataaggctgttgttccttgcagcggatcctgatttggacacgcagcaatttgcaagtgtccccgttcctatattgaaa

SEQ ID NO: 504327 - DNA, 320 bp, Homo sapiens
  misc_feature (320)..(320): n is a, c, g, or t
agttcgatggatactctcgttcttccgagccagctcgtcatttgggcccggatgtctgccattgattcttggcgaggtcctgctgatttgcgggcatctaactccatcggtcaaaccatgatctgggccctctgggcttgtaggccttttacttcctcttcgctggttcttcttcatgaagagcagtctcctccttgagagccttcgatctctgtctccagctgcggtcgtgtgatataggtgtcatcaatgaccttggtgagcccatggatgtctttctccacagactggcgcatggccagctctgtctcatacttgan

SEQ ID NO: 504328 - DNA, 435 bp, Homo sapiens
ttcgggcccaaggtcccccttttcccccccgtggggagagctggccctgaacaatttggttccgttagtgtccttggcaggtggcttcagccccagagttgttttggttccctggctccaggggtcccaggaattgccccccaaaaagtactttatttgggtttcccggcaggagcccaaccagggcccccccccttttttttttaccagcattttgggcgtggcagcccaggattggaaaaagggggaccccttttcctgcatggtgggccccgaggcccttccgttggcctttccacaaaagacctttgaccgcttggggggttaacccccccatgtcaatgtgtttgttgtcatggcggaggtggacggcccctgttttttaaccgcccgcctgtccccccccctgaattaactccatgttccccccagcca

SEQ ID NO: 504329 - DNA, 767 bp, Homo sapiens
tggtacaaaatacatagcggtggtggataatgtctggtgtccagggttcagcgcagaaaacactatactcttctggggctcagggacagtctggcttgtcccccagccagcagtcggggtgctccactggcgagagaacgcagggtagaaagacgcaagagccgcccagttgagggcgtacacggactccccagggaatgcggtacccggatagaaagaatcgcagaagaatgggcagaaagattagaagacgcaccaccacggcctcaccaggggagcaccgccccaatgcatagaggtagaagctctgtacgcggggtctcgcttgggaagaagatagaccgactgtgtagaacccaagacgggtttgttgtgtagatcgcccaccggccaatagatagactggcctctggtgtttgtaaaacgctgggcgagatcatcccccaccatgtacagacaggctgggcggccaggacctgacttgtgcaacagggttcccagggggatgctattcgccggaagttccccacaacagctgatggaccgatgagagagactgacagaaagacggcaaaggagacattagtaggctccagacattctccccggaacaaggcccttcacctccgaacaaaggtgaacccagaccccggtggcacggtcaccgacgctgcagggtcggcctaggaacccttgcgatgaaggcctgacgatgccctgcccccccgtgtggccggaagctcggtgcataaagagtggggcccctc

SEQ ID NO: 504330 - DNA, 293 bp, Homo sapiens
  misc_feature (70)..(70): n is a, c, g, or t
  misc_feature (252)..(252): n is a, c, g, or t
  misc_feature (269)..(269): n is a, c, g, or t
gatcatcaccgggatcacttccgcgccgtgatacttgacgccgccgaggttgatgccgatgttgcgccanccgcgcgccacaccatgtagccggcgaggatgaacatcacgacgtagacggccgggcccgcgaagtcgatgaacttcttgatcgtctccatcccgttccagaacacgaacgcctgcagcacccacagcagcatgaagccggcccacccgaccgccgacagcccgagggaagccgtagcggtnggacattcgcatacggnagccatttttggggaagaattttt

SEQ ID NO: 504331 - DNA, 195 bp, Homo sapiens
gtacgatcgagcagaggagattgttataaagatggtattgtttatcctatatggctgtccattgatcactacttatcacggttacggttggtgtcggaaattagactgccgggggcttccaccggtcttgggctcttctgcaagaggctgcggaggccctggagccttgaggtgtggaactcgtacgcttccgtg

SEQ ID NO: 504332 - DNA, 794 bp, Homo sapiens
agcataatagtccttgtagggtagattatatgtcatgtccagttcatttctcttagaggtgattacctctaggcatcagccttagtccatcccatgttggtatgcaatttgagccggcaaggctcgtatcgccaatagtctatatacattttgtctccatttgttctgtgcttgacagagtccatgatagaactgtggtctagttgagttactattcctggagtagctactgtatttgctccttggaaagttagagtttctaaagttgcacctaaggaatctgtcacattattcttgtcagaatcatggtcttggttttcgttttcaaccagatattccttctgatacggacttgaaaagttaggtgtatggtgacctgtgtttcagcaaatacaaaggtactactacaaatactgtatagttatatagcttaatgagatttccagaccccgcccttttggtccggggaggtggggacgaagctagtcgggggcgggcgacttgtaatgctgatgatgtggcaaattggggcggctcgatgcttggaagacagcccgtgttcgtgaacacacagtggatgtactgcacaagattatatcctggtaaacctcgccttggaattggtctcaacgagactctctctagaaagaccaccagtgttccccttgatccctagctttctcaaacctttttctgacaccgcgggtgtgcggactggcaaggcgcagggccgggttcaaaaagcggtgttgggacgttatgcgccagaagggaacccggaacattttccgcgg

SEQ ID NO: 504333 - DNA, 145 bp, Homo sapiens
cccgctcggggctgaggcgggcggtcgtctgccccggctcgcgctcgaccccgccggcgctggccctgtggcgtgaggagtcgatcgagacgacggtgatcgtcgacaagcgctcggcggccttctacgccctcggcgcggcgca

SEQ ID NO: 504334 - DNA, 139 bp, Homo sapiens
tacaacctgtatcagtgctggtgcctgctgtccctcgcgcctgggcgtctgttgtgctgatctggcgccactgctgtcctgctggcttccgctgacgcagcctgggtgtaccaacgtgtttgctgcacgggcaggcccc

SEQ ID NO: 504335 - DNA, 356 bp, Homo sapiens
ggcactagccaggggaggggttccctcctgctagctgtggcaggagccacttctatggtgaccttgttgctggcggtgcctatcactgtcctgactgtgctggccttagtgccccaggatcagggaagactggttacagatactgccggccccggcgcacacgcccatcaaggactggggtttaagaacctgccagaggaggagccagaaacatatctaagcctcgggctcccaactgcccacctaataagcgctccgctgaaggggctggggctaggctgggagactactaaggaacatgcgtttttgacgagcgggacgcagttctaggacgcccaggggctggcgctcccgcc

SEQ ID NO: 504336 - DNA, 334 bp, Homo sapiens
  misc_feature (91)..(91): n is a, c, g, or t
atttaccttcactccagataatagcatctctgcatccatatactagtacatattccaacacatctatactcaactactgtacatcaatatntctcctcactgcaacaactctaagcagactatgttattatttcaaattcccatactgacacatataaatgctattatataggatgggggagctaacaacggacattcatgtttagctctaagccctacactgtctcaaaatgtggattgcgactttttacaaagtcttcttttagaatgtttaaacgtataaaaagtaatttctggccgggcacggtggctcacacctgcaatcccagcactt

SEQ ID NO: 504337 - DNA, 246 bp, Homo sapiens
gcttgtgggacaccactgtgatatttagagagcttgcaattacttcaagttttttgaaagacacctgggaaattcatcgcaaaaagatcatcacctaggcacatcgtcgtcaggttatccaaagttaagatgaaggaaagaatcttaagagctgtgagacggaagcaccacgtaacctataaaggaaaacctatcatattaacagcagatttctcagcagaaaccctacatgccagaagggattgg

SEQ ID NO: 504338 - DNA, 2066 bp, Homo sapiens
  misc_feature (1291)..(1291): n is a, c, g, or t
  misc_feature (1359)..(1359): n is a, c, g, or t
  misc_feature (1465)..(1465): n is a, c, g, or t
  misc_feature (2015)..(2015): n is a, c, g, or t
  misc_feature (2066)..(2066): n is a, c, g, or t
ggctcctggtatagagaggaaggcaatcgggaaggcgtgagcccgacagtaaccagagagtcacagcaagttgctctccgtggcagagatcaggaacggcaggcgtggaacgaggagcacgattggtacattgactgaggcatgcaggacacacccgcgtacgatatccgatcgcatggcttgcttgcctgtcttggctgagatgtcatcaagatgtggcggggcgatgtgtataagtgcattgacttttcattagagattgggtgcgttggacaactaaggcacaaactaagggcgtataccatgtaatagttaggtcaaaacagggctaaggactagagcgaaagacgcggaacgaggattcgtagttagtacgcacacagggtggacaagaggtcaccggaatgtcttcgtcaaagtggttgctcgtgagaatgcaagtctagagaagggcaccattttgcttcacaaaacaggtgaggggagaacaggggaatgcctcccaaaagactgtgtgaacctgcgcttaaggggcccttgactattgcgcgtcaacacattgataaatacacccctggacaacctactgacttgagaagcttgagcctgagttggtgacacgcattcagcgctcgtggtcaggggaatgcttaatgggtaccctttgggagaatacccgacaccgttacacaggacccagtccatgtggggacttttccgaagcaccgccggtatggaagaagaggaggggtgtggagtgacgtacagttgggtggtggtcacccagtctgtagacagacattcgggtcaaaatggtcgggttgtatatacgttgcaatacacgggtggcgaaagagggcctccgaagaaacgggttatgcccacggcacatttgcactcttgggtcaagcggtagtggaagcgggtcattgctatacgcattggtgcaaccctgtgccctagggttgtaatgtggtctcccttgttttgtaggacatgtagggacccccgttccaactggggacgtggaccctaacaacgggatgtgccgtgcgtgtccacggtgggatggtcccggaatatgtacgttcccacattggcgatatggaaagttgcaaaaaatatccaatgttgagacaagtgtgcatgtgacagagaccgttggaaaataacttgtatagacattataacaactccaacggacgcgggcccatacggagatatgtggtgggcaccccaagcggagtcacactaacaacccgtggtcaacctctcccctgtgaaatgaggnggaacaccgacaacaatcactgggagtcatgggcgcagcggacaccacagccaaggatataacaatgnttgcggatcgaacacacaatcgagagaggtggtggggctgccccaccaaaataaatgagaggcgaacgtgcgagacaaacacaacccacgcgcaccatagtagganagcaatagacgggaggcccagctatgagatctacacacaagagaagttagcgactggacgaggcgggcacagacaacgtagcagctagcatcgactagcgacacacgactaggggacaccaagagagcaccacggaaagagcaacaccacggggggcgaggaggacacccaacaaacacgggacgcgccgacaaagtagccaacaacaccggaggggatgaacaagcgcacgcaaacggcggaacacgactagacgcctaacaacacggggggaaacgtggtgcagcccacaaccccgagtgacatagacttgcacaagaaaaaagaagtatcgtacacggacggcgagcagtcagacaacactatccagcgcgacacccgtgcgtagacagccaagcacggcacgcgacgctcactagagatgaacggttagacggacgcaagatcacgagtaaagacagcagtcgacgcagcgcagacgcgtacgcacagcccaccagctacgtaccggaaccccagccagaacagacgaacgcacgacacagacaancagcagcagcgaaagagtgaaatgacagcactagtcaatcaactgcaagan

SEQ ID NO: 504339 - DNA, 970 bp, Homo sapiens
  misc_feature (178)..(178): n is a, c, g, or t
gtacgacgatcagtgccggattggcctcaaaaaaatccgcgcgatcgtccctcgggggtccctccccaccaagagacgcacacgacggggtaatctcgggcatgggcctaaaaaacgttgcaagaaactcggcaaaactggggggccacgacaccccccaggccacgtggcccccccngggggcccccgcccccccgcatatccccccgcctcccccctatggggggccccagcgcccaagcaaaaaaacaatcctcggttcggtgacgaaaagggctggcccgctgcgttccaactgcagcaagccgcctatacctcttcaatttgctggcgaccccccccctcggtaaaggggctccctccccggcccccagcggaagaagctgttcggagagtaatccaccaccttgggcgacacacatcggggtcttggaacaaggaaacacaagccaccaacggggagggtggcaaccacaaaaccagagggaccaaaagaggccttcttggcgagcggccacaaaacacgcaacagcgtcgccatcagaagatccccacaaaggcggcgaacaaacagaaatattgcatgcccctcgtagaagcccgcccccccactctcctataacacgggggctggttaggacaggccgcgttctcacagaccttggtattgtctccaaggagcgcactccaactatagagtcaagattgaaattcacaagccaggcgtttccaattagaatagacacacagctcttggctagatccactctctcacaacagaaagccaacagaacagtatcaatgcggcgcaccacgcatcgagcgagttctttgtacagtggcggcggcaccagttttcaaacagataagatgtcttcaaacccagcctctttgtgcgggaccgacagagcccccaaagtttgccacgaattttggagccccgttaaacaaattacaaagaaacaaaaca

SEQ ID NO: 504340 - DNA, 105 bp, Homo sapiens
gagttaagggctaccagaaacgggaggccaccgaagccctgttgcaagtgaggacaaagtgtgggaaggcgtgagggtctgcagtccgggttggccttggattgg

SEQ ID NO: 504341 - DNA, 129 bp, Homo sapiens
ttctgcacatggagccatcatttatttagcacctttgttaaacagaaaggggtctgtcctgcgtgtgcagtctttgcatttaaaattatgcaaattcttcacgcacaaaatggccacatatggctatca

SEQ ID NO: 504342 - DNA, 423 bp, Homo sapiens
  misc_feature (423)..(423): n is a, c, g, or t
tagcttttcagatacaacttaagctgattccccatatgtcaaaatggactgctgatgaatgaatgcttttggtacatattcttgtagtaattacttgtatctttgtgaattttctattaactttaaaaaaattcaaagctattacaaaggaaatatttaaagagcgacgataaaggcaaaagaccctgttttgttttctaaatgtcacagttctatacatctttgcattggatgaactgctatttctttttaatatgcttatgtaattttgttcatgtatgtatgcatatagatttttatatctctcagccttatgtaatttctacgcagttttctgaacaatgacttttaagttacttcttacgtctctatttctaatacgctgatttaccataacagagtatctgccggttttctgtggcn

SEQ ID NO: 504343 - DNA, 355 bp, Homo sapiens
acttgggtgaaacaccccaggtgggtcaccagacaccttatacaggagcatttctactggcatcaggtgggtgcccctcaaggacagagatcccagaggaaggagtggggtcccatctttgctgttctccagcaccctctggtgacatcttcaggtgtgggagggacccagataaatagggcttgaagtgaatccccagcaaaccacagcagccctacagaagaggtacctgactgtcgaaagaaaaacagaaagcaacaacaacatcaaccaaaaagtccccacggaaaacctcatcttaaaggtcagcagccttcaaaggttcaaattgaggacaaattccttggaagatgag

SEQ ID NO: 504344 - DNA, 302 bp, Homo sapiens
ctatgtcaatccgttcacgtgcagttccgtgacacatgttgaactgtgcctcctggtattcgactaggttcataaactttgatgacacggttcctgtgtctcagtaaggcgtgtatggcaaggtcatttccatacagatctgggtccagatgtccatgttccacaaatgtgtgcaagcttgacagtagacccttgccaatagacaccttgcagcctggataagggcatagtgtatgttagtgcccataagtggcttcgatatgatgtggttataaggcccaacaatacattgaacaagctcg

SEQ ID NO: 504345 - DNA, 331 bp, Homo sapiens
  misc_feature (32)..(32): n is a, c, g, or t
  misc_feature (105)..(105): n is a, c, g, or t
gacgtcaaatctaggggaaaaagcaaatactnaatagtaaaatttggccgggcacagtggctcacgcctgtaatcccaacactttgggaggccgaggcgggccgntcacgaggtcaggagatcaaggccatcctggctaacacggtgaaaccctgtctctactaaaaatacaaaaaaatattagctgggcgtaggtggtgcacacctgtagtcccagctactagggaggctgaggcaggagaatggtgtaaaacccaggaggcagagcttgcagtgagccgagatcgcgccacggcactccagcctgggagacagagcaagactccgtctc

SEQ ID NO: 504346 - DNA, 6067 bp, Homo sapiens
gacggggtttcaccatgttggtcaggctggtctcaaactcctgacctcaagccatccgcccgcctcggcctcccaaagggctgggattacaggcgtgagccagcgctcccggccctgacctcattttttttttttctatttttaaaatagggattctagttctgttgcctgggctggagtgccgtggcgccatctcggctcaccgcaatctctgccttccggattcaagctattctcttgcctctgcctccggagggactgggactacaggcgcgcgccaccatgcccggctaatttttgtatttttagtagagacggggtttcaccatgttggccaggctggtctcgaactcctgacctcaggtgatccacctgcctcggccttccgaagtgctgggattacaggcatgagccactgcgcccggccctgacctcattatttctacccaccccctcccccaccactaccaccatcttcatctccagcctcagagatgcaaactcctggaccgcctgcccctttcctcagataaaccaaggtcgtaagttcaggctccgcctccccgcagggcctccccaaggtcacccgcttctttcctcgctcagctccttggtggcgttgtccgcgtgcccctccacagcggggccggcgctctaggctgcagcgggccgttcacacagcctcatcatctcgctggtttccggtgctcggcggctactctagccctcagccgggccctgggactctatcccctaaggccggttctctatggtcgacatcgcccctttgtcccgaatttcctccgggaggacgctctggtgggatccaagcacttcccccgctgcgtctgtggtcgcttttaggtgcaactggagaaggcactgaagccctacgagattcacaccgtcttcggtctcctggggtcggcgccgagtgggaggatggcggaagtaagtatgaaggtgcccttccctcccgccgctgttctctatggtctcttccttcagcgacgggaaagggggtcctgacgcctgcgcggaaccgggctgggcgctcgtcgcgtagtgggtgggggcgcagggagcgggagccgccgccgccgccgccgccgccggagctaacctcggggaccgagatgcaggtgggaccggaaccggaacccccctcttcaagtaccttttccctctccgcgacccggccctggcgcccgagaggattcctgggtgggggtgggcgtggagggccgggggctggagaggcactcggccccggagagtgcagcagacagggctggtcccgaggtggatgcggccccggaaaatgggcggctggggggtgtccagggagtagggtcggatcggagtatatggaccaccgggcccggagggtccgagccgagagcggagcctgcaccctccacctcccgcccttcgggaaatatcagaactgagccaggaggcaggtgcaccgggaaaatgtgtctgagtcctgcttggcagaagagaaactgagtcaccagcttaggagtcgcagggtcagcgggcctgaagggggctgggtctgtctgcggtgcggaggattgggtgggcctgtgtgagccgaggtggccgctggctggagattggtttgcacttcttggctgggttcccccgtgctccatgactcctgcatctcctgattgtttctcgttggtttggagttgtccctgcggttggagccatctgagcttgtagggtcgaggcccaggaggaaggggagggttcaccgacttacagcctggctgtaggtttgaacaggagtctgaggtcgctgagggtttggggaggctttcctgagctgctctggccccagtcctggggctgtcaccttccagtattgcgtggcgggaggagcgctaacaagagccaagggttgtaaattccacacccagctctgccactttctagttgtaagaccttgagagggctcctcctttctctaatttctattttagaaaattggaacaataatattcttctcccacatgaagatagtaacaatggcagtcgttcagcggatgcttactttgcgttcagcgctgacataccccattccatgtaattctctcaacatttcgaggggagggatcattagctttgtttaacagatagaaaaacggaggctcagagaggacgtggaatttgttcaagataacatcgctcataaggtggctggactgggtgctcataaggtggtttgagccctggtctgactcaagtccatggccttaaccagaaggctaacctgcctttagggcatactccccagtgggagaagaggaaggtgaaaaatcctagggccccagctctccctgtgatgttttgtttacgtgaggccagcaaagacttgacctgagccaacccagtttctcctctggggcccctgcggcctctggccccagactgaagggataccaaagaagtgggctgtagctatttcacatctccttcacgcagtgcgtgggtgctggactctggggtcagctttcaagacaattactgttttggtccatcatgcatccatcctcattaatgaatcggccccctccaaagagttggaccctaagatgcgtgaggcaggctctctaaggtctagaatcccagctcctctctagccccctgcgagctggggcggtgaggtgctatggctgaggctggcccagccgggccctggggacagggactatgaagtggggaaaacagtagacttggagttctgaaacttttctgagcttcggtttcctcatctgttcgagaggtctttgaaacctctcagggaaaggtaagataaccaagtgggagcctctagaatggctcatgggaagtgtgacatgaatattggaggatccgatgtagagggggggtgatctggaaaagttcccttttttagggggaaggtgctccaaagccctctactgctggatccaaagctaaggaaagtgggggcaaatgtggcaggctcggggcaggttagacgctggggagccagttggctggggcctgcagggtgccaggatctgggagagggaagggaggtgttgggctcccttccccattgctctctgcggagtctgaagtagggtcggacgtctctggctgggggtgggatgcagcctccggtgcgccctcagcagtgaccctcgtgtgtgcctctctcttcctttcctgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgccttctcccgccgttttgctgagctcttcctgcagcactttgaagccgaggtggcccgggcctctggctccctgtcgccacccatcctggctcccctgagccctggtgcggagatttcgccacatgacctgtcccttgagagctgcagggtgggtgggcccctggctgtgctgggcccttctcgatcatctgaggacctggccggccccctcccttcctcagtctcttcctcctctacaacctcctccaagccgaagctcaagaagcgcttttccctgcgttcagtgggtcgctctgtccgaggctcagtccgtggcatcctgcagtggcgggggaccgttgaccctccctcctccgctgggcccctggagacctcgtcaggccccccagtcttaggtggaaacagcaactccaactcctctggcggggctgggaccgttggtaggggactggtcagtgatggaacgtcccctggggaaagatggactcaccgttttgagaggctgagactcagtcggggagggggcgccttgaaggatggagcagggatggtgcagagggaagagctgctgagtttcatgggggctgaggaggcagcccctgacccagccggagtgggccggggaggaggggtggctgggcctccttcagggggaggagggcagcctcagtggcagaagtgtcgcctgctgcttcgaagtgaaggagaaggaggaggaggaagtcgcctggagttctttgtaccacccaaggcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccagcagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggccgggagcaggctgggagccatgcgggggtgtgcgagggagatggatgccaccccgatgcctcctgcaccctcatgcccttcggagcgagtgactgtgtaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcggttcaaaaaaaaaagtggaccaaaacag

SEQ ID NO: 504347 - DNA, 594 bp, Homo sapiens
ttcaatcgtacggtgtctgtgacacatgatctgagacctgatgtgtgcggtattttgtgtgaggtagtgcttggtgtgccctgctaattgtgtgtcagtggtgtggtcgactcacttatggggtgatgtggtatggtcatgaggtctggcccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcggttcaaaaaaaaaagtggaccaaaacag

SEQ ID NO: 504348 - DNA, 549 bp, Homo sapiens
ctgggagtttcaaaacacaccccgtggtctcacaccgaggcgaagaacccccgttccacagagtgtcccgggggggaacacccactccccactcccgcacacaccagggggtcccccccccgcgaggggagcgttctcccccccacacgcgcacacaagcgggagggcgccacccgcgggggaacgcccgtaagagcggcacaccacggcgttggggagaaacatttccccccccctgcggccgtgatggaaccaccggcgcacatatcagggcgtgctcgcaacaacgcgcgattgtgaggcgtgcccttccgggaccattgagagcccctcggtaggcgcccgccagaatgagcgcacaccaatgaccccaaggggccccttcaacccctagatccccctagaaagaaaggcggcatgggggccggggccaaggccccccgccgaagttttccccgcggggccccacaaaaacgccgcgtgtatgcacacacccttgggggcacagcgcctcccacacacacacacaaaaacagagagaaaaacaaa

SEQ ID NO: 504349 - DNA, 358 bp, Homo sapiens
ccctgaaagaaggctggcagaacgcaagtgccttttttccctgtgggaagaaagatcaagtgacatattattttttcctggttgtcccttaatgggctgagtaaaaagcttgaaaactcagactttcggttttggttttgcccctcattggttatgaggaggcccaaagcaggtaagttccccttcctggccttactttcctgatgtgtaatacggaattacttcccagtagcatgccagtataagccccccccagtagatacaactatgatgcccttccatgagttggtatttttagttctaactgctaaatttgttctctttacgggccagatttttaataaagtgcttggtttta

SEQ ID NO: 504350 - DNA, 3992 bp, Homo sapiens
gacggggtttcaccatgttggtcaggctggtctcaaactcctgacctcaagccatccgcccgcctcggcctcccaaagggctgggattacaggcgtgagccagcgctcccggccctgacctcattttttttttttctatttttaaaatagggattctagttctgttgcctgggctggagtgccgtggcgccatctcggctcaccgcaatctctgccttccggattcaagctattctcttgcctctgcctccggagggactgggactacaggcgcgcgccaccatgcccggctaatttttgtatttttagtagagacggggtttcaccatgttggccaggctggtctcgaactcctgacctcaggtgatccacctgcctcggccttccgaagtgctgggattacaggcatgagccactgcgcccggccctgacctcattatttctacccaccccctcccccaccactaccaccatcttcatctccagcctcagagatgcaaactcctggaccgcctgcccctttcctcagataaaccaaggtcgtaagttcaggctccgcctccccgcagggcctccccaaggtcacccgcttctttcctcgctcagctccttggtggcgttgtccgcgtgcccctccacagcggggccggcgctctaggctgcagcgggccgttcacacagcctcatcatctcgctggtttccggtgctcggcggctactctagccctcagccgggccctgggactctatcccctaaggccggttctctatggtcgacatcgcccctttgtcccgaatttcctccgggaggacgctctggtgggatccaagcacttcccccgctgcgtctgtggtcgcttttaggtgcaactggagaaggcactgaagccctacgagattcacaccgtcttcggtctcctggggtcggcgccgagtgggaggatggcggaagtaagtatgaaggtgcccttccctcccgccgctgttctctatggtctcttccttcagcgacgggaaagggggtcctgacgcctgcgcggaaccgggctgggcgctcgtcgcgtagtgggtgggggcgcagggagcgggagccgccgccgccgccggagctaacctcggggaccgagatctgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgccttctcccgccgttttgctgagctcttcctgcagcactttgaagccgaggtggcccgggcctctggctccctgtcgccacccatcctggctcccctgagccctggtgcggagatttcgccacatgacctgtcccttgagagctgcagggtgggtgggcccctggctgtgctgggcccttctcgatcatctgaggacctggccggccccctcccttcctcagtctcttcctcctctacaacctcctccaagccgaagctcaagaagcgcttttccctgcgttcagtgggtcgctctgtccgaggctcagtccgtggcatcctgcagtggcgggggaccgttgaccctccctcctccgctgggcccctggagacctcgtcaggccccccagtcttaggtggaaacagcaactccaactcctctggcggggctgggaccgttggtaggggactggtcagtgatggaacgtcccctggggaaagatggactcaccgttttgagaggctgagactcagtcggggagggggcgccttgaaggatggagcagggatggtgcagagggaagagctgctgagtttcatgggggctgaggaggcagcccctgacccagccggagtgggccggggaggaggggtggctgggcctccttcagggggaggagggcagcctcagtggcagaagtgtcgcctgctgcttcgaagtgaaggagaaggaggaggaggaagtcgcctggagttctttgtaccacccaaggcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccagcagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggccgggagcaggctgggagccatgcgggggtgtgcgagggagatggatgccaccccgatgcctcctgcaccctcatgcccttcggagcgagtgactgtgtaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcggttcaaaaaaaaaagtggaccaaaacag

SEQ ID NO: 504351 - DNA, 834 bp, Homo sapiens
gaaatgatgaatgagttgttgaaaacaaaatggtcaaacccacgggaatctcagatgccctttctcattcttgggctgcatcgagctagacaaatcatgtagcccaagaattccacctcgggctccaggtgctgcaagttctaagggaggctgtcggggaactgaggaccagaccagaagtctcgtgtaggacgtctgatctcctctggcaggaaggccattggtgggagtgtttccactaacaaccaagagagatgaagagttgagagcttgaactgaggctcggggtgggatagagggggcatgacaaaagtctgagtaccaggtgggtcatctattcaaccttccacaaatattgactgaggcactggaatatagatcatgaacacagcacagactgttgctcatgggacatatgttctaacgcatgagcaacacgcatgtttcttcgtatattctaatcaggttaagtgaccaagaaaatggaataataagaaggaccaggcacggtcggcagtagggctctgtgcatgtcaatcaccttagtcagcgttgtggtgatgggccagagtacagtgtgggatgagctccaggtgcatggaagatctgagaaccaagccacagactcatacatagctgttatactctgttgttacttttgatacaaaaaattagctcgatgtggtggcacatgcctgtaaccccagctactcagggaggctgaggcaggagatcatttgatcctggaaatggacatgcagtgaacctagtcgtaccattaaactcgagcatggcacagcagctttcgctttctgttgtgttctttccgcctct

SEQ ID NO: 504352 - DNA, 787 bp, Homo sapiens
attcggcacgaggccagcttgattatattttacataaatcagtaataagcagccatcattattgttaagggtgtcagaatatgaaatggaggacctgcgttcaagttgtaattttttcattaactagatgcgtgatttggaaaagttgcttacattatctgaaatgtaatttccttatctgtaaagtgaatatgaccagaaagactgcgaggagagaatgagataatactaaggctttgaaggtataggtatcatatattaataataaggtgctaaaaacataatttaagactaaaggaaaatgtacatacaggtcccttaaccacagccatgttgtattaatattctctgctactaattagacattgcacccttcaaaggaatggtttaattctcgctgttcaatcacattaagttgtgccatgattcttgctttagaccccagggcctcaagaattttgaacttgtacttggtatttattcgaggtaagcccacttataattgttgggaatctaattcgtcaatggaaaattaaaaaggttggccttgattaattggtggcactttgttaaaccgactgggacctttttacattatagcttcttggccctttgggaattgtcccgtgaattaacttaaaagtttaaaaaatttaaatcccataggtctttggcctattttaaacagagggcaccctattatgggtccacgtaggccctttactatcctccattcctttggctaaattggttttgttgtttccgtcctgtaggttctttttgcttt

SEQ ID NO: 504353 - DNA, 3814 bp, Homo sapiens
gacggggtttcaccatgttggtcaggctggtctcaaactcctgacctcaagccatccgcccgcctcggcctcccaaagggctgggattacaggcgtgagccagcgctcccggccctgacctcattttttttttttctatttttaaaatagggattctagttctgttgcctgggctggagtgccgtggcgccatctcggctcaccgcaatctctgccttccggattcaagctattctcttgcctctgcctccggagggactgggactacaggcgcgcgccaccatgcccggctaatttttgtatttttagtagagacggggtttcaccatgttggccaggctggtctcgaactcctgacctcaggtgatccacctgcctcggccttccgaagtgctgggattacaggcatgagccactgcgcccggccctgacctcattatttctacccaccccctcccccaccactaccaccatcttcatctccagcctcagagatgcaaactcctggaccgcctgcccctttcctcagataaaccaaggtcgtaagttcaggctccgcctccccgcagggcctccccaaggtcacccgcttctttcctcgctcagctccttggtggcgttgtccgcgtgcccctccacagcggggccggcgctctaggctgcagcgggccgttcacacagcctcatcatctcgctggtttccggtgctcggcggctactctagccctcagccgggccctgggactctatcccctaaggccggttctctatggtcgacatcgcccctttgtcccgaatttcctccgggaggacgctctggtgggatccaagcacttcccccgctgcgtctgtggtcgcttttaggtgcaactggagaaggcactgaagccctacgagattcacaccgtcttcggtctcctggggtcggcgccgagtgggaggatggcggaactgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgccttctcccgccgttttgctgagctcttcctgcagcactttgaagccgaggtggcccgggcctctggctccctgtcgccacccatcctggctcccctgagccctggtgcggagatttcgccacatgacctgtcccttgagagctgcagggtgggtgggcccctggctgtgctgggcccttctcgatcatctgaggacctggccggccccctcccttcctcagtctcttcctcctctacaacctcctccaagccgaagctcaagaagcgcttttccctgcgttcagtgggtcgctctgtccgaggctcagtccgtggcatcctgcagtggcgggggaccgttgaccctccctcctccgctgggcccctggagacctcgtcaggccccccagtcttaggtggaaacagcaactccaactcctctggcggggctgggaccgttggtaggggactggtcagtgatggaacgtcccctggggaaagatggactcaccgttttgagaggctgagactcagtcggggagggggcgccttgaaggatggagcagggatggtgcagagggaagagctgctgagtttcatgggggctgaggaggcagcccctgacccagccggagtgggccggggaggaggggtggctgggcctccttcagggggaggagggcagcctcagtggcagaagtgtcgcctgctgcttcgaagtgaaggagaaggaggaggaggaagtcgcctggagttctttgtaccacccaaggcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccagcagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggccgggagcaggctgggagccatgcgggggtgtgcgagggagatggatgccaccccgatgcctcctgcaccctcatgcccttcggagcgagtgactgtgtaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcggttcaaaaaaaaaagtggaccaaaacag

SEQ ID NO: 504354 - DNA, 921 bp, Homo sapiens
  misc_feature (164)..(164): n is a, c, g, or t
  misc_feature (327)..(327): n is a, c, g, or t
  misc_feature (692)..(692): n is a, c, g, or t
gagatggggtttcgccatgttggccaggctagtgtcaaactcctggcctcaagtcatctgcccgccttggcctccccaaagtgctgggattacaggcatgagccactgcctggctgccttcagacttttctaaaggaagaaaacctcatgttaataaaaatgtnttaatcattacttttgtcattaatgatctcgatatagttaacatcttaagcactatgaaatatggtaattaaaatggcaatatattgaaatgtgaaaacagttttagcacagcacttattgactatgaaatacttactgcagttgcctgtagattattggggnagacattaaggagctcctgaggagggtttaaaggtttgagataacgtgtgataaaaacagtttttccgcttatatcaattactgttgtaaggcactgacgatttggaaactttaaggcacattcagcttgaaacttctcagttgcttgaagtaatttctcatcttcctgagactcaaacttcaaaaagaaagacttcatggagtttatgtatgattacaagagagaaagtacgtgttcagattccacagtcaacatgcaggaaatgtatggtttgggaatatgactgactccttacaaagctgtcatgtcctggtgtccctgcagctttatttaaattaaatttgtagtttgaaaattagaccgnctcattaaatacttaaaatatatttgacaggattgaaataaagtagcaggtaagcagccatatggaaactactacattaataatctatgaaattaaactgtgatgtactaattctgattgatgaggctagaattaggcagtagagttttgtgtgtattttgatggtggttttaagtgtgcaggctggggggcggccccagaaaatctaacatctcatatgtaaatctta

SEQ ID NO: 504355 - DNA, 5684 bp, Homo sapiens
gacggggtttcaccatgttggtcaggctggtctcaaactcctgacctcaagccatccgcccgcctcggcctcccaaagggctgggattacaggcgtgagccagcgctcccggccctgacctcattttttttttttctatttttaaaatagggattctagttctgttgcctgggctggagtgccgtggcgccatctcggctcaccgcaatctctgccttccggattcaagctattctcttgcctctgcctccggagggactgggactacaggcgcgcgccaccatgcccggctaatttttgtatttttagtagagacggggtttcaccatgttggccaggctggtctcgaactcctgacctcaggtgatccacctgcctcggccttccgaagtgctgggattacaggcatgagccactgcgcccggccctgacctcattatttctacccaccccctcccccaccactaccaccatcttcatctccagcctcagagatgcaaactcctggaccgcctgcccctttcctcagataaaccaaggtcgtaagttcaggctccgcctccccgcagggcctccccaaggtcacccgcttctttcctcgctcagctccttggtggcgttgtccgcgtgcccctccacagcggggccggcgctctaggctgcagcgggccgttcacacagcctcatcatctcgctggtttccggtgctcggcggctactctagccctcagccgggccctgggactctatcccctaaggccggttctctatggtcgacatcgcccctttgtcccgaatttcctccgggaggacgctctggtgggatccaagcacttcccccgctgcgtctgtggtcgcttttaggtgcaactggagaaggcactgaagccctacgagattcacaccgtcttcggtctcctggggtcggcgccgagtgggaggatggcggaagtaagtatgaaggtgcccttccctcccgccgctgttctctatggtctcttccttcagcgacgggaaagggggtcctgacgcctgcgcggaaccgggctgggcgctcgtcgcgtagtgggtgggggcgcagggagcgggagccgccgccgccgccgccgccgccggagctaacctcggggaccgagatgcaggtgggaccggaaccggaacccccctcttcaagtaccttttccctctccgcgacccggccctggcgcccgagaggattcctgggtgggggtgggcgtggagggccgggggctggagaggcactcggccccggagagtgcagcagacagggctggtcccgaggtggatgcggccccggaaaatgggcggctggggggtgtccagggagtagggtcggatcggagtatatggaccaccgggcccggagggtccgagccgagagcggagcctgcaccctccacctcccgcccttcgggaaatatcagaactgagccaggaggcaggtgcaccgggaaaatgtgtctgagtcctgcttggcagaagagaaactgagtcaccagcttaggagtcgcagggtcagcgggcctgaagggggctgggtctgtctgcggtgcggaggattgggtgggcctgtgtgagccgaggtggccgctggctggagattggtttgcacttcttggctgggttcccccgtgctccatgactcctgcatctcctgattgtttctcgttggtttggagttgtccctgcggttggagccatctgagcttgtagggtcgaggcccaggaggaaggggagggttcaccgacttacagcctggctgtaggtttgaacaggagtctgaggtcgctgagggtttggggaggctttcctgagctgctctggccccagtcctggggctgtcaccttccagtattgcgtggcgggaggagcgctaacaagagccaagggttgtaaattccacacccagctctgccactttctagttgtaagaccttgagagggctcctcctttctctaatttctattttagaaaattggaacaataatattcttctcccacatgaagatagtaacaatggcagtcgttcagcggatgcttactttgcgttcagcgctgacataccccattccatgtaattctctcaacatttcgaggggagggatcattagctttgtttaacagatagaaaaacggaggctcagagaggacgtggaatttgttcaagataacatcgctcataaggtggctggactgggtgctcataaggtggtttgagccctggtctgactcaagtccatggccttaaccagaaggctaacctgcctttagggcatactccccagtgggagaagaggaaggtgaaaaatcctagggccccagctctccctgtgatgttttgtttacgtgaggccagcaaagacttgacctgagccaacccagtttctcctctggggcccctgcggcctctggccccagactgaagggataccaaagaagtgggctgtagctatttcacatctccttcacgcagtgcgtgggtgctggactctggggtcagctttcaagacaattactgttttggtccatcatgcatccatcctcattaatgaatcggccccctccaaagagttggaccctaagatgcgtgaggcaggctctctaaggtctagaatcccagctcctctctagccccctgcgagctggggcggtgaggtgctatggctgaggctggcccagccgggccctggggacagggactatgaagtggggaaaacagtagacttggagttctgaaacttttctgagcttcggtttcctcatctgttcgagaggtctttgaaacctctcagggaaagctgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgccttctcccgccgttttgctgagctcttcctgcagcactttgaagccgaggtggcccgggcctctggctccctgtcgccacccatcctggctcccctgagccctggtgcggagatttcgccacatgacctgtcccttgagagctgcagggtgggtgggcccctggctgtgctgggcccttctcgatcatctgaggacctggccggccccctcccttcctcagtctcttcctcctctacaacctcctccaagccgaagctcaagaagcgcttttccctgcgttcagtgggtcgctctgtccgaggctcagtccgtggcatcctgcagtggcgggggaccgttgaccctccctcctccgctgggcccctggagacctcgtcaggccccccagtcttaggtggaaacagcaactccaactcctctggcggggctgggaccgttggtaggggactggtcagtgatggaacgtcccctggggaaagatggactcaccgttttgagaggctgagactcagtcggggagggggcgccttgaaggatggagcagggatggtgcagagggaagagctgctgagtttcatgggggctgaggaggcagcccctgacccagccggagtgggccggggaggaggggtggctgggcctccttcagggggaggagggcagcctcagtggcagaagtgtcgcctgctgcttcgaagtgaaggagaaggaggaggaggaagtcgcctggagttctttgtaccacccaaggcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccagcagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggccgggagcaggctgggagccatgcgggggtgtgcgagggagatggatgccaccccgatgcctcctgcaccctcatgcccttcggagcgagtgactgtgtaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcggttcaaaaaaaaaagtggaccaaaacag

SEQ ID NO: 504356 - DNA, 255 bp, Homo sapiens
ccgggaaggtcgaggctgcagtcagcggtgatagcactactacactccagccttggacaacagagggagaccctgaataacatgtggcccagtcagtctctcttccgggattcagaagtctttcagggtagatccagctccagctctgtggccctggggttggagactgctgctcaagtgcattggaaaggatccatcccacgccattcttcagagtcatcttcactgctgcagtggtcacttgtagcaccccaa

SEQ ID NO: 504357 - DNA, 4045 bp, Homo sapiens
gacggggtttcaccatgttggtcaggctggtctcaaactcctgacctcaagccatccgcccgcctcggcctcccaaagggctgggattacaggcgtgagccagcgctcccggccctgacctcattttttttttttctatttttaaaatagggattctagttctgttgcctgggctggagtgccgtggcgccatctcggctcaccgcaatctctgccttccggattcaagctattctcttgcctctgcctccggagggactgggactacaggcgcgcgccaccatgcccggctaatttttgtatttttagtagagacggggtttcaccatgttggccaggctggtctcgaactcctgacctcaggtgatccacctgcctcggccttccgaagtgctgggattacaggcatgagccactgcgcccggccctgacctcattatttctacccaccccctcccccaccactaccaccatcttcatctccagcctcagagatgcaaactcctggaccgcctgcccctttcctcagataaaccaaggtcgtaagttcaggctccgcctccccgcagggcctccccaaggtcacccgcttctttcctcgctcagctccttggtggcgttgtccgcgtgcccctccacagcggggccggcgctctaggctgcagcgggccgttcacacagcctcatcatctcgctggtttccggtgctcggcggctactctagccctcagccgggccctgggactctatcccctaaggccggttctctatggtcgacatcgcccctttgtcccgaatttcctccgggaggacgctctggtgggatccaagcacttcccccgctgcgtctgtggtcgcttttaggtgcaactggagaaggcactgaagccctacgagattcacaccgtcttcggtctcctggggtcggcgccgagtgggaggatggcggaagtaagtatgaaggtgcccttccctcccgccgctgttctctatggtctcttccttcagcgacgggaaagggggtcctgacgcctgcgcggaaccgggctgggcgctcgtcgcgtagtgggtgggggcgcagggagcgggagccgccgccgccgccggagctaacctcggggaccgagatctgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgccttctcccgccgttttgctgagctcttcctgcagcactttgaagccgaggtggcccgggcctctggctccctgtcgccacccatcctggctcccctgagccctggtgcggagatttcgccacatgacctgtcccttgagagctgcagggtgggtgggcccctggctgtgctgggcccttctcgatcatctgaggacctggccggccccctcccttcctcagtctcttcctcctctacaacctcctccaagccgaagctcaagaagcgcttttccctgcgttcagtgggtcgctctgtccgaggctcagtccgtggcatcctgcagtggcgggggaccgttgaccctccctcctccgctgggcccctggagacctcgtcaggccccccagtcttaggtggaaacagcaactccaactcctctggcggggctgggaccgttggtaggggactggtcagtgatggaacgtcccctggggaaagatggactcaccgttttgagaggctgagactcagtcggggagggggcgccttgaaggatggagcagggatggtgcagagggaagagctgctgagtttcatgggggctgaggaggcagcccctgacccagccggagtgggccggggaggaggggtggctgggcctccttcagggggaggagggcagcctcagtggcagaagtgtcgcctgctgcttcgaagtgaaggagaaggaggaggaggaagtcgcctggagttctttgtaccacccaaggcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccagcagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggtgagcagagcaggtctgcaggggaggaggtgcccgtgcacccaagaagtgaggccgggagcaggctgggagccatgcgggggtgtgcgagggagatggatgccaccccgatgcctcctgcaccctcatgcccttcggagcgagtgactgtgtaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcggttcaaaaaaaaaagtggaccaaaacag

SEQ ID NO: 504358 - DNA, 3906 bp, Homo sapiens
gacggggtttcaccatgttggtcaggctggtctcaaactcctgacctcaagccatccgcccgcctcggcctcccaaagggctgggattacaggcgtgagccagcgctcccggccctgacctcattttttttttttctatttttaaaatagggattctagttctgttgcctgggctggagtgccgtggcgccatctcggctcaccgcaatctctgccttccggattcaagctattctcttgcctctgcctccggagggactgggactacaggcgcgcgccaccatgcccggctaatttttgtatttttagtagagacggggtttcaccatgttggccaggctggtctcgaactcctgacctcaggtgatccacctgcctcggccttccgaagtgctgggattacaggcatgagccactgcgcccggccctgacctcattatttctacccaccccctcccccaccactaccaccatcttcatctccagcctcagagatgcaaactcctggaccgcctgcccctttcctcagataaaccaaggtcgtaagttcaggctccgcctccccgcagggcctccccaaggtcacccgcttctttcctcgctcagctccttggtggcgttgtccgcgtgcccctccacagcggggccggcgctctaggctgcagcgggccgttcacacagcctcatcatctcgctggtttccggtgctcggcggctactctagccctcagccgggccctgggactctatcccctaaggccggttctctatggtcgacatcgcccctttgtcccgaatttcctccgggaggacgctctggtgggatccaagcacttcccccgctgcgtctgtggtcgcttttaggtgcaactggagaaggcactgaagccctacgagattcacaccgtcttcggtctcctggggtcggcgccgagtgggaggatggcggaagtaagtatgaaggtgcccttccctcccgccgctgttctctatggtctcttccttcagcgacgggaaagggggtcctgacgcctgcgcggaaccgggctgggcgctcgtcgcgtagtgggtgggggcgcagggagcgggagccgccgccgccgccgccgccgccggagctaacctcggggaccgagatgcagctgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgccttctcccgccgttttgctgagctcttcctgcagcactttgaagccgaggtggcccgggcctctggctccctgtcgccacccatcctggctcccctgagccctggtgcggagatttcgccacatgacctgtcccttgagagctgcagggtgggtgggcccctggctgtgctgggcccttctcgatcatctgaggacctggccggccccctcccttcctcagtctcttcctcctctacaacctcctccaagccgaagctcaagaagcgcttttccctgcgttcagtgggtcgctctgtccgaggctcagtccgtggcatcctgcagtggcgggggaccgttgaccctccctcctccgctgggcccctggagacctcgtcaggccccccagtcttaggtggaaacagcaactccaactcctctggcggggctgggaccgttggtaggggactggtcagtgatggaacgtcccctggggaaagatggactcaccgttttgagaggctgagactcagtcggggagggggcgccttgaaggatggagcagggatggtgcagagggaagagctgctgagtttcatgggggctgaggaggcagcccctgacccagccggagtgggccggggaggaggggtggctgggcctccttcagggggaggagggcagcctcagtggcagaagtgtcgcctgctgcttcgaagtgaaggagaaggaggaggaggaagtcgcctggagttctttgtaccacccaaggcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccagcagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcggttcaaaaaaaaaagtggaccaaaacag

SEQ ID NO: 504359 - DNA, 151 bp, Homo sapiens
  misc_feature (1)..(1): n is a, c, g, or t
ncaacacaacacactcactactaacgctactactcactacaactaccaacgacgtttgcacacaccactaccaacgacgacactactacactgtaccaccaccaacacttactactactactcgacacgtaccacctcgtacactcttact

SEQ ID NO: 504360 - DNA, 3924 bp, Homo sapiens
gacggggtttcaccatgttggtcaggctggtctcaaactcctgacctcaagccatccgcccgcctcggcctcccaaagggctgggattacaggcgtgagccagcgctcccggccctgacctcattttttttttttctatttttaaaatagggattctagttctgttgcctgggctggagtgccgtggcgccatctcggctcaccgcaatctctgccttccggattcaagctattctcttgcctctgcctccggagggactgggactacaggcgcgcgccaccatgcccggctaatttttgtatttttagtagagacggggtttcaccatgttggccaggctggtctcgaactcctgacctcaggtgatccacctgcctcggccttccgaagtgctgggattacaggcatgagccactgcgcccggccctgacctcattatttctacccaccccctcccccaccactaccaccatcttcatctccagcctcagagatgcaaactcctggaccgcctgcccctttcctcagataaaccaaggtcgtaagttcaggctccgcctccccgcagggcctccccaaggtcacccgcttctttcctcgctcagctccttggtggcgttgtccgcgtgcccctccacagcggggccggcgctctaggctgcagcgggccgttcacacagcctcatcatctcgctggtttccggtgctcggcggctactctagccctcagccgggccctgggactctatcccctaaggccggttctctatggtcgacatcgcccctttgtcccgaatttcctccgggaggacgctctggtgggatccaagcacttcccccgctgcgtctgtggtcgcttttaggtgcaactggagaaggcactgaagccctacgagattcacaccgtcttcggtctcctggggtcggcgccgagtgggaggatggcggaactgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgccttctcccgccgttttgctgagctcttcctgcagcactttgaagccgaggtggcccgggcctctggctccctgtcgccacccatcctggctcccctgagccctggtgcggagatttcgccacatgacctgtcccttgagagctgcagggtgggtgggcccctggctgtgctgggcccttctcgatcatctgaggacctggccggccccctcccttcctcagtctcttcctcctctacaacctcctccaagccgaagctcaagaagcgcttttccctgcgttcagtgggtcgctctgtccgaggctcagtccgtggcatcctgcagtggcgggggaccgttgaccctccctcctccgctgggcccctggagacctcgtcaggccccccagtcttaggtggaaacagcaactccaactcctctggcggggctgggaccgttggtaggggactggtcagtgatggaacgtcccctggggaaagatggactcaccgttttgagaggctgagactcagtcggggagggggcgccttgaaggatggagcagggatggtgcagagggaagagctgctgagtttcatgggggctgaggaggcagcccctgacccagccggagtgggccggggaggaggggtggctgggcctccttcagggggaggagggcagcctcagtggcagaagtgtcgcctgctgcttcgaagtgaaggagaaggaggaggaggaagtcgcctggagttctttgtaccacccaaggcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccagggtgagaagcctgacttctgtcgctaagggacatagagtggggttggggagcagccttgcgcctctcacctggtgactttcctcccagcaccatcttccctgtctctgcagaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccagcagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggccgggagcaggctgggagccatgcgggggtgtgcgagggagatggatgccaccccgatgcctcctgcaccctcatgcccttcggagcgagtgactgtgtaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcggttcaaaaaaaaaagtggaccaaaacag

SEQ ID NO: 504361 - DNA, 163 bp, Homo sapiens
ttctcgaggatctccgcaacaacttcgtccatacgcacctgtgtcaacaaggggtatgggcgctcggagtgtgcagcaacaacttcgtccatcatgatctgcaacaacttcgtccattccgatttgacttcaagaagtgtctggtccctcggcgtgtgcagga

SEQ ID NO: 504362 - DNA, 1672 bp, Homo sapiens
gcatgaccctccctctggcccctggggcggggactggtagcagggcaggccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccagcagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggccgggagcaggctgggagccatgcgggggtgtgcgagggagatggatgccaccccgatgcctcctgcaccctcatgcccttcggagcgagtgactgtgtaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcggttcaaaaaaaaaagtggaccaaaacag

SEQ ID NO: 504363 - DNA, 225 bp, Homo sapiens
aggtgtgacgtcgtcaatggtcagtttgtggacccgcccacggttggacacctttatgcggctgctcgggcaccagcctccttcccacttcttcatgccacacacacccgaaccacatctcaatctgagagcctcacaatttgagacaccgacctggtccagttgacggcccaccaatcaggctctgcgaatgctctggttacacctccagtcttacgttttcct

SEQ ID NO: 504364 - DNA, 3768 bp, Homo sapiens
gacggggtttcaccatgttggtcaggctggtctcaaactcctgacctcaagccatccgcccgcctcggcctcccaaagggctgggattacaggcgtgagccagcgctcccggccctgacctcattttttttttttctatttttaaaatagggattctagttctgttgcctgggctggagtgccgtggcgccatctcggctcaccgcaatctctgccttccggattcaagctattctcttgcctctgcctccggagggactgggactacaggcgcgcgccaccatgcccggctaatttttgtatttttagtagagacggggtttcaccatgttggccaggctggtctcgaactcctgacctcaggtgatccacctgcctcggccttccgaagtgctgggattacaggcatgagccactgcgcccggccctgacctcattatttctacccaccccctcccccaccactaccaccatcttcatctccagcctcagagatgcaaactcctggaccgcctgcccctttcctcagataaaccaaggtcgtaagttcaggctccgcctccccgcagggcctccccaaggtcacccgcttctttcctcgctcagctccttggtggcgttgtccgcgtgcccctccacagcggggccggcgctctaggctgcagcgggccgttcacacagcctcatcatctcgctggtttccggtgctcggcggctactctagccctcagccgggccctgggactctatcccctaaggccggttctctatggtcgacatcgcccctttgtcccgaatttcctccgggaggacgctctggtgggatccaagcacttcccccgctgcgtctgtggtcgcttttaggtgcaactggagaaggcactgaagccctacgagattcacaccgtcttcggtctcctggggtcggcgccgagtgggaggatggcggaactgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgccttctcccgccgttttgctgagctcttcctgcagcactttgaagccgaggtggcccgggcctctggctccctgtcgccacccatcctggctcccctgagccctggtgcggagatttcgccacatgacctgtcccttgagagctgcagggtgggtgggcccctggctgtgctgggcccttctcgatcatctgaggacctggccggccccctcccttcctcagtctcttcctcctctacaacctcctccaagccgaagctcaagaagcgcttttccctgcgttcagtgggtcgctctgtccgaggctcagtccgtggcatcctgcagtggcgggggaccgttgaccctccctcctccgctgggcccctggagacctcgtcaggccccccagtcttaggtggaaacagcaactccaactcctctggcggggctgggaccgttggtaggggactggtcagtgatggaacgtcccctggggaaagatggactcaccgttttgagaggctgagactcagtcggggagggggcgccttgaaggatggagcagggatggtgcagagggaagagctgctgagtttcatgggggctgaggaggcagcccctgacccagccggagtgggccggggaggaggggtggctgggcctccttcagggggaggagggcagcctcagtggcagaagtgtcgcctgctgcttcgaagtgaaggagaaggaggaggaggaagtcgcctggagttctttgtaccacccaaggcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccagcagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggtgagcagagcaggtctgcaggggaggaggtgcccgtgcacccaagaagtgaggaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcggttcaaaaaaaaaagtggaccaaaacag

SEQ ID NO: 504365 - DNA, 248 bp, Homo sapiens
tgggtttccaaaactgcacaaaacattttatttttttgggaaaccccatggccccctttttttgaaaaatggggcatgggggaacccaaaattattttgggggggaaaatttattcatccttttccaccttgatttcaaagaatgagttcaagtcaggacaacaggttttggggggtggggcaaaaaaaggggagccaggggcattttaatcccccccctaattttcctttttttggaaattaggatt

SEQ ID NO: 504366 - DNA, 550 bp, Homo sapiens
gcttctggtaaggtggtaatagaagctcagactatttttatgtggatttcagttttcatcatcagaagtcctagacagtgacatttcattaatgggtgggagtccagctcatggcattgctgatgtatacagaacgagttgcgagtgaggttatgttgtgcatttcagtttttgtactgtaaattatgagactaaacaatttttacatagtaaatactgtgtatttaccaaagtatttgaaatgcagttgatgtaagttaattaactcagaatactgtgtaacgtatctctaaaacgactagaaaaaagaaatgtgtagtatctcagattacgaccaatctgtgctagatatgaatctttgatagaaatagaaataatctacatgggccttggtgaaatctggggaagagctttaggattctagtagatggatactgaatactcgaggcccacttagattattaatgtatacattgtgtttttgtctttatgctatgtacagagaaatgtgataattgtctataataaatatttgtatgatgagaagaaa

SEQ ID NO: 504367 - DNA, 180 bp, Homo sapiens
ggctagcaccatagcttcaataccctgtttccaaaaataaaaaaaaataaaaaattagccaggtgtggtggtgtgcaccagtaatcccagcttctcagaggaggccaaagcaggaggatcacttgagcccaggagttggtggccaaagtgtgctacaatcacaccactggattccagcct

SEQ ID NO: 504368 - DNA, 414 bp, Homo sapiens
ccattttacctgtcctaaaaccagacaaggcttacaagttagttcagaatctgcgccttatcaaccaaattgttttgcctatccaccctgtggtgccaaacccatacactctcctatcctcaatacctccttctactacccattattctgttctggatctcaaacatgctttctttactattcctttgcacccttcatcccagcctctctttgccttcacttagactgaccctgacacccattaggctcagcaaattacctgggctgtactgccgcaagttccacaaggcagcccccattacttcagttaagcccaaatttcatcctcatctgttacctatctcggcataattctcataaaaacacacgtgctctccctgctgatcgtgtccgattaatctcccaaacctcaat

SEQ ID NO: 504369 - DNA, 828 bp, Homo sapiens
agcctaggaggcagaggtggcagtgagccgagatcacaccactgcactgcagcctgggcgacaaagactgtcaaaaaaaaaaaaaaaaaaaggttattacccaaaaagtcaaagggagaatttataagggaatgtcagaaaatactgtggagggtggattggaaaatacagaacgaacttcatcaaattctggtggagatggtggttggaaaggcaacggcttcacggtggaacatgatatagtctatgacctttggtatgtggacattggagaatgtatcttcaaattaactaggcctaacttcccacctttagaaatatacggtaaaaaaagaacaatttaaattcaaggccagaagggatttattaaccgttcaggtggtgggaaatagagattaaacattatgtggagaaaacacagcgatttcgtggacttattcataaaataaaggctttattaaaatggagaattgtcaaaaggtgatgtccctaaatggaccttattccatacaggggatcagtatttggacaaatatcttgggggaagtagacaattcctagaaagacatggattaagcaaaaatatttcaggaacaaggtgaagacattacgttgggtaatttaaaaatctgcacccttgccttgaacacattgtgaaatcccaagtccagtgtctccttgggtattttgttaccaaagctttgaaaattcccattgggataaaattgttttaaaacttgggagacgttgtaccatttaaagtcaagagccttggtttcagataccagtgggaatctacacgggaactctgataaacggaagaggatg

SEQ ID NO: 504370 - DNA, 335 bp, Homo sapiens
gtacagacatactctgagcaaagatattaataccgtgaccagtacaagagatgaccaccgaacatcagaccagtgcagacaaagtatacgatcaaatatgggttcctagaacgaaagaccctctaacaagaatcctgcctatttacaaaattggtcagtcttgtcagagattacattggaaacaaaatgtctatatagcagtagtaattcacatagaatttacttagtaacatacttcctctcttttaaacagatgtcacaaggtaagacccagaatggcgctaaggactttgggttccactggatactgtgctgtcagttatggaatctcgctt

SEQ ID NO: 504371 - DNA, 856 bp, Homo sapiens
agcggggcggccgtatctcgagccccagcggctgagggcgggcggtcgggcgcggggcgagggaggggggccggtccgcgacgactccccgtgacggcgtttctcctccgagcggcgccggttgcgcgcttggggggggcggggtacatgcccactccagtgaccatggtgcgacaacgaagagcccgacccaggccaaaaagacaagcgaaacctgccgcagacgaagggtgcgggattgtaggctgtctgcagccttcaggaaacatgtgctgaagcctttagaatgcagcatctgcgatgtgaggaaaggcacctccaggcagaaaacctcggatcaattctcagctggtggtcacagctacgtggcacaagcagtatgccaccccaacacccccgtaaaaacggacgacgaagggaggaaagtttgaaacagcgggatcagaagagaacacctgagaaagacggggacagtagtcctagtgttgcgctggaaagaatagcaacaaggaaaaggcaaggccgaaagtctgacagttctgaaagatcctcctagtgaagcaagacagcagtacagctctgcaaagtgctacagacgaagaccagcgaaacaaaatcacacctcagggcccccggctgaaaccacgtggaccggagcacttgcacagccaaggtggcagtaaactgtgggcaacgtccaccgtcatgatcacggactttaacgggagaagcttcggtccttcatcgacattctcattcacagtgacctccagtgcatggttcaaaacggcagaaccagagccagtcgggggtcagagaggaccaaccatgggttcctcccgttcctcacggccag

SEQ ID NO: 504372 - DNA, 756 bp, Homo sapiens
  misc_feature (46)..(46): n is a, c, g, or t
  misc_feature (186)..(186): n is a, c, g, or t
ttgtaaaccattcgtttggagcgctggtcccagttggcgtacaggntgtaacatggctctctagacttgtattgtcctaggtagcactccttgcgtatcataatcatagctggcgttggtagttcctacatcgcaatgttgactatactgacccgtgacgagacaggccggagtcgattcatgacncatatagtccaagatgtgcagatacgtgtagggatcactatacctggtgttcgtactcactcgaggagctccatggcgatgcgtcgtagtatcgaagattaggtccactcgtctctgaaaattacgcttcatttcaagtagtttatcagtcccatcctttcccttctctgagcaatggaactactgtatacaaataagccttctggcctattttgcatcttatacttccgaaacccgaatcttagtaggcatgttcctcattttcaaaaacgaggggaacaagaccacgagtttttcacggagaaaactggcaggacaaatgggcacaagaaactcagaaggcagctattcccagcagcttcctagttaacaagccccatgctgcctccagtctttgtctgtattcttctgtatttaaccttcagattgtaacgccttttcttggcaagcttttcttcatttttttaaactcttttcctgaaactttttatgaatggctatggcaccattaatgctgctgaatatctttaaactctgcacaagcaagtgtgtagcttacggccactactg

SEQ ID NO: 504373 - DNA, 540 bp, Homo sapiens
  misc_feature (3)..(3): n is a, c, g, or t
  misc_feature (61)..(61): n is a, c, g, or t
  misc_feature (63)..(63): n is a, c, g, or t
  misc_feature (70)..(70): n is a, c, g, or t
  misc_feature (167)..(167): n is a, c, g, or t
  misc_feature (176)..(176): n is a, c, g, or t
  misc_feature (209)..(209): n is a, c, g, or t
  misc_feature (211)..(211): n is a, c, g, or t
  misc_feature (233)..(233): n is a, c, g, or t
  misc_feature (244)..(244): n is a, c, g, or t
  misc_feature (281)..(281): n is a, c, g, or t
  misc_feature (367)..(367): n is a, c, g, or t
  misc_feature (370)..(370): n is a, c, g, or t
  misc_feature (435)..(435): n is a, c, g, or t
  misc_feature (456)..(456): n is a, c, g, or t
  misc_feature (499)..(499): n is a, c, g, or t
  misc_feature (519)..(519): n is a, c, g, or t
ctnatatgaatgcagttctgattgtacgacacagcaagaaaattcactttcacagttaacntntcatctnactcagtagaacacaaagtaaatggtttataactccaatatttgcaaggaaaatacagtacaaattactaaaaaatactaaaatatagaattgtgtncaggcatcnacactacatcaatagcagcagtaacctgaaatnanaaacttttaataaaaagttctnaaatataaatnatatggcaaatgtacagtacattgcttttattcagtntctttttccagtgttttgcagtagaacagggttcctaccatcacctcccttaggtttaaaaaacccaaaacacaagtgtgccgttnttncttcagcatcatgagtgtgagtgagctgagtgtggaataccactgtgtctgtagcttcggttacnactgctttcactgtgattgtntttgtacagattcattccattaggaggaaatatggtgtgtatnacaaacccctccctcgagangggttcattgcctattggtaa

SEQ ID NO: 504374 - DNA, 224 bp, Homo sapiens
gtttatggcaggacagcctcttctcagcatcctggtctaagctaaagtgccagtcctgagggctcccttcccatcagcccctttccacacccttctctccatttgctcccccttgggagacaggatgtcactctgtcactcaggctggagtgcaatggcatgatcatgactcactacagccttgaactcctgggctcaagagacccttctgcctcagcctcctg

SEQ ID NO: 504375 - DNA, 422 bp, Homo sapiens
cccaggccgggggggttttttggtttccctttttcccccgggccggttttttttttgggatttgggcccccccttcttccccgggggggggggcccaaaaagcccccccccctttttttgggggggggcccctgtttttccaaggttgtttttccccccccgggggggcccgggatttttttttttggggggggccttggggcctttttccccccccccccatttccttttttttgttccccccccctttggggggcccccccccgggggggggccccgggggtttttttttttccctcccccccccctggggtaggggggggggggggggggtggaaggggggggcccccccccccggtttgggggtttgggggggggggtttttttttttttttaaaaattttttcttttttttttggga

SEQ ID NO: 504376 - DNA, 853 bp, Homo sapiens
ctatatgctagtacgagccccggttgaatcggcaccgaggatcttccgtggtggtagacggggtttcaccatgttggccgggctggtctgggactcctggcctcaggcagtccacttgcctcagcctcccaaagtgctgggattataggcctaagccaccgtaaccagccagaattttttttttttttaaagcaccagaacattgggggaaagattgtgtctttaacaaattggtgctgagaaaactgtttaaccacattacaaaagatttgaagtttggacccttacctttacaccatatacaaaaacacaaaactttttaaagattaaacttaagacctgtaaaaaaacaaaaaacaaaaactctctcgacacttagttctctctcttcttcttctctcttcaaattttccccgaaggcgaaagagtgccccagaggtgacacacaggggtgtggctctccggcccccagaggttgttctgttgaaaacaaccacggacggctctaaaacacggttggtagactctcccctgtgttttgcagagacaaagaggcgcccataaaggaatttctggcgcattttggcaacaggagaaccatctccagcgcccccaacaaagaggaactcctacacccgcggttgttgtgtgcaaaatgtgcgccccggtttattattccagggcttttgccacggcgcgaagaaaaggcccacttcgcctctataataggccgggctgtgaaagagcgtgtgcccttccgtgcgaattttaccgcggggtttacccccccggggcgcttggaaccgcgcccaaaagagggtttacctccacgcttgcttataaggcggggccc

SEQ ID NO: 504377 - DNA, 254 bp, Homo sapiens
atggttggagcaacacgatcgtacgcgtatcgagttgctatccatacggtgaatcccttctgtatttctgtgtggacgattgtgacgctcggggcacaccgggactgtcaccggcgccctgccgcaaaccgttagatgccatagtccttccgaccgtcccacagctgccaactggccacaagcaccgtcgatctcagagcctcgggtatcgcgcactgtcaccgggatcttccatgcgctcaagttgtctcgaa

SEQ ID NO: 504378 - DNA, 696 bp, Homo sapiens
tagcatgtgtctaggtgcgtggctgggtgttgagtcggccgagggatcgctggtactgctatggcggggtcatcggatatccttcaccatggcgtccagcccggccccagcgtcgcgcgaggcacctgactcctctcacctccagccctggccgagagctcccggcgtactgatgccctcacctcctacgccctggccgtgacctttccaccatttgacggatgagtccgaggggctcctaggcacagcaggggcccctggaggaagaagcaggtatggagaggtagctcgattggcagcatggcatggagaacgggactaccgcgccatcccagagctggacgccctatgatggcccgagggactggctctggactgcatgaggacgtacgagtgagcgtgatcggccagctcagagggcaggctagctagacgctgggtccactgccgcgtcagcgtgacgcgggaggcatgcgccggggcctttgggcctgcagtgctgcccgtgcgactccgtgatcttgaccacgcgattgcacgcgaggaccgaaggcagcgctcctgaccccgcaatccgcctgtccaggtgctgccgggcctgccgtcgtgactggcgaggcgcgggcccgatcgagagtgagtccgagtagcattctgagaccctgggagtgcctctccacaaggccactcctggtc

SEQ ID NO: 504379 - DNA, 453 bp, Homo sapiens
cagaaatggaaagaagtgtgagattttattctaggaaaagcaagcacttacataccactctaacggtttgagaatttagcaagcatgaagaaagatattctccttaaagttttgccttaaaattattgaaatgtattatattctttttcaaattaatcaatttggttaaagaaataattaagtaggctgggcgcagtggctcacgcctgtaatcccagcactttgggaggctgaggcaggtggatcaccaggtcaggagatcgagaccatcctggctaacacagtgaaaccccgtctccactaaaaatataaaaaattagtcgggtgtggtggctggcgcctatagtcccagctactcgggaagctgaggcacgtgaatggcataaaccctgtaagcggagcttgcagtgagccaagatcacgccgcgacagagggagactctgtctcaaaaa

SEQ ID NO: 504380 - DNA, 161 bp, Homo sapiens
attacccgagtagccgacaggccacctgcacatcgcacacaccacccctacagtctgggagtgtctgagaagaacacaggcccagggatcagaacaggagggtgtccgcatggcatgccaccacactaagtaacaaccgtgtaggtgacacgcataataga

SEQ ID NO: 504381 - DNA, 1141 bp, Homo sapiens
tgttatttattattttcttttattatttgtttcttcttatatatatatatatatatataaaaaaaaagagagagagagaagaagagagagagagagagagagaggaggggggagggaggagagagagaggggggggggagagagagggggggggggggggtgtgtgtgttaattaaagagtgagtatgttttttatttgttgcgtgggagaagaagagagagaggaggagagagaagagggtggggagggggggtggtaataaatagaggggggtaaaaaaaaaataagaaagaagagagaggggtgggggggcggataacgagggggggaggagaaaaagaacaaaaacgatgggagggcgagagaaatctccacaagaagagcggcgccaggcaggaggagaaacaaaacgcggcggggggggcgcggcggccctccggcgggaggaagagagggagggggagcagcgacagagcggggggtcggcaaccacgagcgcgaaacgtggcggaggggaggagagagaaaaaaaaaggcgaagagacggacggggcgagggcgaacccaaaacccaaacacaaaaagacgcaaccggtggggcggaacagccaccacaggaaacaacaacgcagaaaaacacccacgagaagaagaggaacaccagagacgggcaagcacccaacccccacaaaaaacccgaacaacacccaccccacaggagagcgacaggcaggcgacccacccctacaatagagaccaggagaataatccatggatgacctacaccacacccccccaccatgtacccgcatcaacaaaacaaacacccaacagcagagacaatgactcgacgacccgtccacacaccaaaaagtcagagcaacaaaggtgggtgaaaagtcgatacgagagacgaacgggtgagcgcaacaaaaaaccgccgcccagacgcagggggggggaccgccacgccacaccaaaaaaagaagctggaccacgacaatctcccagaccaaagaacccacgcgaacacgaacgaggcacgcgggccaacgccccacaaacaacgagaaacccacaaccccagcccgagggacaacaaaaaacgccaccagaacaagggaaaaaagcgaaaggaga

SEQ ID NO: 504382 - DNA, 862 bp, Homo sapiens
  misc_feature (2)..(2): n is a, c, g, or t
  misc_feature (69)..(69): n is a, c, g, or t
  misc_feature (90)..(90): n is a, c, g, or t
  misc_feature (97)..(97): n is a, c, g, or t
  misc_feature (117)..(117): n is a, c, g, or t
  misc_feature (119)..(119): n is a, c, g, or t
  misc_feature (122)..(122): n is a, c, g, or t
  misc_feature (124)..(128): n is a, c, g, or t
  misc_feature (136)..(136): n is a, c, g, or t
  misc_feature (166)..(166): n is a, c, g, or t
  misc_feature (168)..(168): n is a, c, g, or t
  misc_feature (180)..(180): n is a, c, g, or t
  misc_feature (208)..(208): n is a, c, g, or t
  misc_feature (214)..(215): n is a, c, g, or t
  misc_feature (220)..(220): n is a, c, g, or t
  misc_feature (257)..(257): n is a, c, g, or t
  misc_feature (389)..(389): n is a, c, g, or t
  misc_feature (428)..(428): n is a, c, g, or t
  misc_feature (503)..(503): n is a, c, g, or t
  misc_feature (539)..(539): n is a, c, g, or t
  misc_feature (589)..(589): n is a, c, g, or t
  misc_feature (660)..(660): n is a, c, g, or t
  misc_feature (674)..(674): n is a, c, g, or t
  misc_feature (726)..(726): n is a, c, g, or t
  misc_feature (735)..(735): n is a, c, g, or t
  misc_feature (763)..(763): n is a, c, g, or t
  misc_feature (772)..(772): n is a, c, g, or t
  misc_feature (787)..(787): n is a, c, g, or t
  misc_feature (789)..(789): n is a, c, g, or t
  misc_feature (799)..(799): n is a, c, g, or t
  misc_feature (853)..(853): n is a, c, g, or t
tntagatgttttgtaatgattagcaacattgtaaacaccaccaggtttttccaacactaactgctagtnttttccagttatttttttttncccaganaaaatatccaaacctaatananttncnnnnnccggtganaccatcagcctacccccccaaatcccccancncgcaatccttancatcatgcatatcatttcaccatttcanaaaacnnatttnaaaatttctacaaactttcccagtgtaaaagactccncaaaagccgcatgacaacattaaactacaaaattcactttggaaaagtagggagttatttttctaattttggctttaagattttttttttttaaatgggttaaaagatacggtgaggagtgttttgagagangtggagaaaaggagcctccagttaatgcattcaccatanctgaaaatacttcagttatacaaagggaacacttcgagagttaggatatattataaataagtctctcagcaagangaacggatgaacagttcaattgcacccacaggaganaggtcttcttggagaatgcctgtttatagaatcttctgttaaatagagtnggctacttctaatgattcaccttgtactaaaacaatatcataagagttcatgtacttttctaaaagctcanccactctatcattnagatatccaattttcagaatgtgctcaacattggccactccatctgccattnttaagtttncttgggagtttcccagaagaattatgtnactattgtnttttagttgattgananattctgtatncctcaaggcaccatcatggtttgtaaaatacatgaataagttctcctttaaatncctttgagc

SEQ ID NO: 504383 - DNA, 116 bp, Homo sapiens
taggtattaaaattttttaaaattgtttgcggtggtttaaaattccttgattctaaaaaacactaatacattttaaacgggtaaattttatggtatatgatttatagttcaggaaa

SEQ ID NO: 504384 - DNA, 570 bp, Homo sapiens
tagaggatccccgttcgacggtgtctgagcactgcagctgaccagctgttccctaagatacaacaatactgaaattagaccaattagtaatcctgcaatggtctctaagtgttcaagtaaaaggaagagttgcatatctctcactttaaatcaaaagctagaaatgattaagcttagtgaggctaaggctacgctgaaggtgaggtttcttgcaccagttaaccaagttgtaaatgaaaagaaaaagttcttgaagaaaattaaaagtgttactccagggaacacacaaaatataagagagtgaaacagctttattgctgatatggagaaagtttaaatggtctggatagaagatcaaactagccacaacattcccttaaggccaaagcctaattcagagcaaggacctaactgtcttccaccctgcaaaagctgagacaagtgagaaagctgcagaagaaaagtttgaaggtaacagatgtcggttcgtgaggtttaaggacagaagcagaccctgtaatataaaagtccaaggtaaagctgcaaccggtgatggagaagctgcagcaa

SEQ ID NO: 504385 - DNA, 216 bp, Homo sapiens
  misc_feature (171)..(171): n is a, c, g, or t
gggggctaattttttgtattttagtagagacagggtttcgccatgttgcccaggctggtcttgaactcctgagctcaggcaatttgcctttcttgtcctcccaaagtgctgggattactggtgtgagccaccgtgcctggcctctgttgagtttttcatgtctgctattgngtctttaatttccaagaactatctttttttctctgaatgcatttt

SEQ ID NO: 504386 - DNA, 335 bp, Homo sapiens
ttttgagacagagtcttactctgtcaccaggctggagtgcagtggtgtgatctcagctcactgcaacctccacctccggggttcaagggattctcctgcctcagcctcccgagtagctgggactacaggcgcccgccaccacgcccagctaatttttgtatctttagtagcgatggggtttcaccatgttggccaggatggtctcgatctcctgacctcaggtaatccacctgcctcggccgcccaaagtgctgggattacaggcgtgagccaccgctcccagcctcaccgagcctgtttctatgatctattttctccccttctgtcgtcttctc

SEQ ID NO: 504387 - DNA, 692 bp, Homo sapiens
cttggtggctcatgcctgtaatcccagcactttgggaggtcgagacaggcggatctcttgaggtcagaagttcgagaccagcctggtcaacatggtgaaacgccgtctctactaaaaacacaaaaattagccacgcgtggcggggggggcacctgtaatcccagctactcgggaggccgaggcacgagaatcgcctgaacccgggagacagaagctgctgtgagccgagaccgtgccactgcactccagcccgggcgacagagcgagactcagcctcaaaaaaaaaaaaaagaatctttatctggtcttggtgacagggctatggggaggcaggacctttaacaaagtctgtgtacggtcttgaggcctccaccctcataaattagactactgtggctgacactctacggagtagactccatcatcgtgactagcgggtttgcccccatcttgtggctttctctctctctctctttggcccttctgctatgcgatgctgtctcctgctcatgttttgtgaccacagcacagcagggccctgcaccagtatgccttgcattggggacgttcctcgtcttccagaactattgacgtccgcacactcctggtcccttctcacctttaccccgtctggtgcaccttcctggtcctaccgggcccaaccacaactctgttttccgctgcccatgcca

SEQ ID NO: 504388 - DNA, 281 bp, Homo sapiens
tctatctcattcatagccatcaattgcctaaaaagaaagtcattatactcagcgctacgatcagcgaaacgattgctaaaatgatgtttggaccagaagttaaatactgggatgttggatgacggaatcaaaaggggaaattgtgcaaattcccatcaaaagttttagccgctatgcgataaaagagaacgaagaacttttgaacttggcaaaaaagttaatagacatctacaatcctaacagcactattattacctacaaaggatttatggaacaagatg

SEQ ID NO: 504389 - DNA, 300 bp, Homo sapiens
  misc_feature (10)..(10): n is a, c, g, or t
  misc_feature (94)..(94): n is a, c, g, or t
  misc_feature (117)..(117): n is a, c, g, or t
  misc_feature (121)..(121): n is a, c, g, or t
  misc_feature (133)..(133): n is a, c, g, or t
  misc_feature (191)..(191): n is a, c, g, or t
  misc_feature (198)..(199): n is a, c, g, or t
  misc_feature (219)..(219): n is a, c, g, or t
  misc_feature (223)..(223): n is a, c, g, or t
  misc_feature (228)..(228): n is a, c, g, or t
  misc_feature (231)..(231): n is a, c, g, or t
  misc_feature (250)..(250): n is a, c, g, or t
  misc_feature (259)..(259): n is a, c, g, or t
gctctctgcngcattatttttcattgtaaaatagcagatcgaatttattattcaataattataaaatggtcaaatgtatgtgactatatttggncaatgaaaaatgcggctgttaanggcngacaatactgangattcagatgatgttactgatgaaaataataacagatgacaattattgagcatttctngcattcnncccggcattaccttatttgnggtncaggnctnccaaggggaagagtgactngtggcaggngtgagaggttccgaggcacaaaaggaagataggcattcaag

SEQ ID NO: 504390 - DNA, 1457 bp, Homo sapiens
gctcccgccggtgggctccttgctcggccggtgccgcggcatgggagaggccgagtgtgtgtgctgtgcgtgggtgcgccggaggcgacaagggcccggtggtgagtgctgtgccaccagccctggccggagtgagacagtggtgtggagccccgaggtggagtgtgtgcctcttccacgccatgctgggccacaagcccgtcggtgtgaaccgacacttccacatgatttgtatacgggacaagttcagccagaacatcgggcggcaggtcccatccaaggtcatctgggaccatctgagcaccatgtacgacatggcaggcgctgcattgagtctgagatttcttccattcccgaatccaggagaggaacttcgtccttccagaaggagatcattcagggaggtccgagaaggacaacacgtgactgatcagaacgaagcgcagatgaccacgcaggcagactgagagggccggcagggtggaccccccgagaatcgcggccctgaccgatgcctgccccgcacaccttcgagcgaagttgcgggcgccgagccgtccggacgaggtcgtcccgggcagcgagccagcgagcagcgcaaccgcccgtccagggagcgcgggagcggttgacgaagacaagcggcaggcacgccgacagagggggggcaacgaggcacggacgggggatccacgcaggagagaagagggccgaggggaccgcgccgagacgcaggagggagcacgcgaagtgccaagagagaccacagcgtggcacggccgcaacagcgcgcagcacagccacggcacaagctagagcaggcccgtcaggacgagcccgagggatgttagggccaccgcgagccgcaaagaacacgcactgaggcctgggaatggcgtaacgcatgaggctgggataccaagcttaagagaggcatgggtcgatatagaggctgttgggcgaagccataagaagggttgcaccgagcgccgccccgagaggcgccagcagcacatgtaaagcttcacgctgagagccccgagaagtgccggcaaagtatcaatgagcggcacgcagacagatgagcccgacagcagctactccacagtgggcaacgacacagcgcgatgcaaacacaagtggagcaccgcgacacgggagagagagatgaacacagcacggacgaaggacggccgccggcaggaggagacagccacgaaggagagagaaccaggacgcctgaagatgaggacagcccgaggaagcgagaggccacgccagagcgcgagaggcgggcgcgacacgaacggagccggagcacccctgacacgggcgaccccgcagagacgacgcggcgacaccgacgagcggagcgccgcgcgacgccggggagggcggcgcgagtaagtgaaccgacacaccggcgcgcgagcggcggcaaggcaacagtgggccaa

SEQ ID NO: 504391 - DNA, 461 bp, Homo sapiens
gggatcgagccctcgccgaggcctgcctgtcatggtgccctgcgccgcctgcgccggctgtcacccgggccgcgcgggccgtgagcgtcatggccttggccggggcccctgtgggctggccatgctgcgcctggcgcttggatggccctgctcggggcctggcgctgcgtgcggctgctctgactcctctgcagcatcgtcatcatctccgcctgcgcagtgactgccagcgccccgccggcttcccacctggccccgctggctgccccgcgccgggccctgcgacccttgacctagctagctcttctgccacacctgcatgtgtcgcccactgggcccacacccaagtgctgcctgcaggacctgctgctctggacagcccgaacggttgaagcaggaggctgggacctggaaaacttgaaccatcagtaccctaggccggaggaagcagtggtgccagc

SEQ ID NO: 504392 - DNA, 389 bp, Homo sapiens
atggctcggtgcagccttgaactcctggggctcggggaatccttccacctcagcctcccgagtagctgggactgcaggcgtgcactaccatgcctggctaatgacattgcttttatgaagcaaaacataggatgttgtcgggcatggtggctcacgcatgtgatcccagtgctttgggagcctggggcgggcagatcacctaaggtcaggagttcaagaccagcctgagcaacatggtgaaaccccgtctctactaaaaatacacaagttagccgggcgtcgtggtgtgcacctgtagtcccaactactcgggaggctgagacagaaaaatcgcttgaacccaggaggcggaggttgcattaagccaagattgtaccgctacactccag

SEQ ID NO: 504393 - DNA, 368 bp, Homo sapiens
  misc_feature (222)..(222): n is a, c, g, or t
  misc_feature (289)..(289): n is a, c, g, or t
  misc_feature (355)..(355): n is a, c, g, or t
taaaatgttttctagccttggaacatggtgaaactctgcctctacagaaaaaaaaaaaaattagttgggtatggtggtatgcgcctgtggtcccagctacttgggaggctgaggtgggagagtcacttgagcctgggaggcagaggttgcagtgaactgagattgcaccactgcactctggcctcacagagtgaggaccccgtctcaataaataaataaatnggctgggcgtggtgcctcacacctgtaatcccagccctttaggaggccaaggtggatgaatcatttnaggtcaggagttcgagaccagcctggccaacatggtgaaatcccgcctctactaaaaaatacaaanattagccacgtgt

SEQ ID NO: 504394 - DNA, 481 bp, Homo sapiens
tggctcgctatggaaggatgtcatggacggatggaataactataggtgttacatcccacatgatatagcaaaatctactaaacatactcttcaaaaataggtgctgaatatcttccattataccctatcagatcctatacgtctctctaacctatctacaacactgtatgtgccttaggaggttgacctgcattgaacacatcattgggcttactgtctgtggtcaatggcaaattgtagcaggagcaagagcagggttgagatcccctggtctatatcctgcagggttgtcctgggtcgtcttcattccaccacagaggtatcatcccttgtaggcagccttctcatcacaaggcccgctgactctagcttttgaaaaaatactgctcttcagatctaggaatgaaaataatgtctatttcttattagagcagggatactacagtatctcttatagttatcctacatgcttgcttcacag

SEQ ID NO: 504395 - DNA, 198 bp, Homo sapiens
ctatttctcgatcgttatataataatgagagccagagcaaactgtaagagatactaagtaatagaggctaagggggcactgtagttataggcaacgcagtcaatttttctatataaaggattctctaaacctgccataaatgtaaacatgaagcaatagcagcctaaggaacagaacacttagaagcacataaaacat

SEQ ID NO: 504396 - DNA, 121 bp, Homo sapiens
tccaagatgagccggggcaacatagagagaccctgtctccacaaaaggtaaaaaaatttacccaggcttgcgggcacacatctctaattccagtggctggtccggaggggggatcctctag

SEQ ID NO: 504397 - DNA, 180 bp, Homo sapiens
accactaatgagacagaaattcctctcctgcagggagacgattgttgataatctgttagaggaaaatcaagggctttagtctccagggtgttcctgggggacacatttaggaatgtgcctgtggagagaaaaaaggcaatggtaattaagtatcttttcctgaatgctggcctttgaatg

SEQ ID NO: 504398 - DNA, 340 bp, Homo sapiens
aacaaacccgtgagaacatgaacgagacatctgttcgcttacatacatagtccccacaagcctagggctgcccgccgtggtacatgagcatgctatttcgcgcgctctcgatcgatccccaactccaaatatctcatccgcaatccgaatgatcaacagccgaagagagtgagctaatcaaactaacctcagaacgaatgataagccatagcacaaggactaaaggacgaacctgatctcttagactagtatccgtagtcatttttattgccacaactaacctcctcggactcctgccttactcatttacaccaaccacccaactatctataaacctagc

SEQ ID NO: 504399 - DNA, 436 bp, Homo sapiens
  misc_feature (4)..(4): n is a, c, g, or t
  misc_feature (129)..(129): n is a, c, g, or t
  misc_feature (150)..(150): n is a, c, g, or t
  misc_feature (152)..(152): n is a, c, g, or t
  misc_feature (158)..(158): n is a, c, g, or t
  misc_feature (166)..(166): n is a, c, g, or t
  misc_feature (225)..(225): n is a, c, g, or t
  misc_feature (242)..(242): n is a, c, g, or t
  misc_feature (255)..(255): n is a, c, g, or t
  misc_feature (261)..(261): n is a, c, g, or t
  misc_feature (269)..(272): n is a, c, g, or t
  misc_feature (277)..(277): n is a, c, g, or t
  misc_feature (282)..(282): n is a, c, g, or t
  misc_feature (285)..(285): n is a, c, g, or t
  misc_feature (293)..(293): n is a, c, g, or t
  misc_feature (295)..(295): n is a, c, g, or t
  misc_feature (299)..(300): n is a, c, g, or t
  misc_feature (311)..(311): n is a, c, g, or t
  misc_feature (330)..(330): n is a, c, g, or t
  misc_feature (332)..(332): n is a, c, g, or t
  misc_feature (336)..(336): n is a, c, g, or t
  misc_feature (338)..(338): n is a, c, g, or t
  misc_feature (345)..(345): n is a, c, g, or t
  misc_feature (360)..(360): n is a, c, g, or t
  misc_feature (376)..(376): n is a, c, g, or t
  misc_feature (381)..(381): n is a, c, g, or t
  misc_feature (393)..(393): n is a, c, g, or t
  misc_feature (416)..(416): n is a, c, g, or t
  misc_feature (424)..(424): n is a, c, g, or t
  misc_feature (435)..(435): n is a, c, g, or t
ggcngcccaggcatcttccatgcacacacacaccccgccccgttacagtttaggggttaataagctttggggagcgcaggaggcaggtccacagttcatcaatcccaagacacccccatgaggtagggntgcctcacacagccagacggntntcaagngtatgatnggtagctttttcctctcctagacatctccaaaaataagcctacatctggcaactgacantgtcttaaatacaatgngattcagccactncaaggncctccatnnnncccanacccnggntcattaangntatnnttacaccacanatcccaagtccactaaaananacananggccccnaccacaccttctgcngggggggctggtgcgnaggtnttggctcttgtncctttctccctgggggctcgcgnggggcccntcttcggggtnt

SEQ ID NO: 504400 - DNA, 320 bp, Homo sapiens
agaggatcccgtgatgtatccccaacactaaggtatcctggatgtatatgaatcttctagagggcattcttcagagtagattagttagcctcctggtgttgcttttcttttagagatggagtctcaccctgttcccaggctggatggcaatggcgagatcttggctcagtgcaaactctgcctcctggtttcacgtgattcttctgcctcagcttccggagtagctgggattacaggcatgcatcaccacgccgggctctttttttgtgtgtgtatctttagatagagatggggcttcaccgtgttgggcgataacatca

SEQ ID NO: 504401 - DNA, 317 bp, Homo sapiens
  misc_feature (210)..(210): n is a, c, g, or t
aaaagattgaaaataaccaaagcctcaggaggtgaacgaggtcacctcctacggcagggaggagaaatctgagccaagtggcaatttcctttctaatactgagcactccattagtctccttaaaaactgctttcctaaggggaaaacgaggcagcacaggacaaggatttgggggtgaaatctcagctccacctctctttagttgtttanccctgggcaaataatgtaaccattctgcacctcagtttcttcatctacgaaatggggatactaccacttaccttggctcttgtgaggatggtaactcaagctctggg

SEQ ID NO: 504402 - DNA, 365 bp, Homo sapiens
  misc_feature (51)..(51): n is a, c, g, or t
  misc_feature (67)..(67): n is a, c, g, or t
  misc_feature (78)..(78): n is a, c, g, or t
  misc_feature (95)..(95): n is a, c, g, or t
ggaattgagcaagaagccacattttaaacgaaaaagagagaaaagaccagnaaagtctgtgtcttcnggtccaccccnttctctcttccaccccntaggtcagcacccctcacgcccctcagctctcaccctcgttagagtccaccagggatccttcctgcctcctcaaccccctcccgcccccgcgggcctgttaacccggagcagatttgggaagggaaatgtggctaatatctctagcagctgtcaaaggagggaccttccttcaaagggactggacagggatcctccacaagttctccattagctagcaggccagcaatttgataaggagcctggacctccgctacaagttgccactcagt

SEQ ID NO: 504403 - DNA, 1561 bp, Homo sapiens
  misc_feature (1560)..(1561): n is a, c, g, or t
ggacgcgtgggtcgacccacgcgtccggagcgcagaatatcaagtgctggcattgtcttgggaccacttgcacctccacctcctccaccacgtcccaccagggcctgcacaggcttcagtagccctccctcctccatccaagggacacactatcgggaacacttagatcaagaaagccgtgtagccgtaagcatggcgccgtcgaggcggaatagcctcataggaagccgagccaggcacacataccaaacactcacagaaacaagcaccaccaaaaaaatggaaacccagctagcacagagtaaacagaggaagaacacaaagaatagatgcaagagaacacacaaacaaagacaaacaaacagaaaaaaaaagacccacccaactgagaggaaacaaaactaccgacaaaatcgatcaaacaaaacagagcagcaacaccggggagacaaaaaggcacaagagaaagagggaacaagaaaagaaaataagagcagggagaacaatgagaataaaagagacaaagcagaacaagaagacaaagccctacaccgcacaggagaaggaggacgaagaaagacacaacaaaaagaacaacaaaacaagggcagcacaacatgaccacataaaaactacaaaaaaaaaaagggatagaaacaacccacaagcacaccaaagaccaacagacagaaaacaagataaaagaacaatgacaaccaaaggggaagaagaagcataacgcaaccacaaaaccccacatccaatctacccgacaaaacacacactagcaacaacaagacacacacaagagtaccacatacactaaaacatcctatcataaatcatcctgcgcaaccacactcttacatatgcctataaacctacctacccacaaaaaccatcacctacacaacgcgcactaacagtcgcaacaacaacgaccaccccaccaaagataacataacagaaacaacgatacgaccacagatcgccagacacggacaacacagcctctcgagcgggcacagccgacagtcatccatccaagccacacagatatagcccagcgcgagacgcgcgagcacacaatcacacgaacgctacggagagagcgagacacgaacccagcgtacgagagaacagaaccagaacaagacgcaccaggagcgcgcaacagcacacggacagaactaaacgaggcggcatgacgcagacagagtagcgcacgtagcctggaacaacataaacatcagagagagaacacatacaaaacgaagaacaagacaacatagatcgaacaaaacacgagaacaaaagaaaccaatgaaacaaaaacaacaaacaactcatcactacatacagtcaccgacgaaaagctacgactgaacgagatcatcaatagacacaatagacatgaaagacagataagacagagaatacccaatcacactaggcagacacagaccgaacgctacacgaacatcaacaaacgacgcaacaatacataaaagatcaaccaacaaacgactagtcactccgcccttgctacgcttccttccnn

SEQ ID NO: 504404 - DNA, 439 bp, Homo sapiens
ccagacagaagattgaacacggctacaagaaattggaaatgacattgatctcattttcctctcaattgcagtcatgatatcacatgaatatcaactggaccatcagctcagaagtaggtgagcattatgatctctaaaacgccagtgctgatttctaatccttctcaaaaaattccggatcccaaattgagggctgatgagaagatcttacaccgaaggcactaactgggactaattgtgagccagcaacatgtgaaaggctaaatccaggagatgcagaaatgcacatgggttccaggtgtcttttctaagtgacaatgggccttccttactggacagtagtcaggagacaattcaaatgtacttactacaaatggcaggtgggcaaccaaagggaagagacttaaaagacctcccagaactgggatgcaaaatacgc

SEQ ID NO: 504405 - DNA, 393 bp, Homo sapiens
  misc_feature (15)..(15): n is a, c, g, or t
  misc_feature (229)..(229): n is a, c, g, or t
  misc_feature (267)..(267): n is a, c, g, or t
  misc_feature (288)..(288): n is a, c, g, or t
  misc_feature (316)..(316): n is a, c, g, or t
  misc_feature (329)..(329): n is a, c, g, or t
  misc_feature (346)..(346): n is a, c, g, or t
gtttcctgtaagctnggccttgtgcagggtgtcagagatgccaagtaggtttgacacggcccatgccccagtgatctcacaagctcagggggaaagatccacatagccacgctgtgtagtaaccctgccttagagaagagggcgggtagctggacactcaggcagacacattcacccctgccaccaaggtcagggaggacttctgctctggagctgtgtcctgagggtnaatgaaatgggctgttgtatgtgtggttccccctacancccttccctatagcacttccnaccaggaatagacctactgctgtgggtnccttagcatggangaccagggatacaaggnctgattaaggtatcctacaaaacagattgattaattccctaaaattt

SEQ ID NO: 504406 - DNA, 272 bp, Homo sapiens
catgttgtattacaagtactcccatcttaaaaaataaaaaattaaaaaaattaaagttgactgggcgtggtggctcatgcctataatcccagcactcttggaaaacggtctagcaattcctcaagaggttaagcatagatttaccaaatggctcagcaattccactcctgggtgtatacccaagagaaatgaaaatatatgtccccaaagactttgtacacgaatgtgtacacagcagctttattaataatcgccaaatggtagaaccgact

SEQ ID NO: 504407 - DNA, 388 bp, Homo sapiens
  misc_feature (365)..(365): n is a, c, g, or t
tcttatccagtatctactcctgcaatctattctccacttagctgcttaggggatctttctaaaactcaaatctgatcatgtcactcctctattaaaacccttcaataggctgggcccagtggctcatgcctgtaatcccagcactctgggaggccaaggcgggcagatcacttgaggtcaggagttcaagaccagcctggccaagatggtgaaaccctgtctctactaaaaatacaaaaattagccaggcatgctgatgggcacctttaatcccagctactcgggaggctgaggcagagaattgcttgaacccgggaagcagaggttgcagtgagctgagattgcaccactgcactccagcctgngtgacagagtaagactccgtctc

SEQ ID NO: 504408 - DNA, 279 bp, Homo sapiens
aggatactaaagtccatgatgttcaagtcccttatagaaaatggtgtagtatttgcatataacctgtgcacatcctaccatacactttaaatcatctctagattacctataatagctaatacaatgtaaatgctttgtaaatagttgttatactatattgtttaatgacaaaacaagtttgtacatgttcagcaaggcgcaaccatccatttttttcccaaatattttgaccacagtggctgaatcacagatgcgagtatgacatgagccactggggag

SEQ ID NO: 504409 - DNA, 910 bp, Homo sapiens
gcctggggtgattccgtcctgcgcggttgttctctggagcagcgtcttgttatctccgctcgcgcctggctctcctacgctaagtgcgtgccgcacccgatggaagatccgatggacatggacatgagccctctgaggcccgagaactatcttctcggttgtgaactacaggccgacaaagattatcactttaaggtggatcattgatgaaaatgagcaccagtgtatctttcaagaacggtcagtattaggggctggtgcataaggatgagttgcacatgttaggaagcagaggcaagtgaatgacgaaggcagtccaagttaaagtaacactggcagctttgaaaatgtctgtacagccaaacggttgtcccttgggggcttggataggtaacgccaccaggtggtcttaaggttgaagtgtggttcagggccagtgcatataggggacagcacttaggtagctgtggaggaagatgcaccagtcagaagatgaagaggaggaaggatgtgaaagtcttaagtaatatctggaagcggtctgccctggaggtggtagcagggttccacagaaaaaagtagactgctgcttgatgaagatgatgacgatgatgacctggagaaggattggtgcgatgacggatgatgctgacgatgcattcgcgctcaggaagctggagaaagcgccgcggagacattatcgagaatacccaggcagaagccattgtcaccttatgggaagcctcaactcttacacaggacaaagggggactttgaaaaggaaaatctaaacaaggcattctgaaaatacgcaagtcgcagaaagggcgtctcaggcggcacaacgtagagcggcggacaagcacgcggggggaaagagagacctcaaggcgtttcgaccattggagcc

SEQ ID NO: 504410 - DNA, 130 bp, Homo sapiens
gcagggattgagtgctgctgttagtttagagaaggagagatgtctaacccttgaggtgaagggctctgggagggtccaagaagacgtaggctttatttttatatcattccacacattcagtgctcagcta

SEQ ID NO: 504411 - DNA, 117 bp, Homo sapiens
tcagctcggccctcataagcactgggaagtagatgaattgtacggtacttggcgtaaagccgcttccctcaagagtaactacaatcttcccagtgcttcagagcccagtgcttcaga

SEQ ID NO: 504412 - DNA, 737 bp, Homo sapiens
  misc_feature (638)..(638): n is a, c, g, or t
tcggtgggaccagcaagcatcaaaaatggggtgtgtagctatggagtctgacagaacaagacataagtatgaataagttagtagccacagtctctggaaggaaagttccatgtatgtgacatgagaacacagcatccaagccaaaggttttggcctctgtttcagaaaaggctcataaatctacgtgtgtggctaggtccgacaccgtgtcgcgcagaacagggagctctttctgactagctggatggcgccggcggcacttcagcctctggaagtatgaattaccctattcagctggtcaatagaaagattctcgagtggtaatacgaacatgggagctcgcgaggttctgtgaacgccgttctgcagaactgttacgttgtccacccagtcccatttcaagtttggattggacgtccagcataagacacggtggtctctgcgtctgtagtgtcattttgaccaaacggtgacgagtactgatcgtttacaaaagctcaataaaatttgacttcaagacttgtggacttgaggctgggcgcggtggctcactacctgtaatcccagcaactttgggaggccgaggcgggtggatcagacaggtcggagatcgagacatcctggttaacatggtgaanacccgtctctactaagaattttgacaaatttgctgggtgtcatggcgggctttgtagtccaagctattgggaggctgagcggagaatgggtaaccggag

SEQ ID NO: 504413 - DNA, 198 bp, Homo sapiens
attacatatagaatcgagcttgtaccaccgccggtgcttcacacggtgtgctgcccggcccgatggtctggccggagcggtgatcggtgtcggtgatcgtgccgatgcctacagctattcgcatgccccgcatgccctgccggaaggcagcgtgtggcagctggccagcgaaactgccggcaggccgatgggggggtg

SEQ ID NO: 504414 - DNA, 382 bp, Homo sapiens
tgtttatttctttttttcttgagacggagtctagctctgtcacccaggctgtagtgcaatggcgcgatcttgcctcactgcaacctccgcctcccgggtcaagtgattctcctgcctcagcctcccgtgtagctgggattacgggcgcgtaccaccaggcctggctaatgtttggtattttaagtagagacgaggttcaacatatgggccaggctggtctcgaacccctgaccttgtgttctgcccgcatcagcctcctaaagtgctgggattacaggtgtgagccagtgcgcccagccccggccagacttttttaagttcaaggaactcttctattcatcactgaccaacttttttttttttttcccggaggacccatctc

SEQ ID NO: 504415 - DNA, 216 bp, Homo sapiens
ctgacgataagtcaggttgaagaagcagtgaaactggacggcgagttgatatttgcagttcagtatataggagtctagaataagatacttccagatggggggggtgtattttataggatgaaatgagcataagatggatgggttaaccattggcagaaggctactatataaagatgtttacaaatttgcattataaaggcttagcaatatgctgaa

SEQ ID NO: 504416 - DNA, 214 bp, Homo sapiens
atcaagtagataagtgaataaatgagccagatgaactgtgtgacacggaaacacagaagtgaggatatagtggatcgagactgtggctcgcaagagagacagtgtccacccagcaacctggagaatgtgaccttattcgcgctgttacagctggctcacagctggtaatcccaggcacttagggagggcacaggttgcggtggatcagcttcag

SEQ ID NO: 504417 - DNA, 129 bp, Homo sapiens
  misc_feature (8)..(8): n is a, c, g, or t
  misc_feature (18)..(18): n is a, c, g, or t
tcagtcgnacctgatttncgtgcctctttgaagaagtaggattaggagaaatgtacttttgcgtttactgtcaccgcgtagtcgaaaagggcataggcatgcctctttgcaagctgcatagccttctct

SEQ ID NO: 504418 - DNA, 120 bp, Homo sapiens
gaggaagaagaatctgtatatctgtatatattggctagcaaatgtgccctgctctctcccctcttaaaaataggcaggcacccccatctttggcaaaggaaggcttgccctataggggca

SEQ ID NO: 504419 - DNA, 605 bp, Homo sapiens
  misc_feature (597)..(597): n is a, c, g, or t
gggctgtaggattttgcacgagggctcctggtctcagaatggcgctgtgctgtgctcttacagtcctgagcctcctacctctgctggaagcccatatcccattgtgtgccaacctatgaccggtgcccatgaccaacgccaccctggacacacatcactcggaagtggttttatatcgcattgggctttcgaaacgcggagtacaataagtcggatcacgagatacaagcaaccttcttttactctacccccaacaagacataggacacgatctttcttagagagtgccagacccgacaggaccagtgcgtttataacaccacctatctgaatgtgcatcgggatgggaccatatacagatacctgggatgccaagagcatttcgctcaattggtgatccttagggacaccaagacctacatgcttgcttttgacgtgaacgatgagaagaactgtgggctgtctgtctatgctgacaagccacagacgagcaatgagcaactgtgagagagttaccgctcttgactgcgagcgcatattccaagtcagatgtcgtgtgcaccgattggaggggaggggtccttatctggacacgtnctttggtt

SEQ ID NO: 504420 - DNA, 414 bp, Homo sapiens
ctagggggaaagcgagggtgtagttggcagacctgggaaaaatctggccacagtatctggcaggtatagcgctcctttcccttccgcagaaggttctcgggcagggcatggggaggcgcccggaagtggaacatagagggcacggacggtaagagctcacgggcctcaggtttcagggcacggaagctctctagcttttctgccaggttttcaatagctgacatccaagttctcggatcaggcagtgggaatggggggtgaaacaagaatccgggagaaggcctcaagtatttctcttttaaagcttcaggtgggtcagttagtttccttttctctactcggtaaatagggtccataaagaacggagggcgtcttgcatgctgcaaggaaccatcggaagcaggtctggatccg

SEQ ID NO: 504421 - DNA, 854 bp, Homo sapiens
tgagcaccccggccaccccccgaggccttattattcatgttggacccccgccaggagatttcggtggctgaggaatggctattataccaacccacgggccacaaaaggttggaagaacatcgagagttacttacaagggatgtccctaactggcatagagatcttggtacgagtgggtgaaacaatccccatgtgttgggtcgcaaacacaagtggatattaagggccaggaaagtgaaggccgaatccattgtcgttcccccgaagaagaatcttcagtactcacgacctttctgcccaagtactaccactttgaaagcccttcctctggcttgctaggaagctccttggagaccctaacttggaatttgttccatgcctgctctcgccccccccgaagttgtcatggaccccgctttggccgccccgtatgagcccgacttagaggttgctccagaaccaactgctctcccggatgaggatgatgacctgtgagaatgaagctggagccccgcgtccagaagtctagttttataggccagctgtcctgtgatgtcaggcggtgcagcgtgtgtgccccctccattattatctagctaagcggaacatgtgcttcatctgtgggatgctgaaggagatgagtgggcttcggagtgaatgtgcccagtttaaaaaataacttccttgtttggacctgcatatttagctgttttggaaccccgttgattccttgagtttcatatataagactgctgcagtcacatcaccatattcagtggtgaaatcttgtttgttactgtcattccccttccttttcgtttagaatcagaataaagttgtatttccaatatcta

SEQ ID NO: 504422 - DNA, 842 bp, Homo sapiens
  misc_feature (394)..(394): n is a, c, g, or t
  misc_feature (403)..(403): n is a, c, g, or t
  misc_feature (446)..(446): n is a, c, g, or t
  misc_feature (453)..(453): n is a, c, g, or t
  misc_feature (469)..(469): n is a, c, g, or t
  misc_feature (534)..(534): n is a, c, g, or t
  misc_feature (565)..(565): n is a, c, g, or t
  misc_feature (581)..(582): n is a, c, g, or t
  misc_feature (589)..(589): n is a, c, g, or t
  misc_feature (608)..(608): n is a, c, g, or t
  misc_feature (637)..(637): n is a, c, g, or t
  misc_feature (652)..(652): n is a, c, g, or t
ggacccggcggctcggcaggacccatggcggattcctcgcccgcactgtccctgcgggaaggcggccccgcgcgccgggccctcggcccctcgccgcgccggctcgcgctccggctccgagtccgaggaggccgagctgtcgctgagcctggcccgcaccaagacccgctcgtacggcagcaccgccagcgtgcgggcgccgtgggcgccggcgtcatcgagcgccatgtggagcaccgggtccgcgcgggcgacacgctgcagggcatcgcgctcaagtacggtgtccacgatggacccaggattaaaggggccaataaaactgtttacccagtgatgtgtatattttctgaagaaaactttgaacatcccagttatatcagagaagccttgngtggtttantggacttactccattgattctccagaaaatgaaactgtgatancagtttnctcaggacgaggagcnagtgtgggccgggaagacctccctcctcccagtcctcaagaatctgatgtcagcctgtgcagccngaggaagtgtcagcagagattctgcagaganttgattgcagatagtnntcacacnggcagccagaagtaaaagnagagagcagagatgaagaaagtcctatgnaatcctctatacgtnaggggattgtggggggataatctaccaaagtacgatatgttgtctacgatccactttgggtttaaaacatccctgggtccatagggcctttgaaactacttgggttaccgggggggcggcgggaaaaccggttctaaaaaggtatgggggggggaggaacacacatggggggggtaacaggagaaatatc

SEQ ID NO: 504423 - DNA, 472 bp, Homo sapiens
agtgctctatcgggaaaaaacatgggattgagaaaatttagaatttctttgcgcaccggctatcttttcgttagtacctttctttttcattcgtttttttgacaaggtcttactctgtcatccaggctatagtatagtagttcaatctctactgactggaaccccctcctcctgggttcaagtgatcctcccacctcagccttctgagaaattgggactacaggtgtgagccaccacgcccggctaattttttgtatttttggtagagatggggttttgccatgttgcccaggttggtcttgaactcctgagctcaagcaatccacctgcctcggcctcacaaagtgctgggattacaggaatgagccatcacgcttggccttctgtttttaagccatttgttggatactattccttcctcactgactgtatcaattaagttactctggttgcaagtaacagaaagtgacca

SEQ ID NO: 504424 - DNA, 366 bp, Homo sapiens
ccaaggaggtcgaggctacagtgagccatgatcggccactgcatttcagcctgggtgacagagtgagaccctgtctctaaaaaaaagaggggcaacatttcattcgtaatcagaaggggttttgcttggaagtaacattagagcccatctaatgggcctttattttagaggtgagaaaaatgagtcatagagttatttgtgataacaactagttcttggtggagatggcatttgaagatgggtcttctgggcctctgaccgctccatcctgctgtctctgtctcagtgtataacacgtcattttcaatatatttgtcaggagaggtttttggtactgtttttagaaccttgttctttgaaacacat

SEQ ID NO: 504425 - DNA, 180 bp, Homo sapiens
gggagacttaaatacaacctctgaccaaaaaacaaaggatataaacaataagctactttgacccagggttgactctcctggcaagacaggcttaaaaataaaaccacaatcatccttctcaatttgtaagatcatgagcattctcaagtctggatcctttcagaagtgatcaaagtatta

SEQ ID NO: 504426 - DNA, 308 bp, Homo sapiens
gctctgttgcccaggctggagcgcagtggcgccaatctcggctcactgcaccctccgcctcccaggttcaagcgattctcctgcctcagcctcccaagtagctgggattacaggcaagtgccaccatgcgtgctcatttttgtgtttttagtagagactgggtttcaccatgttggccaggctggtcttgaactcctggcctcaggcaatccactcccgcagcctcccaaagtattgggattacaggcgtgcaccttcacccagcaaatctctacttattataaacaataacttccggttcctttgtc

SEQ ID NO: 504427 - DNA, 767 bp, Homo sapiens
agcggagtctcgtagctctcgctgacctgcgggtgtaggtgctccgggatcgtcagcacccgtccgggcgccatcgacggtcgctaggcttcttctggacataccatactgcgccacttgtccgcttcacgacatccgcgcgggcatcatgggtgaagctcgcgcaaggcgagggtaaaaatctataggttgacgcgccagagtcaaatggctccgtcctactcaacagtgacggtagaatgaatgatagatgaatgatgagagaatatgttggaatgatgagaaatcgatgatatgagtggagaagaggtcgtcgtagcgtcatgaggaataggggaatgaaggctagcatgtcaaccatcagaaaagaaggtggtcgttgccccgatcgatacaaaggttgctacgttgcctagcaatcaggcacgagaagaacagcaagcatgtcactccacggcaaagcaggcaggacgacaagcaccgtgccagaggacgacacgttgaatcaccaatggcaaaacgtcacgtgtaccacaaaccctgagcggaggaaagggacgcgcagcagtcgaagggtcaaaagctattggatagacaatctcctgggttacagaaggggtgctgagcaatcgacagcacaagggggccaagaatgggcgatgaatgcacaagaacgtgaatgatcagtgtatgaatgagggatgatgaatgagctgatgaggacggactgaggaggatgacggaagagactgaggaatgaaggatga

SEQ ID NO: 504428 - DNA, 752 bp, Homo sapiens
gagggctcggagttcttgtgggctgttcgcggctgagtgtttggacctcctgcgtacagacgtgattaatagtggtggtgcctatcccaacatccccctctcttactcccttacctggagtacccaagacctgtttatgctacatgttgatggacatggaaaatgtttgaaaccaaagtaaccacattggatcatgggcttctgctgtggccatctcagcaataagttttggacagtttttgtacagtaggaattcttatcaattcaggatcgagatatgaaggcgacataccttagtggaatttgctccactttcctggaaaactttggcatttacgtctactgctcgatttgacagcaaagatgaaattctgctatacgtttggaaactgcatgggggtatctgtgactgccagacatcaagagacaccaccatgtatgctgtgtcttgctgctagcaaatgtgcttgtgacacggttgtgtttgccttacttgtgctgatgttggttctgcagacccggctaacagatgaagaagtcgagatagacgcggatggctgtgtccaatatgaagcctggagtgaacctgaacctgctatgacttgacccaaaagacattctcaccgcaatgattcattgaaacgggtttacatggagaacacagttggcctccaccgtttctgcccacagcaaaactacaagatcatcgaatgtgctgatcctacttatgactactatccgacgatgatttc

SEQ ID NO: 504429 - DNA, 150 bp, Homo sapiens
atagtagcagcaaaggcatagtgccatgggagaagcggatgcacgaagagcgtactccagcaggcgctatgatgaagtggaatgagtgacagatgcaggcgaggtgcaccacatgtattgccgacatggacgtaaagtcaatactttgat

SEQ ID NO: 504430 - DNA, 232 bp, Homo sapiens
ggtccggatttcgtggaggcgcggcttaccagagcagatagctttactctggaaaccctagatattcggccggaaggattctcaccttcctctcgctactcattccggcattctctcttcttaaaaatccactgctctttacagtacagcttcttctctttaagaatgctcctctaccaatcatcattcgatgattccacggcttcggtagtgtgtttcagccccgcgacat

SEQ ID NO: 504431 - DNA, 1181 bp, Homo sapiens
  misc_feature (109)..(109): n is a, c, g, or t
gttgtgagcatcgaggcatcatggcctgcactggtcagagattgtgcggccattccgcagtatatgccaacacactggtggatgtgtgtgcatatgcaggctctgggantgtgctgaaggtgcagcagctgctccacatttgtagcgaacactttgactccaaagagaaggaacggaagacaaagacacagaaggacacacgaacagacacggacaagaaggcaagcccctgcatgacatgggagcacatcagggcagtggctgttctggggattgcccttccattgctatgcggaggaggagcattggtgcagagctggcattacgaaccatttgcgccacttgctgagatatgggggagcctacaactccgagagggacattgtaaccatcttagccacatggaccctcatctctgtaatacaacatccacgactcaacatcctgagataccactaagcaaaattactatcatgcatgctgatccagaagtttcactataactccaatatatagaacatggagcactggtgcgcgcagtggtaaccaaatacttgccgcgtactggcctgcacaatgtctgcagccagatctatgcatcacaattactcatagacaacaggtgaacccacaaacacaaccatcattcactggatagcgcctatgagacaccaagggacacttgacaacacaattgttaggaggcaaacggagcacaaccccatcaaacgaccgctcattgccccccccataccccgcacaacagcagagacaccaggagcgaagaccatacaaagcagaccccaacgggatggcagcccaggtgcgcagtggcgaacacatcgggacccccaacccatgagcacgccaccgggaccaccaacaatgacaccacacggaccaagctgcataccccggcaaaacacgaaagtcacaagtccccgctaaagaggagcaaaacaacatgccacaaacgcctacagcggacaacataacaggcaccatacgcgggacccagagatgaggcacctacagaccaacatgacccgagacccacacaggaaaaaaagaactcagagcacacacacagcgcaacagacaacacgacagcgcagagcagcaacgacaggcaccacagcaaggcgcaacagagtgaaacagtcgacaaccgaagaccaccg

SEQ ID NO: 504432 - DNA, 299 bp, Homo sapiens
cttacccattagctgtcctgtaccatctaactaaaatgtactgatacatacttgtggccaggcacggtggctcacgcctgctatcacagcactttgggaggccaatgcaggcggatcacctgaggtcaggagtttcagactagtctggccaacatggtgaaaccccatctctactaaaaatacaataaaaaaaagaaaaaaattagaataaatccccggttttgtccttgactgtggctaccttttatcccactgactaaggtggatggggatacaggccccaaatgcctaatcatgtc

SEQ ID NO: 504433 - DNA, 104 bp, Homo sapiens
ggaaagcggacggatacatagatgacctgcttgccgaaatatcgaagtgcgtgaaaaagaaaaatcgcgtgctcgtgactacgctgacgaaggtcagtgcagaa

SEQ ID NO: 504434 - DNA, 129 bp, Homo sapiens
ggcaggacgctgcgcacaacatgggcaaccacctgccgcttcctgcctgcgaagagtggggaggaagatgaaatggaagttgaagacccaggtagttaagaagccaaaaacccaacatcataaattttg

SEQ ID NO: 504435 - DNA, 141 bp, Homo sapiens
tgtgttctagaggatcctcgtcaagcaaaggtctggtcctttcttttttatctcgaaatagtgattccatacatttccaggtcctgagcaatcttcaggtatccaacatagcattatctttgagcatccacggtgttccgc

SEQ ID NO: 504436 - DNA, 128 bp, Homo sapiens
taccacaaaggaaaactgccccccaacctaggcaacggggcagacctgcccaattaccgctggtcccagaccctgtcgtagctggacctggcggtcccttttctgtgtgaacttccggctgaaagtga

SEQ ID NO: 504437 - DNA, 1149 bp, Homo sapiens
ggatacctgtaatggctgcttcctaaaatgtctgtgatcgacgatgctaaagctctataagtctctaggcaatccggagactccagtgtacagggtaaccattccaagtcagatagcaattgctatatataccatttctttggtaatccttcgagcccctcaaggattccatcatgcatgaacctcagtgtttcatcacagttgtccttagtgcctcatgtccctgctttaggtgctgcctgtctgtggaagacagtcagaagaccggctgatgcaatcgccctttggttaggctgttggctgctcaagcatgacagtgcattggttgcctgatttgagggcggtatatgcacgtaataagatgatgtgtactcgacttgtgtccttttgacaagagccatatcggaagtcatatagccgtcaacctcttgtaaagatcgcgtttgctgcctcataaaggctagagagtcatgagagtccgagtgtgtggacccggttccatatgacctcatgtccaatactaacgggagagttcacattttttcccacttggtgttacgcgttgcatagttggggatagcataaagcaatatcaattttctctcaccatctgcctgaggaaaagctcgtggttcacttttcccaagcacatataatggccacagcaaagattggcagtcttataaatttggacaaaggtctagaggtaggttcagcgacgaatgtgcacgaatagggccttgaccatttgtcctcattaaaggtaaactaatgaatccataagagtccttaaggaaatgtactctttcaatagagtccttgttgaaccattcggggacgcaccggcaagtttctttggctcccgaaattcttacggaccattccgtcacctggtacgggttcaatacacttcgatctggccgtccctgaaattcccgttggagcggaggtacctcgtgaacattttcagcattcctcgggtagatggtttgtctcccccaaggtttacttattcatatttctcgaaatactacgaagaagtcagggcccaagaagggaacacttcttatccctccaagggacacaaaaacttttgacacacaccgcttcccgggggatttaattactggaaataggcggacaaagatt

SEQ ID NO: 504438 - DNA, 152 bp, Homo sapiens
gtatatcaccatatgtagcatcaacatgcgtcagcaaatttgattctattcttggactgtactcttcgcatggcactgggaagttcttttcaaatcattaaatattaagacgaccatctcttctattaaattacagtacatgttcgttccat

SEQ ID NO: 504439 - DNA, 418 bp, Homo sapiens
tctgaggacagagaacgggagaatggggaggagaaggggcggcacatagagctcagcagaggagacagacagaaggaaagatggcttggagaaaccagcagtctgcgaagctggggaggatggagagtggtttggggttttgggtcgggctctagtgtgatcaactgcagaagcattaccccgtggcctggtttctttactcagcccctggggtagatcccagccccccgcattagtccttttgctggaaaaggaagagggagtggtgggacgaatctgaggagtcgttggaggaggagccacggaaggtgctcgcccctgaacctgaggagattctgggtggcggagatgctgtgtggcctcaagatgaagctgaagcgacggcgagtgtcgctcgtgctccctgagcaccacgagg

SEQ ID NO: 504440 - DNA, 242 bp, Homo sapiens
cgatcgcttatgctccctcttcatttccagcacagggtatcaggtcctggctgcatagggaattggttactgcgctggccaccgaggagggggtagggactctgttatcaatgctggctgctgcctgggaacagcggtgtgccaaggaggctggagcgtgcacagtgcgtcaggctagtttgctgcgatagactagagggggtagccacacgacggggcgctgacactaggggttatgagag

SEQ ID NO: 504441 - DNA, 139 bp, Homo sapiens
gctatgccaccttactgttcacctcatcaaattagttctgcccagtgaaaagatacagccttcccatgccgtcgaggtggcgatcgtaatcgaggatttctgctagttttatacaggccatgtgtgatcaagagcgtcg

SEQ ID NO: 504442 - DNA, 129 bp, Homo sapiens
ctcagggagcacaggtggttaaaaacccgtgacttgggcagttcttccgaagagagggaccacttgaggagccagaaggactcagaacctgacgaacgtggcatcgatctgccgcacggaggggagggc

SEQ ID NO: 504443 - DNA, 259 bp, Homo sapiens
ctttattttttttcggtagagtcaaggtctctctctgttgcccatgctggccttgaattcctgggctcaagcaatcttcctgtcttggcctatcaaagtgctgggattacaagcatgagccactatgcctagctgtatgcttcatttctaaagggagtatattagtccattctcacactgctataaagatcctacccaagaccgggtaatttataaagaaaagaggtttaattggctcatacttccacatggccgggga

SEQ ID NO: 504444 - DNA, 2111 bp, Homo sapiens
  misc_feature (1447)..(1447): n is a, c, g, or t
gtgtctgtgtggtgtcgttgctgcgtctgtgctggtgtgttgggctgcgtgcggtgcctgtgtgctgtttgttgtgtggtttcggcttcttcggcgtccgctgtgctggctgcgtgcgtctcgtctgcttgtgtgtttgtcgtgtctggtgcgtgtttgtgcgtgcttctcgctgttgtttgcggcttctggcgcgctgtggcggcgcgtgtcgtgttttgtctcctgcggtctctctcttgctcttgtcgtgtctgtcgcggcgtgggtggctgctgtgcttgccttgtcgggctggctttggggccttgtccctccgcttctgtgtccttccgtgcgtcctcctccgctggcgtggtctcttttggtccctttcggtcgtccgcttgtgtcttctgcctcgtgctgcttttgctgctggcgtctgcgcgtgttggcctccgtgtgctgccttgctccgtctgctgggttgttttgtttgcttctgtttgtctttcgttttgttgttttgcgtgtttgtgttttgtgttggctctgttgtttcttggcttgttttgttggtcgcttcggttgtgttgtgtttggatggtgtttgttttgtgtgtttggctctccgtctgggtctcttctacctggtctcttctattgttgttagttctttgtgtttgtttgtgtgttggctcctgtgttgtgtggtggtttctgttgttgtgttgtgttttttcttttttgttgtgtttgttgttttggtgttgttggtggtgctgctgttgttgtgtggtgtcggtggttcctgttctgtgttgcgcccccgacatgataccttcccgtgttggtgttcatacaccactcctggttgtgcgggccagcatgttggcccgtgcgtgggtcgcctcccccggtgtgggccacataaagtcgccggcctgtgttgttgacgtccggccccgtggttctatgtctccggtggccttaatgggtgccgcatgcctcttggggttggcccgatatttgccgtccttccgttgggtctcagttcctgtgttgtgttatgtgccctgccatagtgttgcgctggctccatgtgccttgaccaaatggcctctccccgcgttgggcctattgctgtgtgcccctctgggggctttgctttctcctccaattgtggtgggggtgtttcatgagggaacttcagcgcccccgtgtgaggtggttatagggtatcctgagttccgggtatctcagtcatttgttgtggatgcctcccacggggtgtttgtgccctcgtttacctgtctaggtgcctcagggtattagggggctcagggttaggtaggaaaccctgtgctgtgccttatatgggggttgtggtgttttagaaggcctcggaactgtaagaaaagggggccccccatgtctctggcgctgtgggcgcccagacccaganaatgacgtggtgtgcccccctagaggccctggtgcgcctcagacgctggggcgctcagatcctcagaggctttgtctccaagggcccagggagtggggcctgcggcccaagggagctgtctgtgcgagggcgctgcccctgcgtgcgtgtctgtgcgtgtgcttgccctcacacctttggggcctcggtgcgtgcatggtcaccccgggggttgccccaagcctcaccccccgagagctgtctgtctggctgggtgtactatatatgtgtgggagacatgtagtgtgtgtgtgtatgtgcctcgtggtggatagtatgtgatgatagactgtatgtgtgttgtttgaaatgccgtggtgctggtgatatgtgataggtggtggagggatctctgctgtggctgtggccagtagcgcgtggctacctgggagatgctggttggccccggagattgggaccggcctggatggctgccctgcccctggccctggtgccccgggaaactgggccgaaggtgcctcggctgtcctgaaggggcatgctggcccctgccccccaccccccccccccacttggttgccccgctgctttggaaatgaatgctgggtggaaagtggtaaatgcgccctgtgccaaggaatgaactggggtgtggactgccaag

SEQ ID NO: 504445 - DNA, 331 bp, Homo sapiens
accagcctggccaacatggtgaaaccctgtctttactaaaaatacaaaaattagccgggtgtggtggtgggcacctgcaatcccagctactcgggaggctgaggcaggagaattgcttgaacccaggaggtggaggttgcagtgagccgagattgtgccactacactccagcctgggccacagagcgagactccatctcaaaaaaaaaaaaggaaaggaaaaggaaaaggaaaccaaaggttaaccttcctcaacatcatgtgagtcccaggcacaccttgacaggcaaacacaaggccgggatgtcatatccagctgttccttgtctcca

SEQ ID NO: 504446 - DNA, 1097 bp, Homo sapiens
ggtactaccccatgctccggtttgtgggtcgcgtggtcgttgccacatcccgtccgtcgctatatttcctgactcatccctgtacatgcggtctcttgctctctccctattcctcaggtacttacgaggggacctggatcctaggagtggatccatcctgtccaggttactatgcgtgtcgctatactatctctcttacgtcgcaaaatagtcagagtgtcgtcatgacggtctgcatagtgagcaggtgataagggggcagatggttggacgtcccatgttatgaatgaagggaattagacaagcaaattgtagaatgtcccctggaaagttgtcacatggcagggaagagtcagacctgagttttggaggtgggaccagtgatttgggtgatagacacagtaaggattattgctatggatggtacaagaaagtcttggtagagaggaatccacatgttatctggatccgtggatgccaccacttactatgtgcgctgatctggtgcctcgaggatcttgaggggcacaaactctcttcaactgtacagtcagtcatgaatgcttaatagatagaatagacgagttggccgctgatagataaacaaaaggaatttctgcctctcgattttcaatttgctggaagctttcgctgatctccactggcaacatgcagtggtgagaccacgtacacattgctgttggactgtgtattcgacttgcttgttctgcacgctagagtatggcttgccctatttggcggggagcggttataaccggtgcgcgatccccagtgcggatgctttggagcatttgagtctgacatcgtactaggatcagtctccgttcactccgactctattgtccgcacgagccctcctggtggttcccattggtcttggctagtgttcgattatgaagacccgactaagcgcgactcgcttcatatcacgtgaaacagttagacacgcctagtacacacgatagagtataaccgcttacgggagcctgagctttgcaaactactcactactagggttcgttccaccagcctcaccagttttcgccacagtaacaacacatgtaaaaagcagtatt

SEQ ID NO: 504447 - DNA, 342 bp, Homo sapiens
tcgagtgttttgttggtttgtttgttttgagacagagtctcgttctgtcgcccagactggagtgtggttgcgcgatctcagctcactgcaacctctgcctcccggattcaagcaattctcctgtctcagcctctggagtagctgggattacaggtgcatgccgccatgcccagctaatctttgtatttttagtggagatggggtttcaccatattggtcaggctggtcttgaactcctgacctgaggtgatccacctgcctcagcctccaaagtgctgggattacaggtgtgagtgactgcccccagttgttagaagcttttaaagcaaaactttaagtcac

SEQ ID NO: 504448 - DNA, 1579 bp, Homo sapiens
aaacttacggctaggtacgaggcctgggtgttagacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacggacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggaaaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaagcaagcaaaaaaa

SEQ ID NO: 504449 - DNA, 1816 bp, Homo sapiens
  misc_feature (102)..(102): n is a, c, g, or t
acatgatctcaggagggccatacaggctgccccattctctaagtagcctgagatttgaaattcagatcttgtgttattaagaaaactctagggtctacctcntatgagtgtgttgtagtggaattttgttcagcagaatcccatgatggaggttgtttgttaaaaaacaggttttttgttttgttttttcttttcttttcttttgtttgtgagacatgattagattcagaacctcaggctctcccactaacaggaatatgctgttttcctgacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacggacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggaaaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaagcaagcaaaaaaa

SEQ ID NO: 504450 - DNA, 1621 bp, Homo sapiens
agtatcgtgagtataaaatgaggcgccgagtcatacgtgtagtcctgaattttctaggaccacgaattctctacggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacggacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggaaaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaagcaagcaaaaaaa

SEQ ID NO: 504451 - DNA, 104 bp, Homo sapiens
ggaccggcccgtcgcgccagggtagatgtaggcgatgtccatgagggtgtagtattccttcagtggctcgtcctcgtacagaacctccaccccgtcgggtggag

SEQ ID NO: 504452 - DNA, 623 bp, Homo sapiens
  misc_feature (22)..(22): n is a, c, g, or t
  misc_feature (50)..(50): n is a, c, g, or t
  misc_feature (85)..(85): n is a, c, g, or t
  misc_feature (101)..(101): n is a, c, g, or t
  misc_feature (109)..(109): n is a, c, g, or t
  misc_feature (170)..(170): n is a, c, g, or t
attaggttccccttctaccccnactctttggccccttccctcttccccanatgggggaaccttggaatttaggacctatccccanccggaaatttaatccngtaatccnggacttaaataccatccagtggagtatgtgtgagctcagatggatgatgaccattaatttngtgtttttaatgggtatttttattcaccaaatactaatatttattcaaaagcctttttttaatttttaaaagctcattctcagagaggctgatagggaggttgtctgtgcaggaatagcgcctgtccatgcacagtgtcaagtaacctgtctttaaatattttccacatttaactggctacttttcacagtcaaatgataccacgtaaactagttctgatgatctcctgatggaaaaccaaaaacagacttcattgtttttatctttatcctagttttcttcaaattaatttttttatattaagtatttagaaagaataatggtttgtgcagcctggcatggtggctcacacctgtaatcccagcacttggaagccgaggtgggcggatcacttgagcccaggagtttgagatcagcctgggcaacatggttaaaccctatctctaaaaaaaa

SEQ ID NO: 504453 - DNA, 296 bp, Homo sapiens
caggtatcgtcagtgtttctccttgtagggctacatatatggtcccagttgcactgtacaggttgtgcactgtctactgtagtaaattggctcaaagacaataagtctgctgctgttcctgtggaatggtcagcacggtggacaccggctgccctgagatggcgtaagacacagtgatgggcatgttcactttgcgcttcttcactggttggaggacactggcctgtgccaacccgccgttccccttcccggggtgagccctgctgggatggtggtggggaaagggcagccacggt

SEQ ID NO: 504454 - DNA, 3272 bp, Homo sapiens
  misc_feature (17)..(17): n is a, c, g, or t
gagcgggctggccagcnggtccccgggaacaggaaccctggtggacgggtccagcaggcttcttcggtgcccgagagggagcgggtgcccaagggggtggtccctgtggcaggtcccggggtgggggcgcggcgctccgggaagagccttccgcaggtccccgccccgtcacgtgggcgccggccccggccgctgcggtcggtccgctggttggtcgggcgcttggtccggcagttggtcggtgggccagtggcccgtcgctcgcttctgggctctcatgtttgaaggtgggagggacacgggagcggcccgcacacctgagccgcccggagaggagcctcggccccgtacccagtaagaagaggaggaggccaggcaggcaaaaggagtcatggcttctgatgctagtcatgcgctggaagctgccctggagcaaatggacgggatcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttgaagagagcttgtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaaggagattgtgatggtcactcaagggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacggacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggaaaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaagcaagcaaaaaaa

SEQ ID NO: 504455 - DNA, 3351 bp, Homo sapiens
  misc_feature (17)..(17): n is a, c, g, or t
gagcgggctggccagcnggtccccgggaacaggaaccctggtggacgggtccagcaggcttcttcggtgcccgagagggagcgggtgcccaagggggtggtccctgtggcaggtcccggggtgggggcgcggcgctccgggaagagccttccgcaggtccccgccccgtcacgtgggcgccggccccggccgctgcggtcggtccgctggttggtcgggcgcttggtccggcagttggtcggtgggccagtggcccgtcgctcgcttctgggctctcatgtttgaaggtgggagggacacgggagcggcccgcacacctgagccgcccggagaggagcctcggccccgtacccagtaagaagaggaggaggccaggcaggcaaaaggagtcatggcttctgatgctagtcatgcgctggaagctgccctggagcaaatggacgggatcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttgaagagagcttgtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaaggagattgtgatggtcactcaagggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacggacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattgtgagtggctctctggcctagcccacctgccttggtgcaaatgggatattcagaaacttatttattaaggacaagacacaaaagctaacgaaaaaaaataggtacttcatctggaggtcttgcataatttgatgtctcaaagtattttgataatttgtccttgagaattaatatacctcatggaagcaagatgccttctggcagcacctccttggcatgagacttgaggattctaggtcgatgggttgcatggagaccaacgcttacaaggcgagggaacagcagggctgaggaagggacggggaagccgtaaaaatgcagcttcccacttgctgcaataggatccctatcactactcagatctgtcagtggcaaagccagaggggaaatgaggaagtgtggtggcttggatgtcatccagagaagatcctgagagacagcctcaccaaagaggtcccagttctctgctggcctgtgaaaacaaggtggtcagtcagcacatgtgctagtatgtgctcagagccaggccctgtgccagccagtgagtggagtgggactcagaacaagtgactgagctcctgtccctcctctggaggcacccccagccccaacaggccagtctctcagcatcctccccctcgagccatttgtatttgctcctggccaggcttgtctctggttccttcttagatcctggagccacgcttccctgg

SEQ ID NO: 504456 - DNA, 147 bp, Homo sapiens
caggaccgaagcactgggaatagttacttggtttatatcacatttgatactatccttctgaaaagtctgagacagatctacaaaccacagtcaagaattatatgattaatgaggatatgaatgcactctatttgtgctttaagcttg

SEQ ID NO: 504457 - DNA, 2464 bp, Homo sapiens
  misc_feature (17)..(17): n is a, c, g, or t
gagcgggctggccagcnggtccccgggaacaggaaccctggtggacgggtccagcaggcttcttcggtgcccgagagggagcgggtgcccaagggggtggtccctgtggcaggtcccggggtgggggcgcggcgctccgggaagagccttccgcaggtccccgccccgtcacgtgggcgccggccccggccgctgcggtcggtccgctggttggtcgggcgcttggtccggcagttggtcggtgggccagtggcccgtcgctcgcttctgggctctcatgtttgaaggtgggagggacacgggagcggcccgcacacctgagccgcccggagaggagcctcggccccgtacccagtaagaagaggaggaggccaggcaggcaaaaggagtcatggcttctgatgctagtcatgcgctggaagctgccctggagcaaatggacgggatcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttgaagagagcttgtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaaggagattgtgatggtcactcaagggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacggacgaatgctgcaatacctaactgtgaacgatttactcttcttaaaagtcaccagccaactacatcatctcagcaggctcaaacaggtaccgagctcgact

SEQ ID NO: 504458 - DNA, 2134 bp, Homo sapiens
  misc_feature (17)..(17): n is a, c, g, or t
  misc_feature (1922)..(1922): n is a, c, g, or t
gagcgggctggccagcnggtccccgggaacaggaaccctggtggacgggtccagcaggcttcttcggtgcccgagagggagcgggtgcccaagggggtggtccctgtggcaggtcccggggtgggggcgcggcgctccgggaagagccttccgcaggtccccgccccgtcacgtgggcgccggccccggccgctgcggtcggtccgctggttggtcgggcgcttggtccggcagttggtcggtgggccagtggcccgtcgctcgcttctgggctctcatgtttgaaggtgggagggacacgggagcggcccgcacacctgagccgcccggagaggagcctcggccccgtacccagtaagaagaggaggaggccaggcaggcaaaaggagtcatggcttctgatgctagtcatgcgctggaagctgccctggagcaaatggacgggatcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttgaagagagcttgtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaaggagattgtgatggtcactcaagggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagtgagtgtccagccctggtgctggtggcctctgagcagtgtccttggcactttcaatgattgtataagatccctgcacctaccaccacaatccacaattggagaatggtggggtgggtggctggaacaagttgtaccttggggtggtcccacctcnagaggctccccctgggcgagctgttttctaaggtcagcactctacagtctcagcaaaccagggtgtgtgtatcccctacttcttttcggctgcagcttttcacccttgtttcctctcttcttctcttcctcctctcgaactctttcctgtccttcctagcattgttttccctcctctcagacacccccttctacccttcctgccgctggtga

SEQ ID NO: 504459 - DNA, 1110 bp, Homo sapiens
  misc_feature (17)..(17): n is a, c, g, or t
gagcgggctggccagcnggtccccgggaacaggaaccctggtggacgggtccagcaggcttcttcggtgcccgagagggagcgggtgcccaagggggtggtccctgtggcaggtcccggggtgggggcgcggcgctccgggaagagccttccgcaggtccccgccccgtcacgtgggcgccggccccggccgctgcggtcggtccgctggttggtcgggcgcttggtccggcagttggtcggtgggccagtggcccgtcgctcgcttctgggctctcatgtttgaaggtgggagggacacgggagcggcccgcacacctgagccgcccggagaggagcctcggccccgtacccagtaagaagaggaggaggccaggcaggcaaaaggagtcatggcttctgatgctagtcatgcgctggaagctgccctggagcaaatggacgggatcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttgaagagagcttgtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggtaagggtgagtgtgtactgtcctaagctcagacctgggaaggctgtcataatgtgaatttaggccatctggtcaactcccagcctggaagctattgggtg

SEQ ID NO: 504460 - DNA, 934 bp, Homo sapiens
  misc_feature (17)..(17): n is a, c, g, or t
gagcgggctggccagcnggtccccgggaacaggaaccctggtggacgggtccagcaggcttcttcggtgcccgagagggagcgggtgcccaagggggtggtccctgtggcaggtcccggggtgggggcgcggcgctccgggaagagccttccgcaggtccccgccccgtcacgtgggcgccggccccggccgctgcggtcggtccgctggttggtcgggcgcttggtccggcagttggtcggtgggccagtggcccgtcgctcgcttctgggctctcatgtttgaaggtgggagggacacgggagcggcccgcacacctgagccgcccggagaggagcctcggccccgtacccagtaagaagaggaggaggccaggcaggcaaaaggagtcatggcttctgatgctagtcatgcgctggaagctgccctggagcaaatggacgggatcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttgaagagagcttgtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacagatatgcaatttagtcctcagattttgtatgcttaatattacatttttcccatttaaa

SEQ ID NO: 504461 - DNA, 1277 bp, Homo sapiens
tagtcttcaggctgtggaatcggagctgccaccgcccgagactccaaagcaaagcccagtttccggcgcggaagcggagggatctcaggaattgtagtccgcggggtgggcgcggttctcgcttccggccagcgggtctggcctgcgcttgcgcgggtctccgccgcctgggctcctagggactgtggcctcggcggtatgtcccttgctttcccttgaagcgggagaagacccggcagaggcgctctgtccgctgcagccgcgcgggtggaggaggcagagtctgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctgaggagccacgaccgcagcaccaggcccctctacatctccgtgggccacaggatgagcctggaggccgctgtgcgcctgacttgctgctgctgcaggttccggatcccagagcccgtgcgccagcactttgttgaacgtggtggtgagagcacacgtcctcgtctcattcctgatcgaacgcggtggtgagagcacacgtcctcgtctcgttcctgatcgaacgcggtggtgagagcacacgtcctcgtctcgttcctgatcgaacgcggtggtgagagcacacgtcctcgtctcgttcctgatcgaacgcggtggtgagagcacacgtcctcgtctcgttcctgatcgaacgtggtggtgagagcacacgtccttgtcttgttcctgatcttaagggaacgtttgcagtctttcaccactagatgtgatgtgagctgttagattttcaaggatgctcttcatccagctgaagacggtcccttctagtcctaatttgttaagtgtttttatccttaaagggtactggattttgtcaaatgcttttctggcctctattgaaaagatcctgtgttcttctgttaatatgaggtgttacattgattgattttcatatgttgagccagtttccatttgtggaatacatctaactcggtcatggtgtataatccatttactctgctgctgaatgtgatttgcttgtattttggtgcggatttttacatctgtatttataagggatattggtctggtgttttcttatgatgtcttcctttggttttgatatcaggataatattagcct

SEQ ID NO: 504462 - DNA, 96 bp, Homo sapiens
  misc_feature (2)..(2): n is a, c, g, or t
tntgagggcacatgtttatttagcagacaaggtggggctccagtcacggggtggcctggggaagcagctgcatgggtggcactgtggggagggtct

SEQ ID NO: 504463 - DNA, 130 bp, Homo sapiens
gccttttagttttgctaattgtgaaaaggaaatgctttccaggaagtaaatgccaattccttttaagtgggctttaaaaaaaaaaattttccccccaaaagaaatttaaaaaaaaaattttatttgttta

SEQ ID NO: 504464 - DNA, 1398 bp, Homo sapiens
tagtcttcaggctgtggaatcggagctgccaccgcccgagactccaaagcaaagcccagtttccggcgcggaagcggagggatctcaggaattgtagtccgcggggtgggcgcggttctcgcttccggccagcgggtctggcctgcgcttgcgcgggtctccgccgcctgggctcctagggactgtggcctcggcggtatgtcccttgctttcccttgaagcgggagaagacccggcagaggcgctctgtccgctgcagccgcgcgggtggaggaggcagagtctgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctgaggagccacgaccgcagcaccaggcccctctacatctccgtgggccacaggatgagcctggaggccgctgtgcgcctgacttgctgctgctgcaggttccggatcccagagcccgtgcgccaggctgacatctgctcccgagagcacatccgcaagtcgctgggactccccgggccacccacaccgaggagcccgaaggcgcagaggccagtggcatgccccaaaggagactccggagagtcctcactttgttgaacgtggtggtgagagcacacgtcctcgtctcattcctgatcgaacgcggtggtgagagcacacgtcctcgtctcgttcctgatcgaacgcggtggtgagagcacacgtcctcgtctcgttcctgatcgaacgcggtggtgagagcacacgtcctcgtctcgttcctgatcgaacgcggtggtgagagcacacgtcctcgtctcgttcctgatcgaacgtggtggtgagagcacacgtccttgtcttgttcctgatcttaagggaacgtttgcagtctttcaccactagatgtgatgtgagctgttagattttcaaggatgctcttcatccagctgaagacggtcccttctagtcctaatttgttaagtgtttttatccttaaagggtactggattttgtcaaatgcttttctggcctctattgaaaagatcctgtgttcttctgttaatatgaggtgttacattgattgattttcatatgttgagccagtttccatttgtggaatacatctaactcggtcatggtgtataatccatttactctgctgctgaatgtgatttgcttgtattttggtgcggatttttacatctgtatttataagggatattggtctggtgttttcttatgatgtcttcctttggttttgatatcaggataatattagcct

SEQ ID NO: 504465 - DNA, 897 bp, Homo sapiens
ggcggaaggggtgcccgggacgaagccatggccctggaggcggcgggagggccgccggaggaaacgctgtcactgtggaaacgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgagttctagccttccaggtagcaaaaccagaacgggatcttccctgcacttcctgctttgtcacagccccttctagctgctttggaaaacaggcgttgccttgcctcccatttggagccccagaacaaaacagttggattcccccacaagaggacgggccgatggcctggaattagggaaccccgggttcaccacggccggtatccttttcaaacccttgtgggtatcccacgccgccgttggcgtatggccctttgggccacttcacttatggggcaaacgttaacgttattaccgttccgattcacgtttccggacccgggccaaaccgcaaagttttggcccagggacacgttcccgatattaatggggataggtgtggcccaggcttgggttggggtttaacccccgtgtgataaagccaacgtttcaccccccaatgcagacgggaaaaccgttggagttggaaacccaatggggcactttcccacgcgggacaaagggcaacacaactttcacaggggtgccaagggggcaccccccttgcaattcgtccgttggccaggggcacacgttgggagacccaacttattccgattcaccggattctccgaaagccaaggggcacccccaagccaagggatg

SEQ ID NO: 504466 - DNA, 700 bp, Homo sapiens
ggcggaaggggtgcccgggacgaagccatggccctggaggcggcgggagggccgccggaggaaacgctgtcactgtggaaacgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggtaacctgggaggacgccgagctcgaggcgggcccctcggtgggctcgggcgtgcggtctccgggacagggagcagtgcaagcgtagaacccggcttctcgttttgtaggatgtcattaatagtctggggagttggccgggcgcggtggctcgcgcctgcggtcccagcactttgggaggctgaggcgggggaatcacctggggtcgggagttcgagaccagcctgaccggcatggagaaacccggtctctactaaaaatacaaagttagacgggtgtggtggcatatacctgtgatcccggctactcggagggctgaggcgggcagaatcgcttgaacccgggaggcggaggttgcggtgagccaacattacgccattgcactccagcctcggcaacaagagcgaaactccatctgaaaaaaaacaatacaactatcacaaacc

SEQ ID NO: 504467 - DNA, 1280 bp, Homo sapiens
ggcggaaggggtgcccgggacgaagccatggccctggaggcggcgggagggccgccggaggaaacgctgtcactgtggaaacgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggtccttcttgtggatggaaacggggtactccaccaccgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctgaggagccacgaccgcagcaccaggcccctctacatctccgtgggccacaggatgagcctggaggccgctgtgcgcctgacttgctgctgctgcaggttccggatcccagagcccgtgcgccaggctgacatctgctcccgagagcacatccgcaagtcgctgggactccccgggccacccacaccgaggagcccgaaggcgcagaggccagtggcatgccccaaaggagactccggagagtcctcaggtgaggccagcccccacaggaccacagcccaggccccaggacagccccaaggccaggctcccaggagcaggcgggcaaggactggcagtagggtggaactgggcaccatgaagacaagaaggccaccggccaccccgttctggcctcaggacactgaccacccctgggggtggtctagggacttaggggaacctcatctcagccgcaggtggagcacccagtccccaaagacaggctgaccgcaccaccccagggggacgccgcagcacagcccagcaccaggtggggcagaggtgaccacggcccctctttgctccgtcatcggctggtcagctgtggtcacggtgcctcagaggacagatctctatgggggcaagtgccagatcctgagagcgcatgagacgctttcccggagccgacgaaggggactcggagctgcagcctgcacgacccctgcagcctgtgctttgcccacccctttcaatagatggaacttgcttgctcttttttattcttctcaggattcattttttatttcaaaaaaaaaaaa

SEQ ID NO: 504468 - DNA, 1524 bp, Homo sapiens
tagtcttcaggctgtggaatcggagctgccaccgcccgagactccaaagcaaagcccagtttccggcgcggaagcggagggatctcaggaattgtagtccgcggggtgggcgcggttctcgcttccggccagcgggtctggcctgcgcttgcgcgggtctccgccgcctgggctcctagggactgtggcctcggcggtatgtcccttgctttcccttgaagcgggagaagacccggcagaggcgctctgtccgctgcagccgcgcgggtggaggaggcagagtctgaggtgtgaccccgaccaagtttgacgcttctgtcctcctagggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggtccttcttgtggatggaaacggggtactccaccaccgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctgaggagccacgaccgcagcaccaggcccctctacatctccgtgggccacaggatgagcctggaggccgctgtgcgcctgacttgctgctgctgcaggttccggatcccagagcccgtgcgccaggctgacatctgctcccgagagcacatccgcaagtcgctgggactccccgggccacccacaccgaggagcccgaaggcgcagaggccagtggcatgccccaaaggagactccggagagtcctcaggtgaggccagcccccacaggaccacagcccaggccccaggacagccccaaggccaggctcccaggagcaggcgggcaaggactggcagtagggtggaactgggcaccatgaagacaagaaggccaccggccaccccgttctggcctcaggacactgaccacccctgggggtggtctagggacttaggggaacctcatctcagccgcaggtggagcacccagtccccaaagacaggctgaccgcaccaccccagggggacgccgcagcacagcccagcaccaggtggggcagaggtgaccacggcccctctttgctccgtcatcggctggtcagctgtggtcacggtgcctcagaggacagatctctatgggggcaagtgccagatcctgagagcgcatgagacgctttcccggagccgacgaaggggactcggagctgcagcctgcacgacccctgcagcctgtgctttgcccacccctttcaatagatggaacttgcttgctcttttttattcttctcaggattcattttttatttcaaaaaaaaaaaa

SEQ ID NO: 504469 - DNA, 867 bp, Homo sapiens
ggcagacactgaccttcagcgcctcggtccagcgccatggcgccctccaggaagttcttcgttgggggaaactgaaaatgaacgggcgaagcagagtctgggggagctcatcggcactctgaacgcggcaaggtgcggcgacaccgaggtggttgtgtgctcccccctatgcctatatcgatttcgcccggaagaagcttagatcccaagatgggctgtggttgcgcagaattgctacaaagtgactaatggggctttaactggggagatcaagccctgggaatgatcaaagactggggagccacgtgggtggtcctggggcactcagagagaaggcattgtctggggggagtcagatgacgctgatgtgggcacgaaggtggggcccatgctctggcaggagggactcggggaaatcgccgtgcatggggggagacgctagatgacgggggacggtggcatcactgagaagggtttgttcgagcagacagaggtcatcgcagataacgtgaaggactgacgcagggtcgtcctgctatgagctgtgtggcccatggtactggcaagagtgcaacacccccaaatgcccaggaagtacacgagaaggcccgaggatggttgagaggccacgtctcctgatggcgggggacagaagcccggatcattaatgaggcgcctgggggactgggcacctggaaggaggtggcagcagggctgatgggatgccaccgggggggggctccctacaagcgagtcgggagacatcaggccaaaagaggccccaatttcaaacttcggcacccgggataacccagaaacagaaagggcccggaaagcagaggaagacgcccctcggcgcacaaagga

SEQ ID NO: 504470 - DNA, 715 bp, Homo sapiens
ttcggctcgaggagagagtttagagagagagttagacagagatttagagagggagagagagagagagagagggatagatttagatggagctagcctccccctcaacgcgggatttcgccatccgattacagctcacagcagtcgttgaaaagataaaatgtccagcttactaatcctggatataatcattcccgaagcactgctctgaggcaagaaacctggaattcatgctctccaggctaaggggccaccgcattggataaactctcacgcaccttccctggaccactgcacacacctaccagggtggcacggtcctcaaaaatatcccttaccttgtgaatgaccatgcatataccctgccgcgaccaccgacagtcaccataacccccctccgcgccccgcaaagaccctctgcttaccattccacaaccctcccattccgtatagataccaaggccacccacatttcccctgcgccccgctcgaccggcctcccgtcgaactcgcacttacaactctctctctccccctctcactctccgtaagctttcttccatctccctctcacaggacgcttccctgcccgccccccttaagccacatccaatcacctctttcacactgggtctctacggcacttttgaccatcgctcccctctgccattgtggctcccacccgccatgggcccctacctccattgcgcatgcttcc

SEQ ID NO: 504471 - DNA, 1415 bp, Homo sapiens
ggcggaaggggtgcccgggacgaagccatggccctggaggcggcgggagggccgccggaggaaacgctgtcactgtggaaacgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggtggtgtatgaggagagccgcatggtcagcctcacagccccctacgtgtcgggcttcctggccttccgagaggtgcccttcttgctggagctggtgcagcagctgcgggagaaggagccgggcctcatgccccaggtccttcttgtggatggaaacggggtactccaccaccgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctgaggagccacgaccgcagcaccaggcccctctacatctccgtgggccacaggatgagcctggaggccgctgtgcgcctgacttgctgctgctgcaggttccggatcccagagcccgtgcgccaggctgacatctgctcccgagagcacatccgcaagtcgctgggactccccgggccacccacaccgaggagcccgaaggcgcagaggccagtggcatgccccaaaggagactccggagagtcctcaggtgaggccagcccccacaggaccacagcccaggccccaggacagccccaaggccaggctcccaggagcaggcgggcaaggactggcagtagggtggaactgggcaccatgaagacaagaaggccaccggccaccccgttctggcctcaggacactgaccacccctgggggtggtctagggacttaggggaacctcatctcagccgcaggtggagcacccagtccccaaagacaggctgaccgcaccaccccagggggacgccgcagcacagcccagcaccaggtggggcagaggtgaccacggcccctctttgctccgtcatcggctggtcagctgtggtcacggtgcctcagaggacagatctctatgggggcaagtgccagatcctgagagcgcatgagacgctttcccggagccgacgaaggggactcggagctgcagcctgcacgacccctgcagcctgtgctttgcccacccctttcaatagatggaacttgcttgctcttttttattcttctcaggattcattttttatttcaaaaaaaaaaaa

SEQ ID NO: 504472 - DNA, 1393 bp, Homo sapiens
tagtcttcaggctgtggaatcggagctgccaccgcccgagactccaaagcaaagcccagtttccggcgcggaagcggagggatctcaggaattgtagtccgcggggtgggcgcggttctcgcttccggccagcgggtctggcctgcgcttgcgcgggtctccgccgcctgggctcctagggactgtggcctcggcgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggtccttcttgtggatggaaacggggtactccaccaccgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctgaggagccacgaccgcagcaccaggcccctctacatctccgtgggccacaggatgagcctggaggccgctgtgcgcctgacttgctgctgctgcaggttccggatcccagagcccgtgcgccaggctgacatctgctcccgagagcacatccgcaagtcgctgggactccccgggccacccacaccgaggagcccgaaggcgcagaggccagtggcatgccccaaaggagactccggagagtcctcaggtgaggccagcccccacaggaccacagcccaggccccaggacagccccaaggccaggctcccaggagcaggcgggcaaggactggcagtagggtggaactgggcaccatgaagacaagaaggccaccggccaccccgttctggcctcaggacactgaccacccctgggggtggtctagggacttaggggaacctcatctcagccgcaggtggagcacccagtccccaaagacaggctgaccgcaccaccccagggggacgccgcagcacagcccagcaccaggtggggcagaggtgaccacggcccctctttgctccgtcatcggctggtcagctgtggtcacggtgcctcagaggacagatctctatgggggcaagtgccagatcctgagagcgcatgagacgctttcccggagccgacgaaggggactcggagctgcagcctgcacgacccctgcagcctgtgctttgcccacccctttcaatagatggaacttgcttgctcttttttattcttctcaggattcattttttatttcaaaaaaaaaaaa

SEQ ID NO: 504473 - DNA, 1207 bp, Homo sapiens
ggcggaaggggtgcccgggacgaagccatggccctggaggcggcgggagggccgccggaggaaacgctgtcactgtggaaacgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggtggtgtatgaggagagccgcatggtcagcctcacagccccctacgtgtcgggcttcctggccttccgagaggtgcccttcttgctggagctggtgcagcagctgcgggagaaggagccgggcctcatgccccaggtccttcttgtggatggaaacggggtactccaccaccgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatggccctgaggagccacgaccgcagcaccaggcccctctacatctccgtgggccacaggatgagcctggaggccgctgtgcgcctgacttgctgctgctgcaggttccggatcccagagcccgtgcgccaggctgacatctgctcccgagagcacatccgcaagtcgctgggactccccgggccacccacaccgaggagcccgaaggcgcagaggccagtggcatgccccaaaggagactccggagagtcctcaggtggagcacccagtccccaaagacaggctgaccgcaccaccccagggggacgccgcagcacagcccagcaccaggtggggcagaggtgaccacggcccctctttgctccgtcatcggctggtcagctgtggtcacggtgcctcagaggacagatctctatgggggcaagtgccagatcctgagagcgcatgagacgctttcccggagccgacgaaggggactcggagctgcagcctgcacgacccctgcagcctgtgctttgcccacccctttcaatagatggaacttgcttgctcttttttattcttctcaggattcattttttatttcaaaaaaaaaaaa

SEQ ID NO: 504474 - DNA, 168 bp, Homo sapiens
aacgctacgctcacgggacacatgtgcttcttagtcctacgtcaccgcagtttacatgtccaggctcttgtggcggtgggagaccatgcaagcaagccgatggttacatttgctgccaacatcaacaaagagagcattgtggatgtcgaaggtgtcgtgacgaaaagt

SEQ ID NO: 504475 - DNA, 238 bp, Homo sapiens
atttccactagacaacatgttgctccacacacaatatattaaggcttatattaacaagggtattgagttaaataagaacatgattaaggtgatactcacttggaaaaaaaatacgttttatgaaaaaaatccccagggcctgtaatcatgtctctgtttctcaggctgtagataaaagggttcagcatgggggttaccactgtgtacatcatggaagcaggaaataaaaaatacatat

SEQ ID NO: 504476 - DNA, 944 bp, Homo sapiens
ggcggaaggggtgcccgggacgaagccatggccctggaggcggcgggagggccgccggaggaaacgctgtcactgtggaaacgggagcaagctcggctgaaggcccacgtcgtagaccgggacaccgaggcgtggcagcgagaccccgccttctcgggtctgcagagggtcgggggcgttgacgtgtccttcgtgaaaggggacagtgtccgcgcttgtgcttccctggtggtgctcagcttccctgagctcgaggtccttcttgtggatggaaacggggtactccaccaccgaggctttggggtggcctgccaccttggcgtccttacagacctgccgtgtgttggggtggccaagaaacttctgcaggtggatgggctggagaacaacgccctgcacaaggagaagatccgactcctgcagactcgaggagactcattccctctgctgggagactctgggactgtcctgggaatgggctgacatctgctcccgagagcacatccgcaagtcgctgggactccccgggccacccacaccgaggagcccgaaggcgcagaggccagtggcatgccccaaaggagactccggagagtcctcaggtggagcacccagtccccaaagacaggctgaccgcaccaccccagggggacgccgcagcacagcccagcaccaggtggggcagaggtgaccacggcccctctttgctccgtcatcggctggtcagctgtggtcacggtgcctcagaggacagatctctatgggggcaagtgccagatcctgagagcgcatgagacgctttcccggagccgacgaaggggactcggagctgcagcctgcacgacccctgcagcctgtgctttgcccacccctttcaatagatggaacttgcttgctcttttttattcttctcaggattcattttttatttcaaaaaaaaaaaa

SEQ ID NO: 504477 - DNA, 133 bp, Homo sapiens
agatagtgtctgggcaactgcaggatctgggcatacccacgccagcaaggcagcacctgttgcaagtcatgcagtaccagcctttcgctgggcaagcatccaaagcaccattgcttggcactgacgcacagtc

SEQ ID NO: 504478 - DNA, 341 bp, Homo sapiens
attttttttttttggcccctttataaataaaggatttttctttagtttgaaaagggggattaaaggtccctttttgggttcccagggtcttataaccccctgaatttttagttaaaaagtctttaaggagggggggagcccctttaaagggaaaattcccccccctctgttttttcccgtattccttaaaattgtttttttagggggagagagttttttttttccccccaaaggccgcttttttcccctttggggtttatgggttaatttggtttttaacctaggcccccctataaaagttgatactggggccgtaaactttttaaagttttccctgttta

SEQ ID NO: 504479 - DNA, 664 bp, Homo sapiens
  misc_feature (492)..(492): n is a, c, g, or t
gaaaagaagcgaaggaagtcaaatactcagggccctgcatactcacatctgacggagttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggccgcccagccactccgtcgacagccgagcgcccttccctcccaaagtcctatgggccctgggtgcaacatgccgcccacagggtccgtggtgaaccaaccgcaggaaagagtgaacttttccgcagccgagccattcagaccagcctctgggtcaaaacgtttgggtccgtcccaggtgggcagatgatgccgggcccagtggggggattggtcccatgagtctcacccaccatgggacagnctcccagagcagagctgggcccaccttctctgtcccaacgatttgctcagccaggggctccttttggccttctcctctccagagacctggtcaggggctccccagactgccgctaacacaagtccctttcctggtccggaccctgggtttcctggcctggtggtgaggatgg

SEQ ID NO: 504480 - DNA, 115 bp, Homo sapiens
accagacaaccttagctaaaccatttacccaaataaagtataggcgctagaaattgaaacctggcgcaatagctatagtaccccaagggaaagattgaaaaattattacccagga

SEQ ID NO: 504481 - DNA, 169 bp, Homo sapiens
gccaaagagcccctaaaacccgccacatctgccatgtccctctacatcaccgcccgaccttagctctaccatcgttcttctactatgagcccccttccccatacccaacccttggtacaactacaacctgagggcttctatttatttgagccaccttgtggctgaggcg

SEQ ID NO: 504482 - DNA, 271 bp, Homo sapiens
ttttttttttgcccccaaaaaaaaaaaaggggggggaaaggtttcccttttaagttcccttttctggggggaacccccccccgggggcctgttttttttggggggggggggatgccctgacccttttggggcctttttttgtttttattaaagggggggccccccttttttgggccccaaaaaaggggggtcccaaacccccccccggggggggtcccctggggggtccccaagggaaattggttttttttttaaaaaggggcctttccta

SEQ ID NO: 504483 - DNA, 598 bp, Homo sapiens
  misc_feature (34)..(34): n is a, c, g, or t
  misc_feature (45)..(45): n is a, c, g, or t
  misc_feature (50)..(51): n is a, c, g, or t
  misc_feature (59)..(59): n is a, c, g, or t
  misc_feature (66)..(66): n is a, c, g, or t
  misc_feature (69)..(69): n is a, c, g, or t
  misc_feature (92)..(93): n is a, c, g, or t
  misc_feature (99)..(100): n is a, c, g, or t
  misc_feature (127)..(127): n is a, c, g, or t
  misc_feature (131)..(131): n is a, c, g, or t
  misc_feature (137)..(137): n is a, c, g, or t
  misc_feature (143)..(143): n is a, c, g, or t
  misc_feature (155)..(155): n is a, c, g, or t
  misc_feature (329)..(329): n is a, c, g, or t
  misc_feature (334)..(335): n is a, c, g, or t
  misc_feature (337)..(337): n is a, c, g, or t
  misc_feature (339)..(339): n is a, c, g, or t
  misc_feature (349)..(349): n is a, c, g, or t
  misc_feature (361)..(361): n is a, c, g, or t
  misc_feature (374)..(377): n is a, c, g, or t
  misc_feature (381)..(381): n is a, c, g, or t
  misc_feature (385)..(386): n is a, c, g, or t
  misc_feature (396)..(396): n is a, c, g, or t
  misc_feature (400)..(400): n is a, c, g, or t
  misc_feature (402)..(403): n is a, c, g, or t
  misc_feature (405)..(405): n is a, c, g, or t
  misc_feature (409)..(409): n is a, c, g, or t
  misc_feature (411)..(413): n is a, c, g, or t
  misc_feature (418)..(418): n is a, c, g, or t
  misc_feature (429)..(431): n is a, c, g, or t
  misc_feature (436)..(436): n is a, c, g, or t
  misc_feature (442)..(442): n is a, c, g, or t
  misc_feature (451)..(451): n is a, c, g, or t
  misc_feature (463)..(463): n is a, c, g, or t
  misc_feature (468)..(468): n is a, c, g, or t
  misc_feature (471)..(471): n is a, c, g, or t
  misc_feature (482)..(482): n is a, c, g, or t
  misc_feature (504)..(504): n is a, c, g, or t
  misc_feature (520)..(520): n is a, c, g, or t
  misc_feature (525)..(525): n is a, c, g, or t
  misc_feature (536)..(536): n is a, c, g, or t
  misc_feature (539)..(539): n is a, c, g, or t
tcagaggatctcagcatcatggtgtcagccctanatagataccanaaaanntgaagatngaaagtngtnaaaaaaaaaaagggcaaagaaannaatatnnccaaagaaaaaagataaatggtagctnaaanataaancaaaancaccagttaatnaaactatacagatctaatacaaaccaaaaccagcctgaaagacccaaccttaaaagatgctaaaaattaaggcataaatctgcataatatggagttttatttccattctctcttttccctctactatgtatgcttaacctgatctgcctctaggggcttacaaaaaaacggttnccggnntncngtcttcaatntgacctcaaatntcctgagcaaagnnnnggtnatcnngctgagggtncttngnngntaancnnnagacntcattattccnnntaatncagaantaggatcgnagcgccaaattnaaatnctnccactggtacntctggaaggaattaaaactttnacagtgccttgcctgnacagnataatgttttnaanaaagaaaaccaagcaagaactataggctaaagaaggttcaaaattataaacaaacagat

SEQ ID NO: 504484 - DNA, 143 bp, Homo sapiens
cggtcgctcgtgctccagcggcgtcccgcccctcctcgtcggttgtcgccaccgccagcctcacttcccacaacctggcgcattaggagccctccgaccggcaccgcccccaagaaaaaaaaacagtgatgtgggtgcggccg

SEQ ID NO: 504485 - DNA, 122 bp, Homo sapiens
gaagtagtaaggtacacttcatttaaataaacacctgtttgtaactcttaaaacttatatattgcagaaggaaaaaattccttctatgtaatgataattttaaattatattttatattataa

SEQ ID NO: 504486 - DNA, 224 bp, Homo sapiens
gatgtggcactaaccacgcattctctatcgagctctctatgtggcatcactggtcagcgccggcccccacaacgactagataaatacaactagttatagagtcctcaggtgctaaattggcagagtgatatgtacttaaataattattattttttattatacttttaagttctagggtacacgtgcaactacgagcaggtttgttacatatgtatacatgtgcc

SEQ ID NO: 504487 - DNA, 804 bp, Homo sapiens
gtgatgctagcgaggagggtctacctatccccatcgcgggccggctagacctaccctaccagactgtaccgctatggctaccaaggctgttacccgccactcgacgtgtagatagcactttacagcggcagaagctgatggctgtgactagaatatatccgccccgaaaccagccatccacccatcatgcgctgtccatctcctacccagccccccacaggaggagataggcctgatacaggctatcatccgccgggagcatagcagtcagtcttccacggacaaccgactgctaggccgtctgccagaatagtggctctgacctgcagaggacacagctctcttatgcgacaccagcctgcaggaaacactgagactcctgatcgacggatacttgccccacgccaggtacctgaagcccttcctgcgacggattccacggtaccagacatcctggcctgccgcctgtcaccggtcgggggcaccaaccactgctgctggatccagtgcaccagccccaacgctcacacgcgacatggccacggactcttcaacggacctgtcggcgcctctccgcgcccgacagcccaacgcagcgccgccctaggagtggaacacacaaaccctccagcacacgccaccgggccataaatacacactcacgtcacacaggatacaaccaagcacaaggcaacccggaatagccacagaccaggagcaaacgaaaggcacgccctcacccagccaccagctcggaccaagaacacacatccactgggatccccagagaccaacgaaccaacc

SEQ ID NO: 504488 - DNA, 122 bp, Homo sapiens
ggcagggcaaacagaacctgtatcacctgttacgacagcagcttatggtttctcgccagaatgcttgtcgcacacgggatgcattataggatgcagctcttatccccttctgtcgtcttctc

SEQ ID NO: 504489 - DNA, 209 bp, Homo sapiens
  misc_feature (36)..(36): n is a, c, g, or t
  misc_feature (47)..(47): n is a, c, g, or t
  misc_feature (56)..(56): n is a, c, g, or t
  misc_feature (109)..(109): n is a, c, g, or t
  misc_feature (144)..(144): n is a, c, g, or t
tgcggtcccgcggttatgtttacgctccaaggtgtnactaggtgggntcctcaccnggccagttaacacttgctctgacccagaccataaatacattttcttctaatgntgctcaagctcaatcaacaataagtgagacttcgncaagagatataactttgccaggctatattaattaaacttaaaggctccgtaagacataaccgcgg

SEQ ID NO: 504490 - DNA, 196 bp, Homo sapiens
tagaccattattagacaatcattcgaactaatcagcacccaagtgctcttcactgctgcacaaaggaaaggtaagagagatagaccatacctacgctagcatcctattcaactacacccagcctccaaacacacgtgacctacttgcaagcgtaagcaaccgtcatccatagcctcttgttacacgcaggttaccc

SEQ ID NO: 504491 - DNA, 180 bp, Homo sapiens
cttttggggtctttgctacttccagtgtcaccacagagcttgttcttgtcatgagttctgccgccctttcctgagagagtccaaccagacttcgtccatccactctaggcagatgttatcttcgctgttgacccagatgcatatgcgctgttccctccttgactagcaggttgacataca

SEQ ID NO: 504492 - DNA, 175 bp, Homo sapiens
tcagcccacaaagctcagattgctaagtgaatattatcccttatacctgccaccccactcttcatcagtgctgcaagaacggtctctgaactgtgcgtttcaatcggccattttagtctagtcctacaagactggttgatgataacgatgcatcgtacaagcttcagaaggattg

SEQ ID NO: 504493 - DNA, 228 bp, Homo sapiens
tggcgacacgtatagccgaccgtattgaaaaaaaaaaaaaaaaaaaaaaaaaaaaaaaaaaaaaaaaattcggggtgttgtttgggggtttttccgcggggttccccggaaaaattaaagggggggggttcttttggccccccggaagggggccccgggggaaaagccccccgaaaacaaatttgccccccccccgtgggggcacgaaccacatcttgttcttcaaaa

SEQ ID NO: 504494 - DNA, 186 bp, Homo sapiens
  misc_feature (179)..(179): n is a, c, g, or t
aagtagatagcttgcatcctgacaccgtggcaaagttaagaaagttgaaggagaaacataccttgagagggggttttctttaaaactagtgttagaagcttagggatttttttttttattccttactaactttcacccagaaccgctctatttgacttgtgccgacattgcaaactttntgacagg

SEQ ID NO: 504495 - DNA, 765 bp, Homo sapiens
  misc_feature (441)..(441): n is a, c, g, or t
agcggactctgctgaaagactgagatgcgcacccgggcgggcacctgggctcgtaccggaacaggatcaggatggacgatgacatgctaaccagcctgaaagatcctcatcatcggcgtacaatggggtgggcaaggtcagccttggatcattgaggttcgataggatgatacgtttgatcggagaatttgcgaggaacagatagggtgttgactttaaggtgaaaacgaatttcgaggtggatggaaataaggctaaatttgcgaatatgggatactagtggtcaacgagaggtgtacgaacgattaacgtccgcagttattatagaggtgcacaggggtgttaatattagttctcatgaatgtcgtacgcaagaagcagcatacatttgtcaaactggcattaatgggaataaatgcaattagggaaacatgctgtcanacaggaaatgcatattagttaaacatgctcagtttgggaacatcaaataatcgcattacaggcaagaatctgtgaaagatccagatagaaattgaaggcctgcaagatttgcagcagagaagcattccagtgttcattgtagtagaggcaaagtgcagagaaaccatgtgatggtgtacaatgtgccttttgaagaacttgttgaatagatcatgcagaccccgtggactgtgggaaagttgagaatcagaataaaggagtcgaagctgtcacgacaggtcatgaagggcatcgaggaggagcctgtgggggtaatggtcctgg

SEQ ID NO: 504496 - DNA, 248 bp, Homo sapiens
gatgtatcgcccaacaccatgccggtaatttttttgtattttagtagagacaggtttcaccatgttggccaggctggtcttgaactcctgacctcaagtgatctgcctgctcggctcccaaagtactgggattacaggcatgagccaccgtgcctggccagtttttgactttttggagagatggggtttcaccaatgttgtccatactaggtctacaaattctatgggctataagcagtctagcctgc

SEQ ID NO: 504497 - DNA, 193 bp, Homo sapiens
ttagaggatccgtggcatttcagcagtgcttgttcttctgctggagctcactcccagtgcttccttctgccaggtacattcccatgaaatccatgcaaaagaacatcccctttccggccctgccttgggtcctggatccctgctaggtgccccttgacacgtccagtgctcctccatggggacaggaacaagc

SEQ ID NO: 504498 - DNA, 92 bp, Homo sapiens
aggaaaaggaaggggagggaagcttcccaaaagtagccccaacctgggcttttgggcattattttgagaataaatttttgtttcaaactgta

SEQ ID NO: 504499 - DNA, 542 bp, Homo sapiens
  misc_feature (54)..(54): n is a, c, g, or t
  misc_feature (440)..(440): n is a, c, g, or t
tctttgaaagtcttagccaggcatggtggctcacagctgtgatctcaggacttngggaggccgaggccggaggactgcatgagccctggagtccaagaccagcccgggcaacatagggagaccctgtctctacaaaaaaagtaaaaattagccaggtatgatggcatgtgcctttagtactagctacttaggaagctgaggtaggaggactgcttgagtctaggagatcgaggctgcagtaagccaagattgcaccactacactccagactgggcaacacagtgagactcctgacctcgtggtccgccggctttggactcccaaagtgcatgggtcagaactcctttagttatatgatagaaacttcatgcaaacttttggcttaagttaaaaagggtattcattggcattggcatatggaatccaaaaggggactgatngattgggaagagcattgagtcagctgggatttgggagcaaccggaaccagacccatttggatgctaccagtaatctctgtcaacagccctgctattttcccc

SEQ ID NO: 504500 - DNA, 716 bp, Homo sapiens
tcactactgttctaggggactgctgtctcttggttccttttaggttgtgttaggatgtgcacaagtaatcatttaatgttaaatgcacagtgtccaaagaaatgcagtcttaccagttctctggtcatatttcactttagcagttaggacaggcagacagctaacctgacttccattttacaacatcattagacaacttttctcttcagtaacaaaaacagggcaaggacaataacagccatgaactatttgctttatgtctgttctttaacaaacatcaatcgttctggaagtttgcttattagcttaataccttatagtacttttaaaaaatcatccttggtaattatgacttatcctagatccatgtacaattcagacttttatctgttagctttaataaaaatttaaaacatctcatttcagaatacactaacggaattacagttcatgcattagcatttttaagtgaacgttctcttaataagatgcttttgtctaaccgaaatagggcatacagattagttcggatgggcaagtggtcaagaattgagttttaaatactgtgcctatttccaaaagaagaccgatgtggcttttacatcatgctttacagagtcctggggatacctagtcttaacaaattgttggcgtaagttcagcggaaacggtgagaattatgctgagtatgtcacaataattgaactttgctgcta

SEQ ID NO: 504501 - DNA, 295 bp, Homo sapiens
tggtaaagtaataaaatcagtacaatcactaatctttcctttgtacactattatttggcagtatacgatgaatatcactaatcagtttgattattctcagagggtgctgctctttaatgaaaatgaacattatagctaatgtctatacctcaaactctgcttccggtaaccaatcagtgtataaatgttagttgtcgttcttctataaaatttaacataccaattcgttattctagtttgccaactgtgagtatgatatgtagaacatgatagtcacaggcacgacatgttcggt

SEQ ID NO: 504502 - DNA, 1399 bp, Homo sapiens
  misc_feature (370)..(370): n is a, c, g, or t
  misc_feature (572)..(572): n is a, c, g, or t
tgtgggccaagcttgaggcttgaaataaagcctttggagtgccacaaaaggggacgtgctgtgaaaaggtggcacagttgggcaccttataccttggggtgaccccattacgtttgggtggccacatgtgctttaagccattacacgtgtggtacacattgtgacatagtgggagcttctgggtgaaagaggtgataagtggtggcgaagtggtcttatgttagaactataagagaaagaaacatctgtggtaatattattcttttatcctatttttttaagagtgttcgcgtagatattctcgtgaaaagtgtgtctgtgtataatagaggtcttttaaatgcgtggcgtgctcttaacaagtcgtgancatgtataccccccgaagtgtggtcaatatgtggggatctcatatgtgagattctggagacacaaggaaatgtctggggttaaggagatataaagatctcttaaaaggcaagtataaatctctgtggctacaaggtggtgtgggatatatgtgagatattctctctctgtggcgaaatttttatacgtgggggtggacaacnaaagaaacatcgttgtggtgcttcttcccaaacccaacaatgtcggcggcgggctcaatttttctctgtgtgagagtggctccacccatattgtgggggtgggcgaaaacaaggttacaaaaagtggtggggctctctctatctcccctgtgtgtgcgttgtatctctttatcaccccatgaggggtggttccatacccctcccgtgttgggggccccacccccctttaaaaatcttctttgtccacaaagggggtgtggctactaaacatgttaggggtttcctcgtcccctaattttcacaccgcccagagaagaggggttattcgcccttcccgtgaaatgaagggaggagggcaacaacccccgggtgcccacaactttggcgggggcaacaacttgagttcctcgtggagaaagttccccgtggggcggaacttatcagcctttttaaagccaccctctttccgaagttttattgggccttttgttgctcccccacaaaaattttttcggcggggcgcccttttttcacagggggcgcccaggtggcacaccacttctcctcccagggccaagcgacacgggtccttttgcacacgcggctctgttccttcaagcacttttttcaaccagcgaatcgtgcgtctgtcttttcatctacaaccacatcaacggctgtctcgcggtgggcaaaactcctctttattcaatcccccccaagttttgtgatgatcagcagcccgtttttgccaagcggttcttcacatatgacgctcctaccgtgtggtctctcacacaaaaacagtcctgccgtcagctgtgcgc

SEQ ID NO: 504503 - DNA, 121 bp, Homo sapiens
gtattggggatgaccgtgcacaggcccaaaactccaaatggaacacatgatctaacacatctgttctggtgagacaccacgaaaaatatgactgaaagttcaaaatgtcctaatgtgtagt

SEQ ID NO: 504504 - DNA, 362 bp, Homo sapiens
  misc_feature (138)..(138): n is a, c, g, or t
tgtgtcggagaccaagcgcgtgccaccacgtgtttgtgtcaggtatgtctgcgtgtttgtgcctgcacagcgaaacccctcacctggcatctgaagcttccccttgtggccgccacctcgttttccctggctgccgcnctgcccggaaagaactaactcggggcccctcagctggacagtggcagctacgggttcagggttgtccctcaccttgcagctgtctgtggccttctaggctgtcctctaaatccagcccagggggggcggtgcatgtgtaggcgtgtgtgtgtgcatgtgtgtgtgcactcccacgtggacctctctccttccaccaagtcagaataggccagaaaggaccccag

SEQ ID NO: 504505 - DNA, 473 bp, Homo sapiens
ctggtagcagtgtcactgtcggggagcgagattccggagagattacggcaatgccgtgcagagactaaggattcggccgagagaaggtaggtgtcactaacctctgttttattatctgtatttaaaatttttttggtgttagagactgggtctcactctgtggtacaggctggagtgtagtggtgtgatcatggctcactgcagcctcagactcctgggctcaagcaagtcctccctcctcagcctcccgagtagctgggattacaggcatgtgccaccacgcctggctaattttttgtatttttagtagagatggggtttcatcatgttaggcaggatggtctcgatctcctgaccttgtgatccgcccgcctcggcctcccaaagtgctgggattaccggcgtgagccaccacacccgggtgatgaggttaggcattctaagtcacgggatgagacaggaagtcagcacaa

SEQ ID NO: 504506 - DNA, 932 bp, Homo sapiens
ggccgccggtcaccaacagacgcaggagtcctggagctgtgaggagattcgggagcgtcacccgtgagctcgccctgcgtcccggcaacgggcgcttctgtcacttggacccattccaacaattctcgtgaaacatggtggattactatgaagttctaggtgtgctgagacgtggcttgcccgagtgtattaaaagaggcatatcggaaagtggtagtgaagtggtatccagataaaaatccgtgagaatacatgaagaagctagagagtaaaattcgatgcaagtagcggaggcatatgaagtgctgtcggatgcctaaggaaacgggacgatcgtatgacaaatagtggcgaaacgaaggattaaattggtgtggagcgagggaggtcggaaagtcaattgtaagaccagtcctatctctgaatctggttccctcactatccactgtaaaccaccgaggatgaatagtcgttcaagtggtaatcccctgcgcgcaagggacccatacttcgatttggacctatcattttgcaagcaccgctctatgagcgcagttctctcgtgaaatctggaaggggtcccctgatgcaagctagacagccgacgcgacaggccttccgccttcatcctgctgcagtgccagtgaaatttgcgcgttcctgtcagccaaagctggactcttacatctgtttggatacaagtgaatttctccttccatgtttgggctccacctactgtacaccgggaggaaccttccaacttcaattctcattcccacgctccaatctggtgcgcccacagcggcatggcgccacagcttctcacactccggacatttcaactttcccactcagacattgctctaatggtccacaaaccaatcaacatacaaaagagacactgtccgacaaccgcccacaacaccagcctc

SEQ ID NO: 504507 - DNA, 159 bp, Homo sapiens
  misc_feature (47)..(47): n is a, c, g, or t
  misc_feature (57)..(57): n is a, c, g, or t
  misc_feature (92)..(92): n is a, c, g, or t
gcacggcggcccaccacgcacggagaaggtgatcccttttccttgtnttgtcattgnctcagctcgaagtctcctcacggtcgatcacaacnatttctaccgtctctctaactgcaaacttgctctggtctcgaactcatccttctccggtggcgtggt

SEQ ID NO: 504508 - DNA, 313 bp, Homo sapiens
  misc_feature (99)..(100): n is a, c, g, or t
ctttaaccccggggggtgtggttccccccccggggggggggttccttttttgggacccaggggggtccccccttttaacaccccccctttcccccaggnnccccaagggggggggtgggggggggggccttccccccaaaaatcccccgggttttgggggcaaaaaacccccgggccccccccccttttttttttggggcgggggggggggttttttaccccccttttgggtttttttccccccttggggccaggggtttttgggggcccccctttttggggtttggggaaatttaacccctttttcccccca

SEQ ID NO: 504509 - DNA, 758 bp, Homo sapiens
  misc_feature (672)..(672): n is a, c, g, or t
tggccaattcagttctttacgggagtggaagggcgggggacacaactcctttatgaaaggaaaccgagggccacttctccgggccccaatcgggggcgtcaatccagccgctgctccggtgcggttggggctcaggccattcttcttccttgggggggccccgggccccgggcctcgcccaccatccggggaagccccttcggggcccccgctcgggcctggggctcccggggactggtcctgggtctggggaaatcttctgggtcacaagggcgacccctgcctcgatccatttcccaccgcttccgtttccgccctggagatctgggcaacgccgtttctggctgggcctcggggaacagggtcctcactggggcgcctcgcccaccgccgggcagaaatactcgatgtcatcatcttcctgtcatcatcgtcctcacccaactccaggctcgccgtccttgaaggggatcccagaggcctcttcatcattacccccgaccggtgccttcttaatgccctccaggctcttctttctggggggcctcccgctgcctcctgttggcgctgcacattcggggcctgctgggcctgctctgggccttcagcgcagttcttctccttggtccaggagggctgaagtcctcctccgcttggtcaacaaactgtggnccctctttgcctcccgagcctctggacttgatgactgagcgcaccggggcgaatcgggggcgattgcgttgtgggccgttgtgcag

SEQ ID NO: 504510 - DNA, 203 bp, Homo sapiens
  misc_feature (97)..(100): n is a, c, g, or t
cagggccgcccagaagccctggggctcatcatcgcgatcgcccatgccggcctgcccgctggccctggccgtcgttttcccccgtcgaggctgggcnnnncccccccccgccctcccctccttcccgccctgctcctacccctttccctgggtctctctcttcccctcctccccgcctccccgtccttggcgtctcccttccc

SEQ ID NO: 504511 - DNA, 149 bp, Homo sapiens
tgctcggacctctccctacgtatctagcagcagcggagatgtgttaatgaacgggaaatggagacaaactgaaacaacttataaaatgttactttgaccaagtacgactgactagctttacttcctatcattaggatacagtagggaga

SEQ ID NO: 504512 - DNA, 765 bp, Homo sapiens
  misc_feature (354)..(354): n is a, c, g, or t
  misc_feature (492)..(492): n is a, c, g, or t
  misc_feature (557)..(557): n is a, c, g, or t
  misc_feature (598)..(598): n is a, c, g, or t
  misc_feature (648)..(648): n is a, c, g, or t
  misc_feature (672)..(672): n is a, c, g, or t
  misc_feature (687)..(687): n is a, c, g, or t
  misc_feature (698)..(698): n is a, c, g, or t
agcgggcgccgctgcggctgctgcgcggtgaggtcgtgacaagtcacagctaacttgccctccgcgccattccacgccaccaggaagcgcagccggtgcctctcggcatcggcgaagaggccttgccggaccggcgcccagccctccaggctgtcgagctgctcgtcctccatggccgtcggcggcagcggccctaggactcggcgggcgcgggcctgacctcgtcgcactgcctgtcaggggacagtcccaggcataactgaaggtgaaaggacagaatcaccgtgtgttactggcacagatgcatcggctagtgaagaaagaagacattcaaactagtcccgctctgtcgcncagtctggagtgcagcagcgccatcatagctcactgccacctagaagccggggtgaagcaatcctcctccatcagccttcagagtagctgggactacctgcgcggcccaccacacccggctaatctttgtggtttttnttttgttttccgttctgggtttccgtcgggcgcagtggctcaggcctcaatcccagcactttganggcagaggtggcggatcaccgagtcggagaccagcctgacnacatgaagaatccgtctctactaaaaaaaagaaaaaactcaaattagcgnatatgtggctcatgcctgtatccnagctactaggagccnagcagagatcncctaatccggagccgagtgcgtggcaagatcacacatcactcgcctgacgagggatgaccggtcctt

SEQ ID NO: 504513 - DNA, 865 bp, Homo sapiens
  misc_feature (176)..(176): n is a, c, g, or t
  misc_feature (861)..(861): n is a, c, g, or t
ggcttctctttcggagggagtgttcgccgccgccggcgccacctggagttcttcagactccagatttccctgtcaaccacgaggagtccagagaggaaagcggagcgaacacagtactgacgcctcttcagcccgggtatcgccccagcggggatgcgcgacaagtatctggtctngccttcccgcgtgctctttctgccgctctgccttcgggtgctgctgctggggggcggtttcacaccttccctcgataggatttcacctttacctttcccgccgcaagaaggagtggttctaccagccatgccctgagggctcgtggagatcgagtaccagtttcagatggcgcggattaagatatggattccattcttggcctctccagagggcaaaaccttagcttttgggaaccaacagaaaatcagatggagtccacactgtagagactgaagtggggagattactgtctgttttgacaatacattcagcaccattcctgagaaggtgacttctgtgaatactcctgattacatatgggagaccgggcacagaacaagaacgctggaagcaatttttctgcccaagatattttgctatgaactggaaacttcctggaatcatcacccgctcacggtcagactaagcaagtggccactacaactcgggtagagctttgagcccggcgaccttaacgaagccttggaaggacctggcctggcacaagggggggggggcccccacgttgcgagactgtggaaagaggcactacccacagcgctgagggactacgcggcaagtccatgataaagaattgaatcgtcgcgctggagctccacgctacggtctgtataatatctttgnggcg

SEQ ID NO: 504514 - DNA, 449 bp, Homo sapiens
  misc_feature (8)..(8): n is a, c, g, or t
  misc_feature (36)..(36): n is a, c, g, or t
  misc_feature (126)..(126): n is a, c, g, or t
  misc_feature (151)..(151): n is a, c, g, or t
aagaccgncacctggcctagccaatcacttcagtantaagttcctgctataacttatgtttgctccacctatctaaagctacctctgtaggtattagaccgacactatcacatatgttttaattcngcctgttatcagcagcagaaggtancctggaaaggggatttatggcattctgtttcctacggttggtcacaccacaaacaaatgaagcagcctccacagttaaggtttgtctacaacaacaccacacaatgtcagttttcaggtatacctttctcatgtcattcataattaagcaatgtcaacaaataacactgctgggtaacatccctcaagtatttagtctgccagaccttttctgaaagtatagtaagacaggcccacaatacaagcccaagtgctttttttttctctcgagacagggtctccctctgttgcccaggctt

SEQ ID NO: 504515 - DNA, 351 bp, Homo sapiens
tccactagtgtaggcaacaagagagaagctccatctcaaaaaaaaaaaaaccaatttggggggccatggcgggacacggttgctaatccttttaatcaaaacccttttgcggggggccgggaaacctgtttgcccccaagagttggaccccagccggggtaacacagtgagaccccttctttacaaaagctttttaaaatttatccgggggccccagggggggggctcacccttgtaatccaagcttttgggggggctgacccgggcaaatattttggggtcgggagttcggggccagcctggccaacatggaaaaaccttgtttttattaaaattccaaaatttgcccgg

SEQ ID NO: 504516 - DNA, 561 bp, Homo sapiens
cctgcagtcctgacccatcttataacagactcatctgtatagctaagccactcgcgtctatgacccattaattccattgattcatgaatgggttgagtcaattcagtgagggtagagccctcatgaacacaattacctcccagaggtcccacctcacagtattgctgcactggtggactaagtttcgaagacatgaacttgggtgggaacgttcaagccacaacaagcagataaagagaatgctgagaatggcacagcacccactgtctcacactaggtgactctccttagggcatggccttcttgtatcctgagtcgcatcttgcaattctacactaacttttacggggtaggatagtcagtagactccgcactctgtggttctaccggaggttgctctccacctacttaaccaaggtttggatgggctcacggaataattgtgtttactaggtactatgcactgtgcaagggttcccaggtatgatgctacataggaaagatgtgattcctgtcgtcctagactttgcctcattgggatctatttagctgaaagagctt

SEQ ID NO: 504517 - DNA, 847 bp, Homo sapiens
  misc_feature (257)..(257): n is a, c, g, or t
gtggatacaaggatgtggagaggggaaagactcccccattcctttccctcctccctcgtcatagaaagtgaggaccaaggcacccaaggtctgaccatctgtgtctccagagctcctgcatgtgactaacctctgtgtaaacttctccaaactgcacaccctgggtgacaggcccctgggaggcctcaagggacaccccttctactactatgccttctatgagcttgtagccaaaggagttgcctgtgccttggganacctctaagtgcaggtctgcacctggaaccccagccaatgtggtgaggacaatgggaggggcattctgttgctggtggggtgggcaagctgggactccagagcaggcctgccttgccctcctccctatcaggtacatgggctttgcatctgtccccaccagtcggtgcacactgtgagtgctgccaagacctgcaccaggatcatccatgacatgcagcagagcctgggcacccccatgcctgctgggatgaatgccatgctctactctgcctggccatacctgccacaggtccgcccaccccatatctacctttctggttctgcctcagaatgtgagtgccatgggatgtctacagttgtcactttgacacagctgtgtgtctggttatgtgagtggaggtgtgtgtgatgtgtgtcagcacaacacagctgggcgccactgtgagttctgctggcccttcttctactgtcatccctgagaggatccctgttcccctcggtcctgcagacatgagtccttcaacccctaatcccaacactgactcttatccttcagctccatggtgacctctgacctaattccatcctt

SEQ ID NO: 504518 - DNA, 1187 bp, Homo sapiens
  misc_feature (699)..(699): n is a, c, g, or t
  misc_feature (703)..(703): n is a, c, g, or t
  misc_feature (711)..(711): n is a, c, g, or t
  misc_feature (715)..(715): n is a, c, g, or t
  misc_feature (720)..(720): n is a, c, g, or t
  misc_feature (725)..(725): n is a, c, g, or t
acaagggtttgtatttagtgcgggagggatcctgaaccgcgcggccgaaccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaatggaggccctgctgggcctgcgtggcctgtttcctgcagacccctaacggtccccaaacagtcgtggtgacttggcctgaccctggtgtgcagctcgtgccccgggcccccctggagctggacctgacgggcgacctggacgagcttcaagaagcacgtctgtattgtgctgaaggacgggtgttggagtaccgggataaaaatctctttccgggttaaccgagagatagtgtccggcattgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgctttcacagacgacgacaagaccgaccacctgtcctgggagtgaaatctcaccatcangaangactggangganctgancccanacagagggcgggcacaggcacacctgaccggacggacgacaggaccggcggaacacatgcacacaacaaaagcacaaaaacacaacagaaacaaaccaaaacgaacagagacacaacgaaacgaaacgacaacacaaaacaaacaacccacaaatcgaacaccccccacccacacacccacagagctacaacagacaggccgcaccgcaccaccgccgacgtagagcagaacaccgcgacacaccgacgcccagcagccgctgacactcacgtgagagctgagacgaagccggagggagaccaggacggcacacgagagcatacggccaccaccaacgatgacagacagacaacaggcgaggagcaagaagagagagtgcagaaggaggtcaagctacaatcggtaccagacagcacgtaggtagtcgctagctagagagcacggaacaacactacagaagg

SEQ ID NO: 504519 - DNA, 818 bp, Homo sapiens
gcccgcagcgccggagtcaaagccggttcccggcccagtcccagtccgtgctagcagtctgccgtcctcttgtcagacatggacagatggcgctgtgtccttctgccgaaggacttcctggcaggtggagtggccgcaagactatctccaagacaggcggtagcagcccatcgagcgggtcaagctgctgcatgcaggtgcagcatgccagcaagtcagatgcacggcagataagcaatacaaaggcatgatagactgcgtggtccgtattcccaaggagcagggagtgcgtgtccttcgtggctgcggtaacctggccaatgtcatcagatacttccccagccaggctcttaacttcgccttcaaatgataagatagcaagcagatcttcctagggtgcgtgtggaccgagagaatcgcagtgtttggcgcgacttggcaggggaactctggcatcgggtggatgccgcagggggccacatccctgtgttttgtgtaccgctcttgattttgcgcgtacccgtctagcagctgatgtgggtaaagctggagctgaaagggaatgccgaggctcggtgagtgcctggtgtaagatctacaaatctgatgggatgaagggcctgtagcaaggctttaacgtgttggtgcagggtaatgatgatctagcgagccgctacttcggtatctatgacctgcaaagggaatgcgtccggatccaagaacagtcaattcgtcatcaggggatgatcgcacagaatgtccctgctgttgcggggttgatccctatcatttgaccccgttcgccgcggcttggattg

SEQ ID NO: 504520 - DNA, 159 bp, Homo sapiens
atccaccaacttcaggctctcacatgctgggattacaggtgtgagctgccatgcctggcccttcttagagcggtcttgctttgttgccccacctggagtgcagtagagtgatcatagctcagtgcagccttaaactcccgggctcaaatgatcctccca

SEQ ID NO: 504521 - DNA, 1284 bp, Homo sapiens
  misc_feature (796)..(796): n is a, c, g, or t
  misc_feature (800)..(800): n is a, c, g, or t
  misc_feature (808)..(808): n is a, c, g, or t
  misc_feature (812)..(812): n is a, c, g, or t
  misc_feature (817)..(817): n is a, c, g, or t
  misc_feature (822)..(822): n is a, c, g, or t
gacgggctatcctcgctgcggcgcggaggccccagcccctggaggaatgcagggctggctggacccctggcctggtgtgtccctgggtgtgctgctccctgacccacctcccacgctgccgggaagtgatctgagcctgacagatcccctccggtgtcccgacccaggctaagcttgagcatggctgagcaggagcccacagccgagcagctggcccagattgcagcggagaacgaggaggatgagcactcggtcaactacaagcccccggcccagaagagcatccaggagatccaggagctggacaaggacgacgagagcctgcgaaagtacaatggaggccctgctgggcctgcgtggcctgtttcctgcagacccctaacggtccccaaacagtcgtggtgacttggcctgaccctggtgtgcagctcgtgccccgggcccccctggagctggacctgacgggcgacctggacgagcttcaagaagcacgtctgtattgtgctgaaggacgggtgttggagtaccgggataaaaatctctttccgggttaaccgagagatagtgtccggcattgaagtacatccagcatacgtacaggaaaggcgtcaagattgacaagactgactacatggtaggcagctatgggccccgggccgaggagtacgagttcctgacccccgtggaggaggcacccaagggtatgctggcccggggcagctacagcatcaagtcccgctttcacagacgacgacaagaccgaccacctgtcctgggagtgaaatctcaccatcangaangactggangganctgancccanacagagggcgggcacaggcacacctgaccggacggacgacaggaccggcggaacacatgcacacaacaaaagcacaaaaacacaacagaaacaaaccaaaacgaacagagacacaacgaaacgaaacgacaacacaaaacaaacaacccacaaatcgaacaccccccacccacacacccacagagctacaacagacaggccgcaccgcaccaccgccgacgtagagcagaacaccgcgacacaccgacgcccagcagccgctgacactcacgtgagagctgagacgaagccggagggagaccaggacggcacacgagagcatacggccaccaccaacgatgacagacagacaacaggcgaggagcaagaagagagagtgcagaaggaggtcaagctacaatcggtaccagacagcacgtaggtagtcgctagctagagagcacggaacaacactacagaagg

SEQ ID NO: 504522 - DNA, 647 bp, Homo sapiens
ctgatcttgaacttaaaacctcaagtgatgctcccctatctgcctcccaacactctgggattacaggtgtgagccactgcacctggctcttatcttggcttttgacatgactttctcactgaggttaatcatttccagcttttgatctaaagtgagaaatttgcaactccttctttcacttgaacagttagaggccattgtggggtaatgaatggcctaatttcaatattgtccctcagggaattaggaggcctgggaagaggaggagagaggggagagtggccagttggtggagcagtgagaacatagcatttgttaagtttgctgtcttcgaaggttgtggtttgtggtaccccaaaacaattaaaataggaacatcaaagatcacagagcagccgggcacggtggctcacacctgtaaatcccagcaccttgagaggctgaggtgagtgaatcatgaggtcaggagtgcgagaccagcctggccaccatggtgaaaccccgtctctactaaaaatacaaaaagttagccgggcatggtggcaggcacctatagtcccaggctattcaaggaggctgaggcaggagaatcgcttgaatccaggaggtggaggttagagtgagctgagatcacaccatgcctcccg

SEQ ID NO: 504523 - DNA, 147 bp, Homo sapiens
tatgggctctggtgcagggcggtcggctggtcgttagtgttgtccactcagcttctcagctaggcgtgcatgcagtggcccagttgggttctttgccatgctggcagggtgcagcaccaatgcacacatcccgcaacaccccattgt

SEQ ID NO: 504524 - DNA, 297 bp, Homo sapiens
  misc_feature (83)..(83): n is a, c, g, or t
  misc_feature (95)..(95): n is a, c, g, or t
  misc_feature (119)..(119): n is a, c, g, or t
  misc_feature (122)..(124): n is a, c, g, or t
aatgggaggtgattcctaggggttgtttgatcccgtttcgtgcaaaaatggaggtggagtgctgctaggctgcaataatgaanggcaagatgaantgaaaggtaaagaatcgtgttatnttnnnaggacatgtctactgagtagcctcctcagattcattgaactaggtctgtcccaacgtatgggatggcggatagtaagtttgtaattactgtggcccctcagaatgatatttggcctcacgggaggacatagcctatgaaggctgttgctatagttgcaagcaggaggataatg

SEQ ID NO: 504525 - DNA, 184 bp, Homo sapiens
ttccctgcttctggtcgcctctcgacggctcccccgctgttcgactcctcgtactggctttgaccgaacggcgtgggtacctgactgtgctgtgacctgctacgtgtgtgtgttggttgctgcctgacttgtaacctacttactgacgtcctacgtctgaccttgacacgttggcgaccggctc

SEQ ID NO: 504526 - DNA, 624 bp, Homo sapiens
  misc_feature (66)..(66): n is a, c, g, or t
  misc_feature (256)..(256): n is a, c, g, or t
  misc_feature (305)..(305): n is a, c, g, or t
caccaaaagccacagcggttgacaacgcgattttctgcccattggtcacccatttcgcgacgatgnctcaagttccgctgtctccgaaccgctgcttactcgccgattggtttcgcgggggcgaggccgctttgacacgaagccaaccagggtccgccgagtacatgatgctcgccgcacagagggccaaggcaacaccacgatcgaccttttcctcgtggagaaggccccggccgactagcctccctcgacgcgntcgccgacgctaccgcaacccggcatccgcattgacagttaccacgggnagtgcgagacatacttcggggaggcgctcacgctggccgccggggctagccttttcgtctttcttgatccgtgcggagctgtgctccccatggcctccatcagaaagatcctccagcagaggggaacgtggccgcgtaccgaggtgctgctcaatttcaacgccgatctgattcgccgcgttggtgggcagctgaaaatgggccagctcgaactaggcggcgtcgcacaggcggatgaggtgtgcggcggcgtttggtggcgggacgtggccctgcaggcgcattacacatccggtggacagacctgggaggcggccgc

SEQ ID NO: 504527 - DNA, 229 bp, Homo sapiens
cgtagtcttagaagtatcaatagcaaaaacaggttttctagatgtcagtggtactcaaagtctgctagatccgttggtgcaggcagcatcagcttcacttggaaacttgctagaaatacggatctcaggcccaggccccgcccgaggcctgctgaataaaaaggcctgtggtggggcctggcagcgtgtgtttaaaggaaggcctcctgagatcgccgctgatgccctg

SEQ ID NO: 504528 - DNA, 912 bp, Homo sapiens
tggttaaaaaaattaaaaggggttttccttccccttgcttcaaggggaaaaattttgggcattttttttttcccgttaattatgttggatgccatacgtgaatatcaacaaaaagctggatttgcccttttttcacataatataaaaaaattctttcatctcaacaaaaacaacacaaaagggggcgcacatcctaataaagactcccctaagacgggcccccatcctctttcgactgatacccccatcttgatatgcacagacgggcgcctccttattatggagtcgctctcttctcctgacgcactagcgaccgcggcggcgccgtcctgtactacaccacgccctccgtgcgagagcgagagagaagaccaggtgtcaaatcgctggtgagacatatctgtgtgtgggagagacagagacaccccttacatacttctgtgcgtgagcgcgcgtgacacacacttactgttgtgagacgacacaatacactcactgacgaccgagcaaactaaataaccacgcctctctcaccaccgacctacactatatcctaacacgtcccagacggcggtgttctaatgtgtggtgtcaccacaccccacgcacttgactactacacttcaccgcgggcccactggcatgattgtcggttacatcatagagagtagctctctcttttattagacaacaatatttttttctagtcaggaagtcctattccttcgaagttccgccccccttccacatccagacataaggaccacagtgacaacacccatcaccaccagactctaacataccatctagactcactacctaatgatcatcaacatacacatcttaccctcagcgaccactgtcagctatgaccacctgacaacactcgactgtcactgttaacccctagtc

SEQ ID NO: 504529 - DNA, 222 bp, Homo sapiens
atattatagtgaagatactctgtatcggactccacttatgactccctaaagcccatgtcgaatcccccatcgctgggtcaatagtagttgccgcagtactcttaaaatctaggcggctatggtataagtacgcctacacactctattctcacatccccctgaatcaaacactacatagccttacccacttccttgttactgggttaccgagcctcgaatttc

SEQ ID NO: 504530 - DNA, 82 bp, Homo sapiens
gagaccaacccacaaaaaacacaagaacacaagcacaaaaacaacaaaaaagacaaaaaacaaataacagagaacaaaagac

SEQ ID NO: 504531 - DNA, 391 bp, Homo sapiens
  misc_feature (100)..(100): n is a, c, g, or t
  misc_feature (115)..(115): n is a, c, g, or t
  misc_feature (257)..(257): n is a, c, g, or t
  misc_feature (265)..(265): n is a, c, g, or t
  misc_feature (269)..(269): n is a, c, g, or t
  misc_feature (274)..(275): n is a, c, g, or t
  misc_feature (280)..(280): n is a, c, g, or t
  misc_feature (307)..(307): n is a, c, g, or t
  misc_feature (328)..(328): n is a, c, g, or t
  misc_feature (371)..(371): n is a, c, g, or t
aaaaaaacacattagtagaccaggagtgaaaatagatcaagcgatcagcccacaatgtcaaagaaaatttagaatgttaatcaagcccagcacccatatntttcagaagtatttnagccgtatctaaagactttcccctccatgtgcctctcaggaaggctctcacagccaggcaactcccatgttagtggtaaccttgtatcaaccttacccacaattctaagaccctccttcttctccctgtatcctccccaaantgcaggangggngattnncactntttacctcatggttaaaaagtcaacgntagcaccaaagaagttctganacttcagaactggacttggtttatttctacaaaagtagctgtnacacattccaaaacagaatg

SEQ ID NO: 504532 - DNA, 442 bp, Homo sapiens
tatctttaaggctcaatgctctgtccatctgttacagtggcattcagaggaaggggaactttctgctaagaagaaaaggtattctctggaacctgccactccccaaaattttttttaattacttagaatttattgaatattaacagaatttgtcaaaagtagcatattcttcaagttgaccctttgttcattgaaggatgaaaggattcactggcagtttggagagaagttgctttaagcttggtagtggggatgtgggacatgattccttgaaacactgaccttgtacaaggtcattgctctggagcaggggtctctgagctggtttcagtgaactttatgaaaagcaatgtgatattttgagaaaagcagttatctttcatcagcttgttgaagtggccttcaatgtagaaaatataaagagtcactagccaaaaaaaaa

SEQ ID NO: 504533 - DNA, 523 bp, Homo sapiens
  misc_feature (226)..(226): n is a, c, g, or t
agatcgtcacagctgcacttgtaagagcattgacatcatcctcgtgctctgagaccatgtcagatcacactaagatattaaagcacatcttagaataatgttgcccaagtgttaattagcagaaacattatgcagggaactgtccttgatatgtatgcttttaaccttcatgtattttttctgaagcacaaaatttcctctcagtggatggtcagggaatgattgngcacagaaaaccaaccatctgaagtgttgattcataaaatgagttccatctttccacgcaggcttcagctgccttccagggtgacatccctttttatgagggggaccattctttggcatctaatgggcttttctccattcatttgggatgaccaatgcacctatggcctacttatgtctgaactctttcaataccaccaatctcttctgtccccttgtgccatcttcccacccccaatttcagccaattatgtttataagacatcagttagtgaatcacaattcaaatgaatccacg

SEQ ID NO: 504534 - DNA, 109 bp, Homo sapiens
  misc_feature (61)..(61): n is a, c, g, or t
agactcatctactaatgatatcctcaatgtatagtctgatatctacttaaaacagagatgngctgggtagtggtcacgcctgtaatcccgcacttgggagcgagatgat

SEQ ID NO: 504535 - DNA, 130 bp, Homo sapiens
gaaatgcctagccacttttacacaaggcacacctacacccttatcccatactagttattatcgaaccatcagcctacttattcaaaccaatagccctggccgtacggctaaccgttaacattactgcagg

SEQ ID NO: 504536 - DNA, 365 bp, Homo sapiens
ttggggctccattcagagagagctgctttggaagcttcttaacttcagttctggattattctggtccctcattttcttggccttcataactttaaaacgatcaaaatctgtcatctgggctttcctttctcgggcttcaatcttctgggcccatcggggggctgcccatttggtatggatgtctgccttcggccaggctggtcggacatacttcgggggggcacggtgcggaaactggaggatgaaatcagtgagctgcatgcactggaaaggcagggccggtctcctcactggagtgcaaggtccatcgaccaaagcccggttctgatcaataacatctacaatcgagcccaaggggtaccgag

SEQ ID NO: 504537 - DNA, 229 bp, Homo sapiens
tgtctgtctccccccctttccttccctccctgtagttttgaaacggatgtttgttctttatagatgttgtttaaaaagcctgataatggggattgaaatttacaaactttggggttttttttttttaagaaaaaaataaaatagtttttttcagggccaatgggctttcctaaccgggcccccccccccttttttttttggtaaaaaaagggctttttgtttaaaaaaa

SEQ ID NO: 504538 - DNA, 878 bp, Homo sapiens
gcgagaatgaggacgattctcagcaatcagactgtcgacattccatgcaaaatgtcgaggattactctgcaagggacgcacagcttatcgtgaagggccccagagagatgccctgtgggagggacttcaagtaccacatcattagtgtagaactcagccttcttggaaagaagaaacatagcacgggtccgggtcgactaaatggtggcggtaacagcagaaagtggtactggctaccgttcagagactatgatgttagtccactgtcacagaaccactaggatccaaagggttgttgacactggggcttcccgattaacacacgtactgaggtcttgtcgatatgctccactatccctctatcaaactgttgtttcatcgcgagcgaggaatgggtgctcgtctgctctgataacattcagagaagaattgtctatgcgggttgagaacatagtgatactccccgcacagggttgcgggattggacgaccagagagtgttgagcctctagttacagggtaattctacaaagggcccatgaaatatgactgaaatcttaaactccccatttgaaaaggtgaccataatggagcaatatcgaagctgggttgggtcaagactttccagggccgcgctctgggactgtgcatggcaaagccacaaaaacttgttgagagcaagtccgagcgggatctccacgcgaagatcttgggcgcgatgggtgactcttagtggtctactcagagaagaaccggacctggtctccatgcccggcgtaggatcgagtgaagatctagagagtccacctgggtttgacttcgcaaggaacgaatttgcgcatggttggacgactttaaagaaactgactgtgtagataa

SEQ ID NO: 504539 - DNA, 750 bp, Homo sapiens
gcaacgtatgatggggtggtgtgccagaacgcactgaggggggtcttccgcccctcgctcctcccgcccccgccagcagtggccccgccttagtcgggtgtttctttctggccgccccagctgttgtggaccgggcccttttccctcttcgccctcgcttcaatgcaggatgtctcgccggggggtgccgccgccactgtgggtcacaggggagttgagcgcgcgcgtgcatttacccagccgcgtgctagtgtcctgttgtctccgccgcgcgagcatttgattgctcactgtgtgggcgacacacactattgtggggtgataaaagccattcttcctcgcgcgtctttctctgaggcggtaggaccgccgccccgtgtggagtcgccgcagacataatggtcagtcccgtgtgtatgtattctgtgtgaacccgtccgtgtctgtcttcccgcgctatgtttccgccggtgtgcagccattctttgtacgtagcgggatccatgcgtgcataaatctgtacgttcgtgtgggaaccatttatgcgtcctgttttgcgaacgacatcatggtgtgtcgcccacataatttatctactacacttcttctattgtgcggtccaccatagtagatctgcccctctcccacgtgcgtatgccccccctttattatgtaacttttcaacctcctgcgtatctactattctttttcccaccaactacacacacacccacaaaataacaaacaaac

SEQ ID NO: 504540 - DNA, 1251 bp, Homo sapiens
  misc_feature (673)..(673): n is a, c, g, or t
  misc_feature (675)..(676): n is a, c, g, or t
tgcggtagctcatgcctgtaatctcagcactttgggagtccgaggtgggcggatcacgaggtcaggagatgtgagaccatcctggctaacacagtgaaaacctgtctctactaaaaatacaaaaaattagccaggcgtggtggcacgagcctgtagtcccagctactcaggaggcggaggcaggagaatcacttgaacccgggagacggaggttgcagtgagctagtatcgcgccactgcactccagcctggacgacagagcaagactgtctccaaaaaaaaaaaaaaaaatttaattggcaaataaaattatatgtacttacgtacaacatgatgttttgaagtatacttgcattgtggaatgtttaaatctagctaattagtaaatgcattacctcacagttattatttttgcggtgagaggaatgttttgaaaggttatgagaaagctcacacgatggaagagaaggctgggtaaccagacccataaacagaaaaccggcagctttagagttttgagagcagaaactgcccaaagttggcttctaattagtgctatttaaaaaatgaactataggctgggcatggtggctcatgcctgaatcctagcactttgggaggccaggcaggcagattaactgagtttagagttcaagaccagtcttgtgctggntnnggggttacgcctgtattccagcactttgggagggcgaggtggccagagttgagaccagcctggccacatggtgaaaccccgttggactaaaatgcaaaatttaccggatgtgtgccccctgcttgaatccagttccatggagacttgagtaggagaatgcttgaatccaaaggcaaagttgcagtgaccagtatggccattgacttcagcttgccaaagggaggaacttcatttggggttacaatgggcccaattcggctcattggccattgccctagggggggttaaaaaaggggccggcttaaaggcggcttggaaaccctggtcaccattaagctgtgaaaatccttttccggtggttaccaaggcccaccgtgtctttccaagtgccccctctgggaggtatcagcgggaatttgtccttaattctaaacgctctttacctcaggtatcgaaccttttatacagaactcgctaggtggggtcttcttcaccgctttataggggcttcctctcatcgggcgaccttgcgcgcctctcttcctaccccttctctggtggcggcgtcccatgcc

SEQ ID NO: 504541 - DNA, 142 bp, Homo sapiens
ttctgggcctccttcatcaggaatcatgggcccttctccccaggacgctcatcgatggccccggcttctcaagccctggcttctcaagccctggcttctcaggcctgggccctcttgggctgtggctgcaccctgggcttca

SEQ ID NO: 504542 - DNA, 100 bp, Homo sapiens
gaagatcctggtgtcgccatgggccgccgccccgccccgttgttaccggtattgtaagaaacaagccgtacccaaagtgtgcgttctgccgaggtgtccc

SEQ ID NO: 504543 - DNA, 1493 bp, Homo sapiens
  misc_feature (49)..(49): n is a, c, g, or t
  misc_feature (348)..(348): n is a, c, g, or t
  misc_feature (376)..(376): n is a, c, g, or t
  misc_feature (530)..(530): n is a, c, g, or t
  misc_feature (571)..(571): n is a, c, g, or t
  misc_feature (631)..(631): n is a, c, g, or t
  misc_feature (641)..(642): n is a, c, g, or t
  misc_feature (644)..(644): n is a, c, g, or t
  misc_feature (647)..(647): n is a, c, g, or t
  misc_feature (662)..(662): n is a, c, g, or t
  misc_feature (671)..(671): n is a, c, g, or t
  misc_feature (751)..(751): n is a, c, g, or t
  misc_feature (762)..(762): n is a, c, g, or t
  misc_feature (804)..(804): n is a, c, g, or t
  misc_feature (807)..(807): n is a, c, g, or t
  misc_feature (830)..(830): n is a, c, g, or t
  misc_feature (852)..(852): n is a, c, g, or t
  misc_feature (880)..(880): n is a, c, g, or t
ccaaaaattatgcaagaggaatggtcagcctttaaagctacctgacacnaagaggacactgttgttcacatttaatgtgcctggctcaggtaacacttacccaaaggatatggaggcactgctacccctgatgaacatggtgatttattctattgataaagccaaaaagttccgactcaacagagaaggcaaacaaaaagcagataagaaccgtgcccgagtagaagagaacttcttgaaactgacacatgtgcaaagacaggaagcagcacagtcgcgcgcgggaggagaaaaaaagagcagagaaggagcgaaccaggaaggaggaagacccggagaaacagcgcnggccggaggaggccgcagggaggcgcgngcaaaagaagtcggaaaagaagcaaaggaaaaggaaacaaaccaaagggaaagccagggaaagccaccccagagaggggaggcccgacgccacccggaagccccgaatccacaggaaacacgaaaaacgccagcccatttcccaacccgaaatnccagacaggccggggcaaccgagaaaccccgatgccaccanccaccccggtgggggggggggggttcacagagatggaagatacctggaaagggccctgtntcaagaattnngnttnccagataatcaaatnatggggatnaggttataaaaggaatgatctatgaaatctgtgtaggtttaaatattttaaaaattataatacaaatcatcagtgctttnagtacttcagngttaaagaaataccgtgaaatttataggtagataaccagatngtngcttttgtttaaaccaagcagtngaaatggctataaagactgacnctaaaccaagattctgcaaataatgatnggaatggcacaataaacatggctgtgatgttctggtatgtctacattaacatgtgagaaaaagtaaaaattagaacatgtatgtagtaatgaaatttcagggacccagaacataatgtagtatatgtcaaggtgggaggtgctgataacaaaattaataggaagtctgtaggcattaggatactgacatgtaccatggaaaattctagggacaggagcatcatttttttccttacctgataccacgaaccagtgacaacgtgaatgctgtattaaagtggtgatgtaattctgtgagtaacaaatgcatgaaaaataagtgttcacctaaggtaagatcatgtgccgtgtgtgacactcacaaaatgtttttttcccttcttggttgatgcaaccttggtggatgtcattggagaacgccctggtccctataatatggtgtgtgcgttgttctacctctgctttatcctttccccacggtgaggcggaatgtctttacaagaaatgggcatgattgtgtacgttacttggaaagagtcctaacattggagttttcacttgggaccacttggggagaggcacgttttcgcgaccctcttgggacactgctacag

SEQ ID NO: 504544 - DNA, 802 bp, Homo sapiens
  misc_feature (111)..(111): n is a, c, g, or t
  misc_feature (439)..(439): n is a, c, g, or t
tcccttccaagcaccggatggactcctttcggggcgtttacatagttagttttaatcgccgcctcgctcctgctcttttacgctaaccccccaggcggtgccttgtatgtnctccccagccgtcgctcgttgtattaaatttttcgtcggttgggggcgcgaccgctctcgggagcgactgagatgctccctacaccctctccgcggcgcgcctgatacacatctctgttatgaggtttctccccccacttacccatgccgcaggtcttttatatattcctcccttggtggtcccccccactatacttttcgcacccctccggggccgtcacacatgcttgtctgccttcgcgaggcgagtgatatacacgctgccccatctctcctcttttttttagtagagagcgcccccatcacattcccacaccacatcgagcgngtggtttccacccccccgcccgctttggtggtgaccggagcacttcctcctgtgggggggcccacctccccctctgtcttatagagaggtgttctgtctgtttctgtacacacacagctgatgtatatagtgtctctatccgcctgcgatgtagttgagtgagtgttttggaccccgcgcgtgatttcaccgcgctgggcgtgtgttgtatttttttttgctcaaatttcctctccccccttcttttccgaaacgaccaaagaaaaaaaaagcctcttttcccacaagcccctcccccccaaaaaaaattttttcccctttgttttaatacccccccccccccccgcacaacagggtttttta

SEQ ID NO: 504545 - DNA, 122 bp, Homo sapiens
ccggccaactcagggcgagctgcaggaattatgatatgggtgtcgagatccttttttctatcagatattcattgtcatgcagtagtagtaaaaacatcaaagatgcagctcgcccctgagtt

SEQ ID NO: 504546 - DNA, 331 bp, Homo sapiens
actcctaccccacgtcctccgctgcgggttgcccagcacatggccggtctgcgttctgtctgccttgtctttgaccagatgaaagccgtcccgaggtttgtggtcaatgcctccaatcggcgcatggcagtcaatgcagatgctctgttccatcggcctgccacactagggtgaagacagggcactagaaccacttctggagcagtaccattttatgcacaaatgccatcatgcaaatgaacacctccttatcaccggcagacgtgagcaccctcagattgtcccagtgtgtgcctgtttcgggtgggtggagaacccatgggaacaggat

SEQ ID NO: 504547 - DNA, 113 bp, Homo sapiens
tcctcacctgcagccaacatatgtttcctaaactcgaggttcactactcgattcatattcaccacagcccctagagagcccgtagaggtgtcgggtacctgagcttgattttg

SEQ ID NO: 504548 - DNA, 174 bp, Homo sapiens
gttaacgggacgcagctatctagtagcccaggccaggaaccggagaatgtcatataggtggtgggtttctcctaatgcaaggaaaaacgcggcatctagcacggggtcactggttccccctccactgtggcaggaagtcactcctgccataggtgtggtttcgaccagcatagc

SEQ ID NO: 504549 - DNA, 257 bp, Homo sapiens
ttgctgtgagtccatcagtgaagccaatgacccgacccagagccagatcaagactatactgatgggccctacgccgcctggaccccccacggcgccgacgcagcgttccctgccgggtacttggacgtagagcgttgtattccagccgcaacacactatatcttgcagtgcctggcaccacggtgctggaggatgaggcccgggagcagggccggggtcatccatgtcattgtcctcaaccaggccacgggccacgt

SEQ ID NO: 504550 - DNA, 544 bp, Homo sapiens
  misc_feature (85)..(85): n is a, c, g, or t
  misc_feature (136)..(136): n is a, c, g, or t
  misc_feature (139)..(139): n is a, c, g, or t
  misc_feature (200)..(200): n is a, c, g, or t
cagtgggagatgctcacacttctcccttctggagcagttgaagagcagttttaatgggtggcccgctggcaaactcacccaaggngaagaacagtatatttcggggtcacccggtgggtttcacaattttgaatcngangttctttccggtgtcactaaggtggtcgtgaagctcttttactctgatcccaacactgtgncgggccctgtagaagtctccaggaagaaccctaaatttatggaggccgtggcggagaaagcgctgccggaataccgcaaaaaaccccgggaggagttaaatgtggattttgcttttgcacccacggggggattttagtccagctccccccaaaattaggtgcagccccccagaaaaaggtttggaggttcccaaggaaacagggcccagcctccagggccccaaatccgcccagcctttccccgctttgggtcctgccctttaacactcgactttgttggtcatgggaaaaacaaaaatggtcccgccagccactaattcaataaaactgttttgtgaggtgga

SEQ ID NO: 504551 - DNA, 123 bp, Homo sapiens
taccaaagcgtataccaactacattggaggctgaggcgtagaattgcttgaacctcagaggcggatggttgcagtgagacaagatcatgtcactgccctccagtccagggtggacagatgcaa

SEQ ID NO: 504552 - DNA, 186 bp, Homo sapiens
ggtctatctgtactgccagccgtcgtcaatgcaaaggagcatcgtgtgggagcgcgtggaggaaacaccgaaagagtcgttcagacatactggccgagccatctgaagccctcgccgtagccttgcctcatcacgaccgagcacatgaagatctcgatggggcggatatcggtcagcggtaccttg

SEQ ID NO: 504553 - DNA, 656 bp, Homo sapiens
  misc_feature (548)..(548): n is a, c, g, or t
  misc_feature (621)..(621): n is a, c, g, or t
  misc_feature (628)..(628): n is a, c, g, or t
  misc_feature (630)..(630): n is a, c, g, or t
gataaaaccaagaatattgaggatgtagcaatgaatgctccaggtggcactatttggtgggtgaaatttaaaccttacatatccttgaagtatgcttttgtgattattaaaagcattttaaaaataagtattagagtttttacttagatgtttgaaaaagaattctgtcatcaaagtgtatgagagttgacaagtgtaaatatgcaggttagacagtttcaagggacgtgtattatttactgatcaatgtactgtctcctttggagccattacactcagtcatttcctgtcaatctctccacgctgttataatcagactatggatatgcatattaaaatataagaaagttattgtgtatgtgtggtggcagctttttaattgttaataatgttgctgctttaaaaaggtatcagggtagtttactcttaggatggttaatattctgcagaattgcatgagaaattaggggaaccaaaattcgagctggtggataatgaggccaataggtgggtgtctgtgcttctagtcgttgccccggttacaaaanaatgagcttttaatggtggtcctaatatggaggtaggttccttctgttcttttttcaaatttttatttatttnatttttntntactactgtgttttcaggaaaacttg

SEQ ID NO: 504554 - DNA, 519 bp, Homo sapiens
aggattctagagtgttattgatggagtaatggctctcatgacaagtgtgtctctgaacatcagttttcattgcataaacataaatttttacattttctctagaacagaatgagtggaagatcttcacagcttgtcttgtaagaagtctgcatgcggccgtgagccactgtgcacggccacaaaaacctttttaaatctcaagttttctttctgttgttttgaaaattgcctgatttctgttaccaattacatattactggttttgctttcctggagaaatttgagaacatacaaaagcctagggggttgtttatatggcagcgttcttgccagtggaagcacgaagccaacatatagccttagttagagagaccctcttttctctggccatcctgaggcgtctcaggcagtatggagctattttaggagaagaagcatggtttgaaaaggaagaaatattatatattgtttgttaaagtttattgaaataaagaatcatttaaatcttcaaaaaaaaaa

SEQ ID NO: 504555 - DNA, 894 bp, Homo sapiens
ctttttcttggcaagatggcggatcatacgacttgactactcgcatcgcgcacttttggatcggcatctagtctttccgcttcttgaatttctctctgtacaggagatctatcatgcaacaggacattcttacacaggtaaatgggaccttcttagtgataccaacatggtagactttgctatggatgtatacaaaaactttattctgatgatattcctcatgctttgagagagaaaagaaccaccagtggttgcacaaactgaaacagttcaggcagaacacagaaccaatggtgcagatgttcgaagatccagaaactacagaggcaaatgcagtcaacccagggatggtaggagtgctcttgactacctggcggacaaagccatgcgttttaggcaggactatttagactacaactctacgagatatgcaaaaattccagtacgaatgtgggaattactcaggagcagcagaatatctttatctctaagagtgctggtccagcaacagatagaaatgctttaagttcactctggggaaagctggcctctgaaatccttaatgcagaatggggtgcagccatgtaagaccttacacgggttaaaagagaccaatagattaataattctgtgagttctccactttcagtctcttcagcacgagaacatggtccatcagggtcctctgtggtttcttcaatcaccccaaggtcgcggataatttattggcctcttctttatcaggcaccatatcttacgcatccgcacaggggtccaattctccgattttgataacgcggctacaaccaatgtttcgacaagtcgggttcaaaactttgtaggttcaaccggtgttatttagccaccgactgggtgtctctactgacatgggcc

SEQ ID NO: 504556 - DNA, 134 bp, Homo sapiens
tcctatgggtgatgctcttgtaggcgatgtactaccggggcgttaatatgaggacagtcgagatgatccttagcaggagtttctacctcctcctagtcctcctcgccctccctccctcgatcgaaatgcaagca

SEQ ID NO: 504557 - DNA, 149 bp, Homo sapiens
agctcgacgcatcatggagctcgagtcggatctgcatgcgcagcctgaacctgacctcggaaatattcgaaaaggaaaaaggcgcggtggtgggcgagctacgccgtcacctcgactcggccggcagcattgcgtgggacgagctcatg

SEQ ID NO: 504558 - DNA, 349 bp, Homo sapiens
tccgggagacatacagaaatcactccagaagcaaagacaaactcttactttccagaatcccaccactgatgtaggaaaacagagtaccaaggaaactcggaaaccaaaaatacatggatctggtcatgtcgaagaaccagcatcaccactagccagcatatcagaacatctctcagcaagaaaccagcaagcttcataatagcacagcagactaaacccctgtgtgccctgtccagtcatgcaacacaagatgcagtcaggcaccttcctccaagccagcatggccaagcccaaaggcttcaagcctcccatgcacagcccagcaaggggtcccagttggggtcttgca

SEQ ID NO: 504559 - DNA, 617 bp, Homo sapiens
atcgcttattgtgctgggtgtggatcttgtgctcgttggttcttgtgctggaactgtgggagtgggaagggctagatgagggagcagtgggaggtgttggtcatcatgagcttttccttaggtacagaaagaagggaaatagagtgagccagactgcaagaggattttgaggtggagagggtgtgagtttgaggagcctccaacagaaaacttctttgtacgggattaggtgaaatcacttgtggagtgaggaggaaaaggatttggtgctaaaaaaaaaagtagaaatggggacagtagatgtgggaagtattgagggaggtcaagaaaaggtgaaccaaaggaggctgaacgttgcacgttctcagtgactccagtcacgcatagtttggtggctttccagtcggtcgtagaaaccagaaagcaggattagaaggagtaagcatggggcccttttctggactgggacttagaagtcaaggagcatggggagcgtcgcgcagttcaagggtgtcagccagttcttatttcatagttgggccgaggtgagtaaaactctgtttgcgggccattattagttctgacactaggtgcgcgacaaggtcaacgctactatc

SEQ ID NO: 504560 - DNA, 799 bp, Homo sapiens
agcgggttggctgtaggcagcgcaatgccaagacagagctgctggcggcgggggcgaatctccctgcaccatgagcctcggtccggccccgttagtggctgataagcacaggcacgccgcctccatttgccccggggccctcggtgcgaaatagcggggcggaaggaagtcgaggaaagcgctgggcggggtctctacgaacatgtgaaggaaaagcagctccgtccaaaacgcctgttcgagggctcctagggagtcgggccccgggccgcaccgtcacctcggccgctgcgttgtcgccaatcgcttgtttccccatcccccgccaatggccgaaggaccttctctgcggcacgtctacaccgaagatgatttctactgccccgtctgtcaggaggtgctcaaaatgcccgttgcggaccacggcctgtcagccacgtttttctgtacaacaatgtttcctgacctgcaatgagggcaagcgtgacgcacattgtcccctatgtcgtgcaacatgtgactagaaagagaggagagctgtcttgaagcggggcttttagacctttgaaacttataagtcaggaagttataccgtgttaagctggaagaatgcttgtggcaaaaagggataaactctattggattgagacttctttacgaatcttgttaagaacgtatcagggatgaatatggtgtcttataatcattccaaaagtttcagatctctcaagattcagtaggaacaagatagggagtgaaacattcgaattttgatacaagaaagtttccaagaaaattc

SEQ ID NO: 504561 - DNA, 733 bp, Homo sapiens
caagggccccggggttaacggacgacggagtttattgtcggcgacgtgccattcaggtttgcacaagctgtctacagagcaagcccaaggtcttctctcatagaaatacagaaacctgtgggtatagcgtaatcttggtcgacagacataagtttagtcacttggccaaagtcatcggaggattatcggcgtcggtgtaggcaaccccctccgggctagcagaagggtggtgtgctcacagatgtggcatggccggtgtctcatcctcaccacaggctgtgcccatgagtccctgtgcagaccagtggcacagcaagctggcccagatctcagggcacccgtttgtgatcctagcaaggatcctgagcatggccacacgaataggccatagagagcctcatggagcgaaactaaagaacaaacggttccattatgccctcttaagagtgatttatgaagcgggtttagcacaccgttctacggaacgtgttttaagggtaagtcagcattgtcttccagtggtacagagcatccctcacctatgcattgtacctacgtaaccaggccaatgaatggaatttccagcttgaatcagtacagtgaggtgaccactgaggctattataaggagaaatgcaatgagatgacaggagctgaaaatgaacaatctcgggagcacgttgaatgtaacaagaattgttacgtattcattcaacagctttccatagagattg

SEQ ID NO: 504562 - DNA, 148 bp, Homo sapiens
cactgcatatcactgcatatacacatgtatatcactgcatatccactgcatatcactgcgtatccactgcatatcactgccatatactcactgcatattcactgtcagatcccaccatgcataattactcgcgtataccacctgtcat

SEQ ID NO: 504563 - DNA, 195 bp, Homo sapiens
tgttggaatttaattcctttccaaagttttgtacaatttccatgtatcatataccatatttaaaacccttcactattttgcgtgatttctaattacataaaaaccatttaaatgcaataaattttgttgccgtaaaacaacaaaatatccccaacttataaaaacacaggaacaattatattcataaacatttac

SEQ ID NO: 504564 - DNA, 295 bp, Homo sapiens
cgcatatatagtgcctcgtctagagatctcggcagtcgtagtatggtagatcgcaggacttgcaaaagacgaggcttgcacaactagaagaattggcggaggactgatttatggttggctaccattagtaggtacagaaacaactatgagaaagtgtggcacaatcgccatatcacggtgcgcgtcttccaggagaatgatctagtatagctttatgacagttagttcgaaaaattctcaggaaaacttagcatgcattggttgggaccctatgtcgtcataacaccacacaatt

SEQ ID NO: 504565 - DNA, 222 bp, Homo sapiens
tagggccccccaggttttcccttttaggtttccggttggtatcttggggggaattgtgaggggataccattttcccacgggaaagaattttgcccaggattccccctggttaaaaattacccctcttaaaagggaaaaaaaaggggggttcccccccgtgggggagcggtttaaaaaatgggggttcccccggggtgggggcttttgtcggaaaaatgttta

SEQ ID NO: 504566 - DNA, 441 bp, Homo sapiens
ccctagggtttcaaacgagacatgtcttgtggggttggtgtgcctagtgatgggagtacttggctgctagataagctgaacaagcagctataacgcgggactgtaattcttcccgcagaagttgatgcctttctctgtaaagatttcagcctatagttaggagctgttaagcagtatctatcagtgtggcaacctaggacctgaatatggcttgatcaattgtgcaaaggggtttgatttctttgccttgcaatatctaataccaaatctcttgggggaggcagaggtaaaagactgatcagcgcggcactggattgccaatcgcacatcatctgcatcaacagtagctttcttagcatggcttgaatacatttttgcatcatctagaattgtggtcacatatcggaaggcaaactccaacatctgttttataactcttgg

SEQ ID NO: 504567 - DNA, 454 bp, Homo sapiens
  misc_feature (5)..(5): n is a, c, g, or t
aaaanaatttttcccactttgaaatgcctaaaaatggcatttttccctatgtgcagtcactccctctcatttcctaaaatagggaccgtggcccaggcacggtggctcatgccctgtaatccccagcactttgggaaggccgaggcaggcggcctcacgaggtcaggagatcgagactatccctggctaacacggtaaaaccctgtctctactaaaagtacaaaaaattagctgggcgtggtggtgggcacctgtagtccccagctactcgggaggctgaggcaggagaaaggcatgaatccaagaggcagagcttgcagtgagctgagatcacgccattgcactccagcctgggcaacagtgttaagactctgtctcaaatataaataaataaataaataaataaataaataaaaataaagcgagatgttgccctcaaacttcaaaaaaaaaa

SEQ ID NO: 504568 - DNA, 1032 bp, Homo sapiens
  misc_feature (781)..(781): n is a, c, g, or t
gctcagcaaaagcccatgtgccctgctcctgtgtgcagttggggtatggggcagctggctaatggtcaggtacatcactagtgtgcccatgccccgacagtacccacaagccctacccgtgctggagcttgcttcccgaacgtatttctactctcttacgagggaatcttccatcatagcctcagcacagagctgccatggccatgagtctacttgaacgggggccatctaggtccccgaacctcatggacatttgtcctccattattcaagcatccgccttttcttctcctattattcgtcatctggactttcttcagaccatgactcacaactaagaacgataaaacgactggaggttacgtcggagtgcccctccccaaagcatgggacgcctgggcattggcgcagaggaggtgactagcctaagatctccgtttgcgctcacgctgtctccccatcgtaaggaagccgtgtaccccttgaggcaagccgtgtcccatcaaccagtactgggctctttttccgccattcttcactcttcgcaggaccagcagaatgtgggtgaagcgtcttggattcatgtcgtacccgtataagcgcaggtcgtcaaatcgacaaccaaaggttggccaaccaaacgtgtacacccttgaccttcgagaaaacccccagcaattcccaaacttccaaaattagttggtacatcgtccttacattaaccccattccgacccatatcacccgcaaatcattatacgctcctaactattcatgccaatncatacctcattcccaaggctccttggaacttgcacaccttgatacttgaccccccgtattttgccagagcccccaccacgtggggacctgttctgtgccaaccaacgggggtttaacaaggtgggcccagagatttgtatggcggacgcgttatctactcggacacaaattccctggtataacacttacagcgcatcccccccccttttgtgcccccccgtagacgtctcgtacagagtggcccctgtaga

SEQ ID NO: 504569 - DNA, 106 bp, Homo sapiens
ccccaatattcatcccctccttctcccattgtgagagaatgcttgaaaacttgactcagatgggtacctggctgcccccaattttaataagggatgcctttcctgg

SEQ ID NO: 504570 - DNA, 454 bp, Homo sapiens
  misc_feature (336)..(336): n is a, c, g, or t
  misc_feature (375)..(375): n is a, c, g, or t
  misc_feature (447)..(447): n is a, c, g, or t
accaaggctgaagagtcaggttgaagcacaggcttttgttttttgttgtttttgttttttgagacagagtctcattctgtcacccaggctggagtgcagtggcgcaatcttggctcactgcaacctccgactcccaggttcaagcaattctcctgcctcggcctcctttagtaggtgggattacaggtgcataccaccacacctttctaatttttgcatttttagtagagatggggtttcaccatgttggtcaggctggtctcaacctcctggacctcaagtgatctggcccgcctcagcctcccaaagtgctggggatgatagggcgtgacaacncaacacccgggccaagcacagggtttttgaatgggtctncctcttccccagcccagggtaacatggagggccaagggtggaactgttggcatcctggaggactttgtgttnccctgag

SEQ ID NO: 504571 - DNA, 190 bp, Homo sapiens
  misc_feature (144)..(144): n is a, c, g, or t
atctaaggatcgctatacacatgatgagccctgggaggcgaaggatgtggctgacacgtgcctctgtggtgtaaacttgtaccagttttacggtccctctggccagtacacccatgaatttgatggagatgaggagttctacgntggacctggagacggaaggagactgcctggcgggtggccttgagtt

SEQ ID NO: 504572 - DNA, 669 bp, Homo sapiens
  misc_feature (463)..(463): n is a, c, g, or t
acattcctttaagaaaagggctttatatttcaacgggtccctccaacagctgccaaactgtgtttggcgctgcccccccacacccctttcttttggaaagaaaatcacccccccacggctccctgtaataaagtgtcaactccaaataaacaccctgtcttgttaagactgcaccataccctcattgtgccccacgaaaatactgccacctcttgtatgtactgccccaatagcccccctcacattgcctcttttccccacaacgatgaaccacccttcttctcctcctcttctataaggaagttactcctgatgtatgtgccgagttctattatttggcgataatttctcctccgtcacgcaaatttttttacaaacaatatgtgcttaaattctcctcgatgtataccaccacgtcggtagtatattgtatgtccgcacgcgcacctcactaattatacanccactttgtggagacggccacctatgacgaaaaacactttttattaattcatctcccagttgttgtctccctgatttttttacacttccaaattaacccccccggttttgttgatgaggggagcaccccgagacaccatgacaaatatattatgtaattacatcttgatctataagatttcacaccacccaactaataacaaaaaa

SEQ ID NO: 504573 - DNA, 450 bp, Homo sapiens
gtcgcgccaccacagttggctaatttttgtatttttagtagagatggggtttcgccatgttggccaggctggtttcaaactcctcacctcaggtgatccgcctgcctcagcctctcaaagtgctgggattacaggcatgagcaccgcacccggcctggtataatacatttaagggagaaatgtcttctataggagttaggagtcctgactaccagaagatctttattttattttgattataggtgagagtctccttatatctcttaccaaaggcagcagtgttttacagggtcatgctcctcctgcaggtcaagtagagagcctaaaaaagaaaaaaccaccatggaaagcatatgggtggggagataattagtaaagccagtttggggtggttaacattaggggagatgaaagcatattggaagttagcaactttaaggggggggatgg

SEQ ID NO: 504574 - DNA, 799 bp, Homo sapiens
gacgcactgctatcaacggggagttgcacacaatgtcggaacgcggaggtacggtggttgtcgttcctcgtagatcgcatagacatgccagtgatatagctctgggctcaatcgctgatacgagcatgatgctcggatggtgctgaagagagcaggagacaaggagctcgtatatcaatcgtactagaaaggagagtcaaggtgaaagcaaggactccagagcatttgacgcttgacgggttgctagtgtgacatgtatggatgtgcaaaggcatgaaagaggtggcaaacgatgcagacgtgcaagagatgaagagcgttcgtgatgccagtggatacattgggactaactgaaaagtgattaagggagaacgcaagagtggacggtgtgacctatattctgagaaagattacattgccagggaggtcactaggggatagaaaggtcctaggatgagaatgtacataggtgatgggtacgttgtcagaggatctcggggagacgaaagagtgagcgttgtggcaggattatttggtgggtcaccgtggaattgaacatgtaggagggagtagtgcaatgggatcgggtgtgattggtcctagatatgaatttggttatcaacagatatattgaaaggtgtactgcagaattattagttagaattccttgtgatgatatggggcatggtgatttatggtcgcattaggaatttaatataaagtaggttcttaaaattgttttggaggaggtggaggatatctaggggtattaatgagtaacgagactggcacaaaaatt

SEQ ID NO: 504575 - DNA, 410 bp, Homo sapiens
ggctggatgcacgagcgagtccgcgttttaataaaaaaaaaaaaaggaaatagaataactagtcaaatgtactaactgagtcctagattgtaaatctcttgaagacattatgggtcatgtcctaatccccttgatgtttccaggacccagccaagtacgtgaaatgttgatttattcgatattcatgaacacagatccaatgtgtaccaactacctgcacgcgcactgttccaggagctggaaatacagcagtgaataaacagaatctttaagaaatctctgctgagcactgacagtaactacatccagaaaggagacgaggaggacaagatggtaaaaataaaaacagagatacatcaggaaaaactgtcaattaagaaagttttaaacataaggaatgtcaaaggaga

SEQ ID NO: 504576 - DNA, 118 bp, Homo sapiens
tagtcgtggcaataaaaatgataggatactagtataagagatcaggttcgtcctttaatgttgtgtatggttatcatttgcttttagagagttagtctgattagtcattgttgggtgg

SEQ ID NO: 504577 - DNA, 112 bp, Homo sapiens
gctaggtaccccgtgctgaagaatgttgatgcacgtccgtcaggtcatgcagctggtcctccagtcgctcatacctgtatctttcctcttgcagggtctgagaaataaaacc

SEQ ID NO: 504578 - DNA, 216 bp, Homo sapiens
aggagtcccggagctgatcagtttgatgtccagttctctatcagtgtggctgtctcctctttcttgaacattcatgatcgcatcaaacaccttgaagatggggtccaggattcagctggcacaaggtgcgtggctagcttcttcccttcggggctggtggctgacttgctgaactggccgttgtttgacacaaagtacctgtcaccccacagcttc

SEQ ID NO: 504579 - DNA, 341 bp, Homo sapiens
cctccacctttacccacatcattttactccactacttgttgaaagcttgcttaaagaaaatccctcttggccgggtgtggtagcccacgcctcctaatcccagcactttgggaggctgaggcggggagatcacaaggtcaggagatcgagaccagccttgaccaacatggtgaaacccttgtctctactaaaaatacaaaaattagctgggctgttggcacacaccttgtaatcccagctactcaggaggctgaggcaggagaattactttaacctgcggggggagcctagattgcgctactgcactccagcctaggcaacagagggagactcttgtctca

SEQ ID NO: 504580 - DNA, 140 bp, Homo sapiens
acaatagagcacacggaattcactgattaagcactgtacacatacatgacagcctacaaccgtgatgagtgtcacatgtccacaggcagttagattaaaaaaggggaaaaaaccacagccacaaaaataaaacctgtttt

SEQ ID NO: 504581 - DNA, 380 bp, Homo sapiens
  misc_feature (37)..(37): n is a, c, g, or t
  misc_feature (96)..(96): n is a, c, g, or t
  misc_feature (108)..(108): n is a, c, g, or t
  misc_feature (115)..(115): n is a, c, g, or t
  misc_feature (117)..(117): n is a, c, g, or t
  misc_feature (144)..(145): n is a, c, g, or t
  misc_feature (162)..(162): n is a, c, g, or t
tataatatgcagttggtaaaaacaaaactggatggcntcaaaattgtctggaagtttggtcttgggcagtatgggctgggccaaatgaaagtgatnttttataattcntaaacangnttaccaaatgaaagtgtcagtggcttnnacttgggctcaattaanggggggaattttttataaaaaaaaaaaaaaaaaaaaaaaaaaaaaaaaaaacaaaaaaaaaaacaaaaaaaacacaaaacaaacatgaatacaaagaagaaacaaaacaccacaacgaaaatcaccaacaccaagcaccaccacccacaccaaaacacggcacgaccatcagacaagcccaaccgacacaccgcgtcggtgcccactcaacccgctca

SEQ ID NO: 504582 - DNA, 256 bp, Homo sapiens
agatggagttccgccatattccccaggctgataggctggtcttgaactcctgggcttaagtgatctgcccccctcagcctctcaaaatgctgacattataggcgtgagccactatgcttcccagatcttcttgtttttgtttttgctaaatcttttgttgttgttgttgttgttgttttgagatggactctcgctctgtcgcccaggctggagtgcagtggcgccatctcagctcactgcaacctccacctcccag

SEQ ID NO: 504583 - DNA, 221 bp, Homo sapiens
cctgttctgccgcttcctgcttctgccgcttcctgctgcttcctgcttctgccagagaattttaatctttatttttattatttgtggaaaacgaatgtctggtctctgtggcctaggcggaagtgcaggggccctatctcggctcgctgaaccctcggcctccgtgggttacaagcgaagttctctacctcagtccctcccaagttacctggaatttacca

SEQ ID NO: 504584 - DNA, 264 bp, Homo sapiens
tcggtatacgatgtacacgtggtacgggtgcgcggacggtgtgcgggtgagtctccccaaaagtggagcccttgtgatgacgagcacaggtccgcctgtgtgcccgtgggctgctctctcaccggtggctcttagtctcggagagcagaacccggcaccttcaggggctgcctgcgggtgggtgttccctgctgtacgtgtgtgttgggtaaggttgtggcctgctttttgctttatttctgaatggtcattaattctttaggt

SEQ ID NO: 504585 - DNA, 260 bp, Homo sapiens
tacatttccagtagctatttagttagttccagtgattcccactcaagtgtcccgtaaggaggtgccatgggaaataagagcagcctcttggcattctggttagaaagcctgaaccaaactttaaagctgtttttataaagggaggacatgtgatggccaaaaattgccttagattcatggagcacttggtcctaacccaggtgtggggggctgggtttcacatcatccaattttcttttttgccttcagacctgcaatgc

SEQ ID NO: 504586 - DNA, 887 bp, Homo sapiens
  misc_feature (38)..(38): n is a, c, g, or t
  misc_feature (61)..(61): n is a, c, g, or t
  misc_feature (70)..(70): n is a, c, g, or t
  misc_feature (82)..(82): n is a, c, g, or t
  misc_feature (101)..(101): n is a, c, g, or t
  misc_feature (147)..(147): n is a, c, g, or t
  misc_feature (188)..(188): n is a, c, g, or t
  misc_feature (224)..(224): n is a, c, g, or t
  misc_feature (242)..(242): n is a, c, g, or t
  misc_feature (249)..(249): n is a, c, g, or t
  misc_feature (299)..(299): n is a, c, g, or t
  misc_feature (386)..(386): n is a, c, g, or t
  misc_feature (453)..(453): n is a, c, g, or t
  misc_feature (470)..(470): n is a, c, g, or t
  misc_feature (479)..(479): n is a, c, g, or t
  misc_feature (483)..(484): n is a, c, g, or t
  misc_feature (528)..(528): n is a, c, g, or t
  misc_feature (543)..(543): n is a, c, g, or t
  misc_feature (556)..(556): n is a, c, g, or t
  misc_feature (561)..(561): n is a, c, g, or t
  misc_feature (596)..(596): n is a, c, g, or t
  misc_feature (607)..(607): n is a, c, g, or t
  misc_feature (617)..(617): n is a, c, g, or t
  misc_feature (632)..(632): n is a, c, g, or t
  misc_feature (689)..(689): n is a, c, g, or t
  misc_feature (722)..(722): n is a, c, g, or t
  misc_feature (736)..(736): n is a, c, g, or t
  misc_feature (782)..(782): n is a, c, g, or t
  misc_feature (793)..(793): n is a, c, g, or t
  misc_feature (811)..(811): n is a, c, g, or t
  misc_feature (830)..(830): n is a, c, g, or t
  misc_feature (853)..(853): n is a, c, g, or t
  misc_feature (879)..(879): n is a, c, g, or t
  misc_feature (881)..(881): n is a, c, g, or t
tgggccctcggagtagggtataggggcagcaggaccanaagaaaggaacaggtggcgattngccccagcnctcccccctaanatgcagaacctcaaaacangtagcggaaggtgagctccctgctccgagatgtagattcgggtgtnacgcaaagacggtatctttcaacaataaggtccccactgcntcaaagcccctaaggccacccgctggtcctggcatnctagacgggggtcccctnggccctncctttgtcttcctgttttgcagggtaatcccagggttccatgcgtttccnctgcacaaccagcatgggcccctcggtgcttgtttttccatttttctgttgttctgcgaaaataatggcccggaggagaggggggtncggcacggaggccaggttgttttccggcgccggcgtaaacccggtgaaggcctccccctcgtgcttnggcaccagccgccagtnatggaaaangagnngttcgaactcccgcgccttgctctaagttttccctgaagaaganaaagaggcgttttcncaaacttgctgtnccgtnggcggttggcatcgaactgccgggcacccgctctnccgagctttanctttgaaggncaggatgccccaggncttcccgtggtccaagttctacctgcgccgtgtagtggggccgcacccgcgttaagngccagttgcacggctcgtcgtgctgccacaccnaggacttgcgcgtnaccagggggcccaggccgaagagcgggagggggccgaccagctgcnagaggcggctntcgcggcgcacgttggcncaggcccggaccggcagcnggcgtccagagaacggccgcgtnaaggtctcgtagtacaccgcgtagancngggagt

SEQ ID NO: 504587 - DNA, 251 bp, Homo sapiens
  misc_feature (166)..(166): n is a, c, g, or t
  misc_feature (231)..(231): n is a, c, g, or t
gggtactggggattgtccccgggagagtcgggaggattactggaggccggatcggtacactaaagtgaaggtgaggtattgcgaggagtatgatccggatgattggttgtgtgattggtatatggttactaccgcgctacattgtgccctttcgtgtatggttccngtggtgtgtggtggacaggtttttccggaagctatgccctattaggataaataatggagtcttcnaaaaaaagaagcgtcctaaa

SEQ ID NO: 504588 - DNA, 311 bp, Homo sapiens
cgcagtatcgtccgccccaaattctaagttataaaggaaacaaccagttctcccacattttaaactccttctcaccccagtgtctggaaaagttaatcattaaataatagcacccactctgggtctggcactgtgtcgactactggagagcaaatagccaaattagtaccgttttcttcatccattgcctaaagtctagatggataagcgatatgattgcataagcaggtaacagccaaatgccatgcctctgagagtgaggtgttcagtgagggttcatttatttccatggcatcgcgtcggttaatttt

SEQ ID NO: 504589 - DNA, 207 bp, Homo sapiens
ggtgtttccctttgtctactaaaaatacaaaaaaaaaaaaattaataattcagttaagttgtggtggtgcacaccttgtaatcccagctactcgggagactgaggtaggagaatcgcttgaaccggggagatggaggttgtggtgagccgagatcgcgccatggcacaccagccggggcaacaagagctaaactcggtctcaaaaaa

SEQ ID NO: 504590 - DNA, 243 bp, Homo sapiens
ctcaggagttcaagacaggctaggtaatgaaaaaaataaccaaaaaattagacaggcgtggtagcgcaagccagtgatcccagccccttgggaggctgaggcaggtggatcgcttgagcctgggaggcagaggttgcagtgagccaagatcacaccactgcaccccaacctgggtgacagagtgggacccccatcacagaaaaaacaacaacaacaaacaaatttccattaactcgtaagtga

SEQ ID NO: 504591 - DNA, 121 bp, Homo sapiens
cggctgcagctgtggaggaggagttcagaggagagaggtcgcagagcagagagcctgagaagccagaggcaggtgaagagagggtggaaagtgagcagcgggatgggctggagccgcacac

SEQ ID NO: 504592 - DNA, 833 bp, Homo sapiens
gtataaacctgatcttgcttgaagtgagcaccagtaacgatttaaaggtgactctcagaacggagagaatacttgtgagaggttacaaatattgcaaactaaatgttatccaagcataaggtgaacatcatacataaagacaagaaggttattgcccactgctacggcatattctcagagagattcatatgccaggtattctctgcactaccgtataggatcctgctattattggcatcctacagtgtgtgtgattggcatccaaagtagaggaattgggagtagttgcacatacaagattgattgctgctgctacttctgtattaccacaactagattcttcatatgcctttccacgaggaatttccttataggatgaatcatatattagaatgtgaattctatctagttagaactaatggattgtagcttgatagtgtatcatccttatagaccttgtgctccagtatgtgcaggacatgggccaagaagacatgttgcttccccttgcatggaggatagtgaatgatacctagcagaacggatctttgcctacttgtatcctcctttcatgataagctatagctttgcctaacattgtagccctgtgtagtacaagcagaaaagatgccaggcaatcggttttgctgagctttctgggggaatatggaaacaaagatttggacactcactccagggtattacaaaactaatatgagccggtggaaagaaacatcgaatgaggaaccacagagactgggcacccatcttagtaagattgccataaaacgacaacaacctccaaacaaggaagagaacacgctccaacatgg

SEQ ID NO: 504593 - DNA, 140 bp, Homo sapiens
ctcacagaggtcaggccacagtgaggaatcaacagtatcccacagcggccaggtgcaagtggaacaacactcttcccttcccactctgcaacctcagtttatgttggagaacctaaaaactcacccatcacattcagtcc

SEQ ID NO: 504594 - DNA, 433 bp, Homo sapiens
  misc_feature (41)..(41): n is a, c, g, or t
  misc_feature (68)..(68): n is a, c, g, or t
ggggcccgtggttttttagatcctcagtagaacagtccagnagcctgaagacaagtggccccttgatnatttgggtctcccgggaccagctaggggtccaggtttcagtcagtaaataagggtggtccaggtcctaaagacccctttcctttacaaagacttgtgatgtttggggggttttgtggccaagccccccccttttctggtcatggtacccgtacagggttgatggccacagctcgaaggggggcttttgtgtccccctggggggtcagtgttttcagtaccccctttttcccgggcccacttgggtttttacttatttttttattgtgggccagtgatggggggtggggggtgggccttccccgccccctccacccctgttgtgacctgtccttccgtacttaataaagggggggtgggagtgtta

SEQ ID NO: 504595 - DNA, 1193 bp, Homo sapiens
  misc_feature (1193)..(1193): n is a, c, g, or t
gcccgcgatccggcgccactcgggccaggcagggaccccgtccacggtccgggaccgtcccggacccggccccagcccgcgcctctccgcgccgtcccgcgctccgcagcgcgccctctccgtcgtcccctgtcctgtgtcggttcggtatcgtggtcatgctcagggggcatttccgtctggcgaggcgattgaaaatcctgtgtgtgggagtcggtttggccatgttccgttctcaggatggagggtgtcctttgggtaaggaagaaaacatcattttctcgttctctgggaaggtgaacatttgtagtgcattgatttcccggtagtctggttaacatggtgagaagatacttttaaagtcgtctgaatgcgtgtgcatgaaggtgaaacgatggaaggatctgatctgtgaggctgtggtggatgaaccataagtggtggccttggatatcacagtgtagatcgggtggtgatggggtggtgccttctggcttttgccctatctttacctgactgtgttcttcgcttccttgtctataaacgccttaatctttcttctttctttaattcttccttgggtcctattttctggggtacaagtggaaggaaatagcagggcatagtgtaaagctagatcttttgtgcacctgatgtgtactgaggttgaatcactagtggagacttctaaaattatgtctgaatacagttggagatccgggtgggacctcgtgatggagacctctcggggctatgggtttcactcttacatttaaactcctttgaacgtgtggtcccagggggaatacagggtgcctctctttgaaggcagattcatcacctcttctattgagttttcagggcactgaccagtttcccggacggggacgacagaattagttggccaccaaccaccattttggcttcctgaacacccgggggcctgttacgcctgggaagaacaagggggatgggtccccctgccagcacatgagccccagacaactacagcgaaacaggggggcgcagacacgctgcagacaaaaactccctatctcaccgtgaggtcgcaatgtcccgtcccctaccactaactcacgactgacattaaccgacgcactactaagaagaagcaacagagcgcgactacgaacaacatcgtggtcggaccaaccccgacgccaccgagaagn

SEQ ID NO: 504596 - DNA, 933 bp, Homo sapiens
ctctaccggggattggatggcgtgatgtctcacagaaagttctccgtcccagacatggttccctcggttccttgcctcggaagcgcagagcaggcatcgtgcgaaggtgaagagctccctaaggatgacccatccagcgggtcaaccttcacagcccttcctggatacaaggctgcatgatcacatcgtcgcgggaaagtcgaccatggccgggtactccacgggtgaccaagacaggcagtgtgctgaggctgtgacccattgtagagacaccacccatgttgttggtgggcattgtgggcttatgtgaaaaccccttcgaggcctcggacctcaggattgtctttgctgcggcccatcagtgcatgaattgcaaccaagggtcctatagagactggcataatctctacggaaagaggggcctttaccacatgtactggcaaggaaatgggcaggatgaggatggccaagaaaggcatggttgacgcaggggaccttcgagccagcttgaagaatgtactgccaggtccatccctgtgtcatattggcccaaaccaagaatgcgctggttccttctgcgcaagaaagaggccccaccttgattggacactcactgtgactcggagcgctggtgcccggagcacgctgattggcccgaaaaggttgccagcggtaccttgtaacccatgttgtttggcacgataaatgatccgcgtcatcgggtgcccaggggaaacgctcaaggggtccacgttttggccccaagaaggtgcccgaagaccacgagcctgcaagtgggcagattgggcatgaacatgcggacactttggacggggaaagttcacacggggggaccagattaaatgcgggcttaaagagggaagaaccgtatactagccctggggctaggaactttagtgcaaccctcacgga

SEQ ID NO: 504597 - DNA, 416 bp, Homo sapiens
  misc_feature (110)..(110): n is a, c, g, or t
  misc_feature (407)..(407): n is a, c, g, or t
aaaaaaacaaaaccgtgtgtgaaagaacaaggagcctgaaaactgcacctgccccacgaatcccaagtcccctcaacatcctacctctgtgaccctatggccaggagganccccggaaagggacatgtgcctcctcccaaggcagagcggctccccccacttttcagtttgtgcttttgtatgggtattagccggggttctctagagggacagaactaataggatatataatgggatatatatatatgattgtggaagtcaatacttaataacacaatcacaatcttgtgatcgtgaatgttaatacttaataaactcccatatgtgtgtgtgtgtgtgtgtgtgtgtgtgtgtgtctgtgtgtgtgtgtataaatgcttgtaaacagtaatctgccaaaaataaanaagtaaaac

SEQ ID NO: 504598 - DNA, 231 bp, Homo sapiens
tctagaggatcccaagctctgataggggaagaagaagggcaagaaggcgccagcatagggcgtctcacactgcgggcactgccccccttctgatggcgagttctatcgactgcttccagaacatcaagctggcgattaacttgctggcaaagctgcagaagcacatccagaaccccagcgccgcgtagctcgtgcacttcctcttcgggcctctggaccttatcgtcaaca

SEQ ID NO: 504599 - DNA, 180 bp, Homo sapiens
gtttgcctgttagttttgaggagcaggagtctcatgggggcttctgtagcccctctcaaaaaggagtctttattctgagaatttgaagcctgaaccctctttaatcttcagaatgattttattgaagaggccgcaagcccaaatggaaactgttttagaaatatgatgattttgattgct

SEQ ID NO: 504600 - DNA, 1569 bp, Homo sapiens
gtgttcactccagaggatctgcacatatgtaggacgagacaggatgagaagaaaaagagtagagacagagacgaggacccacgctggaggacggtagatttggtgtaccgcctgcttgctgctcgacccatgtgcgatggtatctcgtgctgcaagtttcttgcaacaatgatttgcggcatgttgcctgagcgatactatgatgaacatgctgtcctggaaaacttcactcatcctccatgcgttgtgtgacaaacaggagactacccagtgaactgtctgctcttgctccgcctatgtcttcgaggtcttccaccagtcgagcgtggggcccatctatcacatttacgcgtctggtctgtggacttgaagggggaccctaaaacttggctcattccaccacaaaatatccttcctaccctagtgtgatggtgtccttcctagtctcatactcatgtcttcttaatttgcggcgacgagggcgcttgtcgatcgtcaacaaggcggtttcgacctcctacgactgccttaatgatatacttcgtgtgcgactatgcccaccactctattcatgcatgcggtgccccccaaaaaacttttgcgtcagtgacgaagcttcgcatcttagtgcttgtgtgcactcgagggacaacgtgctatatacctcccccggatctgcgcggagactacaacagcatgcgcgctggtctcgacatacggccccacgtacttcgactccctgcggacagatattccaagcggaccaccttgcatgcgttcgagaccagcggcagccttgtacagaaccatatcctccctctcataggggtaagcatggcaacatgcgtcctttcttcgtccattcaaagagcccccctggatgtagggggccaagcaccccccaacgtatcccttccttgtcccttcgttccttcggccgcaaagctgtctaagcctccacccatcattttgggcgttcgggtacgccgcgcgtaatacctctcttcttttgttgcctgaggaggacagagaccccgttggcctgctttggacatgttttctagtgctccttcatctttcatgccaataccgattaaggtgccatgcttgacactttgtgtgttgatattccacgcggcgtcttgtagattactcatccatcccttttattttgttgcgccggcgaggcccggaagggcgggtgcgttgtcgtccccccggcgccgcatcttttttttaattatcattaaacatcctcctccgatactgtgcaggagagaacaccccccctttttgtttacactaccggcgtaatccccaactatttcctcgctgtgtagttcaccgtccgggccgcggaaaatagtcggaacgggggccgttgtctcctttttttaaacaaacaacagagcatagatcgacgcacgcggatctttattcgtcgggcgggcgacacaaatatgttcatgttcgtatcgcatgctcttcaacgtcgctccccacccattttttcattcaaaaagatgaagtaactaacgcggccccaataggggagtaattcaacgggcg

SEQ ID NO: 504601 - DNA, 1390 bp, Homo sapiens
gtccccctgcctctcggactcgaggctgcgtgcgtcagccttcttcgggcctcggccagcggtagcggatcgctcgcctcagccccagacgcccctcggactaccctcggaaccaggaccacgacagcgaccgaccgccctcggccgaccccgacgccggactgggccgcggaccgcagacccacgggctacgcgtagagcgccgaaccgctccacggcaaccagaccacacataatgagaccaccccggacataagaagagcggccaagagcagaccgaccgagcacacgcagacgaagccccacagaaaagccttgagccacagggagggaaaagaccggaggtgcgtagacagagagacaacaaaacaagtcaaacaccataaaccaaatccgcacaggagcgagcacccaaacacaccagttaaccagaccagaaggagcgcgacaataccacgggaggaggccaacgccacgtggtgatgtgaagcacatgcccggacaacgaaggcacagggaagaggacgaccctggcgaccaccatagggcacgcggacggccccgcgacagcgacgcacacacggccggggacatggacgccaacgcaccgtaaacacatcagaaccccgacgacacacggcaccacagagcgcacccgcggagcggaaaacagcgtacgaaaagaacgacacccgaacacagtggacccctcaccagcacaaacagcgggagtacctcacagacacggccatcggggccagacggcgggcccacacgcaggagccagaagcggacggcgaacaacacacaacgaagagatcgccacgacgagcagagacacgcacactccgagcgaaaccaataaaaagccaattggagcacacgcgaccaggccgtggaaaccacagagcacataagagaacagagcctgacaacaggcgccagagagcaccaagtaccacgaggaacccgacccacaggcaggtaacatgccccacgcaaacacaagacgtatgcgcaagcggaatgccaataggtcaaacagcaaccacgtgcggcatcacatccgagcaacgagccaaacagaaccgagaggcggcaccacaccaaatcggaagagggagcccaacatcgatgcacacagagggaccccggagcaggaacggaaccacagacgccaccagcagtaggccgagttcggcgaaacacgacagcaacgttgggcaagcgcggaccaggccaaacccactctgcgagaacaccaaaggaggagcaagatcgatcaaatgagcgcgcgaccacaagaaagaaggcacgacacacacgacaggcgagcgaccgcgagtagcagtgacacgaggcgtaggcggagtagaggagaggtaccgca

SEQ ID NO: 504602 - DNA, 94 bp, Homo sapiens
aaaaacggtctgccggtgtggagcctccaattgcagtggattcctcggggatagaccaaagacctcgacgaccctttcatcagaggaaaagggc

SEQ ID NO: 504603 - DNA, 246 bp, Homo sapiens
tgcaaaatgcatactgaggtgtcaggtgacattattttaggcttctcagctgacagagcaaacagatatatgtgggtatactaacctatgtaactacacatatctataactatttctgtatgtcgtaatctgtatctgtgttgagttaaacatgaattcttactgatttcttgagctctgatccattattacatagatcattctaaaccctgtcccttattgatctgaaaatctccactccagcaa

SEQ ID NO: 504604 - DNA, 121 bp, Homo sapiens
ctcgttcggggcgcattgcggtggctcttctgtggggctcttggggggcacattgcgggccgcgttgtggtgcgcctcgggtggctcgtgcgggtgctagctagaggctgcaataatgaag

SEQ ID NO: 504605 - DNA, 130 bp, Homo sapiens
  misc_feature (11)..(11): n is a, c, g, or t
  misc_feature (75)..(75): n is a, c, g, or t
  misc_feature (92)..(92): n is a, c, g, or t
cgggcacttanagggggagcagagaatccttatccaacatcaacatcttggccagatttgaactcttcaatctcntgcacccaaagcttgtnaagatagttaagcgtgcataagttgcccgccaatcgaa

SEQ ID NO: 504606 - DNA, 222 bp, Homo sapiens
taccagtaaggcttggtacggaagtggaggtgcgccgtgaaccctggatagtctgggaggcttccctgcttgggtgaagttgggagggcttggacccagatagtctgtgaggacttgttggcaggggcaaaggtgtaggtagctaggaaccatgagtgtctagggagctcctagggacaaagacagtaggggctgttggcttgggataccgataggtccagt

SEQ ID NO: 504607 - DNA, 401 bp, Homo sapiens
  misc_feature (213)..(213): n is a, c, g, or t
  misc_feature (235)..(235): n is a, c, g, or t
  misc_feature (311)..(312): n is a, c, g, or t
  misc_feature (382)..(382): n is a, c, g, or t
acgcactagtgtacgctactagtgctgtccgaaaagagctctctaaggcatctgctgagacagttataccaaatacgtgtgctgcagctagcttaccaagctgtttggagagtgatgaccaagtgaacaagtctgtatttcaggtttattcaacagtatgaatagactctatagcagatagcacaaaagaacatgctatgtccaaaaacgtcntggaaatcaaaatttatacccnattatattgctgagtcctagcactttcatttgactagagatcttacttctcagaattaaagccagaactgcagctnncctcacatacccacctatgaacttagatgtctgcaggtgacagaaaaaaatttgtcatgttcagcttctngtatttacatatctaatac

SEQ ID NO: 504608 - DNA, 874 bp, Homo sapiens
  misc_feature (43)..(43): n is a, c, g, or t
  misc_feature (93)..(94): n is a, c, g, or t
  misc_feature (180)..(180): n is a, c, g, or t
  misc_feature (264)..(264): n is a, c, g, or t
  misc_feature (417)..(417): n is a, c, g, or t
  misc_feature (427)..(427): n is a, c, g, or t
  misc_feature (430)..(430): n is a, c, g, or t
  misc_feature (433)..(433): n is a, c, g, or t
  misc_feature (440)..(440): n is a, c, g, or t
  misc_feature (443)..(443): n is a, c, g, or t
  misc_feature (458)..(458): n is a, c, g, or t
  misc_feature (478)..(478): n is a, c, g, or t
  misc_feature (481)..(481): n is a, c, g, or t
  misc_feature (483)..(483): n is a, c, g, or t
  misc_feature (511)..(511): n is a, c, g, or t
  misc_feature (521)..(521): n is a, c, g, or t
  misc_feature (580)..(580): n is a, c, g, or t
  misc_feature (594)..(594): n is a, c, g, or t
  misc_feature (674)..(674): n is a, c, g, or t
  misc_feature (868)..(868): n is a, c, g, or t
tcgtaatgtatacagacatatataccacgttctagtataaatntttcaaaaaatacaataataatataatttataaagaacactcttctatgnncaaccaccaccaccaaaaaaaaaaagccctcagaaaatttctcacaaataaggcaactaatgcctgatatctcaaaatcctttacnaaaggagatagttctagtcaaggagttttgggtatgttactttttttttcttctttttcttttcatctgcctccatctaagtgnatttcttcagctgtaagagctcccgtttcttattctttgctttcttaaccttttccttgatgctggccacatcaattttagtttcagtagaagcttccttaggtttcacaattggtttttccttagggggaataaatgctttgtttctttccncttgtctctnacnganggcttcngcntgtttagcctttatngcttccattttcggccgccnctncngatttgccttcaaaaaggattcaccacnagccaattcnttatcgatcggactgccggggtgggggggggggaagggcggagatgcggccggaacagngtggggcggggggnccgggcggggaggcacatgggggtgtctgaacggtggcaaaaatcgcgcccaactttgtgatcgtaattcagaatctttngccaactctctcttaatcattaagcttttaatgttataaattggatgaatattcttcatagtatcaaggactacttttctaacctcttttaagccactaaaaggtccaatggctgaaactgtgtttccctgaaccataatgtaacaattagttaagagttccaatgccttcaatgtagaacctttgggaccaanaagccg

SEQ ID NO: 504609 - DNA, 874 bp, Homo sapiens
gttgactgagttggattcttcctgtaccctcgggtcgtcgtgaggcatgtgtgcacgagcaaccagtccgccccaccaggccaagagggagggtacgctctattccggcaacaggggacaagcagcagtgtcctcggtagtggacccaacgccacagtgttaagtcccaccctgtgacgtggcggtgggcagccattgtgggacgactgggggctaggtgtgtccgctggcccactcccggtcccctgatgattatacctctcttgacaccatattgtagtactcaggttgtaggacctctgcgctgcttgattgaaagttagctctagtatcaagccgtatcggatggtgattcgatcgttgttgtggcgggctatctgaggggggatcccaggctagcactgggtgtcgacttgccctgtgaatccttgaggtaagagacaattctcgctcgatgcgaagggtgctaggacgggaagttagcgcgtggctcttacaagcgcatgcaatcgtcatggtcagagaaactcaggtccacgcggatgcttgcagcacacgtcctccgtgggtactatacctttgcctttagagttgttttcaactaagaatggttcccttggatattgggctttttcataaaaaacaagaaattgaaaacggaggaaggaggcggcgcgaccgggttctcaaaagggatactctcctatctcgagggggtagccactagagaggtccacggcggtccgccacgaattgctcatgcgtccacaaggcgtgggtcccataaaggaggagcatcgaccataaggaccgcataagggaggcgtagcgccggaccgtggcaaagaacgtgcgcggtgcccgggggaacacc

SEQ ID NO: 504610 - DNA, 152 bp, Homo sapiens
gaattggtgtccgttgtccgtctctcctcccgggaggtcttcgtggctactcccagaagaggagggaagcacgagtatgagggtactttggagactcgaagccgtgtagctccgagactggtagtaacttcagaacccaggatgcgcaggct

SEQ ID NO: 504611 - DNA, 277 bp, Homo sapiens
aaacagaaagtagttttattttttctaaataggattttgtcacaaaaatgctggtgattcaaacctttaaaacagaagctggtgattcaaacctttaaaacagaagagcatacaacctaagaaatgcaaaacaggctacaaacctgtacatcatgttactgcactgaatactgtattcactgaacataatggaaatactgtaggcactgtaacataatggtatttgtatctaacataaaaggtatagtaaaatacagtattatatatctatgagact

SEQ ID NO: 504612 - DNA, 503 bp, Homo sapiens
taaaaccctcatcaatagatggagacttacagaaatagtcaaaccacttctacaaaatgccagtatcagggggggggtttcgaagccaaagtgatgttgggtattgtaaagtgaaattattagtggggggatgaagcagatagtgaggaaagttgagccaataatgacgtgaagtccgtggaagcctgtggctacaaaaaatgttgacccgtaaatgccgtcggaaaagtgggtgaagggagaactcgaaagtactcgtgaggcttgctaggagggtaaaatagagacccagtaaaattgtaatgagccaggtgccttaaattatgtggggtctctcgggagtgtgtttcacatattgtagaacatatgtgggtgagcccctcagaggtgatggaatacctccggaagtgcagagttacaatccgagattgctgtataagggaaggtggaacctcacctaggggcacttcaggcggggggaaacgcctggtcccaaaccacca

SEQ ID NO: 504613 - DNA, 334 bp, Homo sapiens
  misc_feature (6)..(6): n is a, c, g, or t
  misc_feature (53)..(53): n is a, c, g, or t
  misc_feature (149)..(149): n is a, c, g, or t
  misc_feature (191)..(191): n is a, c, g, or t
  misc_feature (222)..(222): n is a, c, g, or t
  misc_feature (229)..(229): n is a, c, g, or t
  misc_feature (231)..(231): n is a, c, g, or t
  misc_feature (279)..(279): n is a, c, g, or t
  misc_feature (319)..(319): n is a, c, g, or t
  misc_feature (334)..(334): n is a, c, g, or t
cttctnccacggtaaccatgtgacgaaccgaaagccgtgatcaaaaatgcggnacatgtcggaaagagaatgcaacaggactcgtggaagtgcgactactcaggacgctggaagaaaatacaacatagagaaggacattgacggctaanatcaagaagggaatttaacaaggaagtacaatcccacctggnaattgcatcgtggggaggaacttcggtagtnatgtaananatgaaaccaaacacttcatctacttctacctgggccaagtggccattnttctgttcaaatctggttaaaagcatggactgtgccacanacccagtaatccatn

SEQ ID NO: 504614 - DNA, 993 bp, Homo sapiens
ggctggctgggctgatggctggcgtggagtttttgtccataacctggtgcaacctgcgcagctggagtgatggcctcactcgtgggcctgcctgcagctgttggtgtgagcaggccgtccgtggtggctgagtgctggagcctggggccccgctggtgtgccgcccgccgccggcctcaccgtcctctctgtggtgcccctgtccccctgcaggctggggaacctctctacaactggcagtgctgaccaatggccgtcgctgaagtgagctgcttctgccttcctcttcaactcgtgatgctgctgaggcgatgtgctgcttcgtactgggcaagggtggtctgcggcgcccgccgcccgcttggtgtggccccgcagctgccatccccgcccacctgcttcgttgctggctgggcggcagcgccgtctttgacgccatgttcactggctggcatggccaccacgtcggccgagatcgagctggcggacgtggagcccgcagccttcctggcgctggctgagatttctatattcagatgaagttcaaattggtccagaaacagtaatgaccactctttatactgccaaggaaatacgcagtcccagacttggaagcacactgtgtagaatttctcaccaaacatcttagggcagataatgcctttatggtacttactcaggctcgatatttgatgaaacctcagatgctaaccttggtctagattcagtagaaaaagggacaatggatggaatcagtgcgaaggtttactgggtattgaaataggaaactcaggtgaagataaagaagaaggtcgtatagagagaatgaatttggagtgtgaatgctggaaaggaggagagttagagcagatagctggactgaggatagggtgagatgttatattttcttccggaaagagaaatgaagcggaatgatgaaggagtaaaaaaaaggacagaggaaagaaaggaacaaagaaaaaaaaatggggc

SEQ ID NO: 504615 - DNA, 478 bp, Homo sapiens
accagcttcgtggggttgaccaggcttagtacatcagagtctgctaaagtcctaccagtggaagatgcgtcaacaccatcctccttgctggagcagctgaactgagcagtttaactgggtgtcccggctggcaaacctcatgcatagcgaagaccagtactatctgcgggtcacacggtggattcccacacttctgattcggacgttccttccggtgtcacttgacgtggtcgtgaatttcaaagacccctgatcgccattcactgtgacggtccctgtagaagtctccaggaagaaccctaaatttatggagaccgtggcggagaaagcgctgcaggaataccgcaaaaagcaccgggaggagtgagatgtggatgttgcttttgcacctacgggggcatctgagtccagctccccccaagatgagctgcagccctccagagagagctctgcacgtcaccaagtaaccaaacccgag

SEQ ID NO: 504616 - DNA, 742 bp, Homo sapiens
  misc_feature (363)..(363): n is a, c, g, or t
  misc_feature (394)..(394): n is a, c, g, or t
  misc_feature (412)..(412): n is a, c, g, or t
  misc_feature (425)..(425): n is a, c, g, or t
agcggggggggggtatccaggacgaggagagggaggagtcgccatcgcctccgcctccgcctcctccggtgggaggggggctgagggaggagacggtggctgatcttgggatgttctggaagaagagaatttatccaaagattaaaactggaagcaacccttaatgtgcatgatggtggtgttaatacaatcggtgggaatgacacgggagaatatatttatcgggctcagatgacaccaaattagtaattagtaatccttacagcagaaaggtttggacaacaattcgttcagggcaccgagcaaacatatttagtggcaaagttcttacctgtgtacaaatgataaacagatggtatccgngtcgggagatggagtaatattttataccaangttgagcaagatgcaganaccaacagacaangccaatttacgtgtcattatggaactacttatgagattatgactgtacccaatgacccttacacttttctctctggttggtgaagatggaactgttagggggtggatacaggcatcaaaactagcttgcacaaaagaagatgtgtcacagatgatattttaattaactgtcgacgtgctgccacgtctgtggctatttgccaccaataccatattaccttgctggtggttgtctgggacagtcagtacgaactatatgatcggcgaatgctgggacaagagtacagggaattatgcaggtcgagggatacgggaatg

SEQ ID NO: 504617 - DNA, 687 bp, Homo sapiens
agcgggagcgtccgcggcccgcgcgcccgcgcggcggaggagaggtgttaagtgtgatgcttccataatacatttggatgctgtcagctaagttcacttctgaactaaggggttcctccaaatgttggctgaaattcatcccaaggctggtctgcaaagtctgcaattcataatggagctactgtactggctattggaaggaggagattctgaagataaggaggtaaaacctgtttagaaattaaaaatgagttacgatttaaagaaaattcagatgactcattgtgagtgctagttctcttgtaggatgccactggaaatgttgaaatgaaaaatattcagccgttggtctttgaaatttcctgtgatgtgtttcaatctagatgcaaagaacatggaaaaatcaaagtgctcgagtggtttaaatatgttttgggtattcctgtttatagactataatacttttccaattaaaatcctcagttgtcacgcagaagaaggttaagctgtatttgattgccagttttactgaaaatgcttagtattttacagtatcaccaaatatattttgtttagccaaggtataggaaaaataaaataaattgtataggttgacttttttctaaaatgtctttattggattgaatgaatgtttatacctgaaaaaaaaaggttcaaaaaaaaaaa

SEQ ID NO: 504618 - DNA, 589 bp, Homo sapiens
gggggcaatttgacagtttatgtagactatagcattaatgttcccaaatgttcagtgcatcctggctaatgtgttattgaaggtgttttcacgtaagcagttagaggaagcacttcacccctattactaagttattaaaatgcctcctaaaggtagcattttaaattagtatacataattgattagtaatttgtcttctcccaagcataaaacagcatagcagagttaagtgtgaccagtgaagtataagatattagggattgatggtgacaatgatcatagcaactaaatggattttttttttcttttagattcagccgttggtctttgaaatttcctgtgatgtgtttcaatctagatgcaaagaacatggaaaaatcaaagtgctcgagtggtttaaatatgttttgggtattcctgtttatagactataatacttttccaattaaaatcctcagttgtcacgcagaagaaggttaagctgtatttgattgccagttttactgaaaatgcttagtattttacagtatcaccaaatatattttgtttagccaaggtataggaaaaataaaataaattgtataggttg

SEQ ID NO: 504619 - DNA, 418 bp, Homo sapiens
acaaaaaaaggaaacaggttcttgcccctgtttgcccaggctgaagtgccgtgacacgatcatagctcactgtggcctcaaatttcctgggctcgattgatttctcctgcctcagtctcccaagtagctggaaccgcagttacttgccaccatgctaggctatttttatttttattttaaaaaaattaaatttttttttatttttattttgggcaacattgctattgtttgccctagacgtggtcttgaccctcctgtggcttcaggctttctccttctttgccctcggcccacccaaaagttgctgggatttgcaggttgtgaccttgccattgccctggcttttcatattctcatatttcataggagattaagctttttagagcctttcacattttgagttgttgaccttgtggat

SEQ ID NO: 504620 - DNA, 507 bp, Homo sapiens
ataaacaagctggtaatagcaggaaagtaagtatttgaataagatgtcaaactgatatttcatgtgaacctaactcattttatggtaactaataattatcttatttaaatcaataggtaaaacctgtttagaaattaaaaatgagttacgatttaaagaaaattcagatgactcattgtgagtgctagttctcttgtaggatgccactggaaatgttgaaatgaaaaatattcagccgttggtctttgaaatttcctgtgatgtgtttcaatctagatgcaaagaacatggaaaaatcaaagtgctcgagtggtttaaatatgttttgggtattcctgtttatagactataatacttttccaattaaaatcctcagttgtcacgcagaagaaggttaagctgtatttgattgccagttttactgaaaatgcttagtattttacagtatcaccaaatatattttgtttagccaaggtataggaaaaataaaataaattgtataggttg

SEQ ID NO: 504621 - DNA, 257 bp, Homo sapiens
attttttaaaaccctttaaagccaaaaatttttcccgggggggccggtttttgagggattttttaaccttggggttttcaaatttttaatttgtctctagaaattttttttttttttttggggtttttttttttacccctttttgggggtttaaaaactattttttttgccctaaaatggtcccccccaaatttttttgttttgttcccgttttttttgtgggaggtttttttttcaaaattaaaaatggggatcca

SEQ ID NO: 504622 - DNA, 662 bp, Homo sapiens
gggggcaatttgacagtttatgtagactatagcattaatgttcccaaatgttcagtgcatcctggctaatgtgttattgaaggtgttttcacgtaagcagttagaggaagcacttcacccctattactaagttattaaaatgcctcctaaaggtagcattttaaattagtatacataattgattagtaatttgtcttctcccaagcataaaacagcatagcagagttaagtgtgaccagtgaagtataagatattagggattgatggtgacaatgatcatagcaactaaatggattttttttttcttttagattcagccgttggtctttgaaatttcctgtgatgtgtttcaatctagatgcaaagaacatggaaaaatcaaagtgctcgagtggtttaaatatgttttgggtattcctgtttatagactataatacttttccaattaaaatcctcagttgtcacgcagaagaaggttaagctgtatttgattgccagttttactgaaaatgcttagtattttacagtatcaccaaatatattttgtttagccaaggtataggaaaaataaaataaattgtataggttgacttttttctaaaatgtctttattggattgaatgaatgtttatacctgaaaaaaaaaggttcaaaaaaaaaaa

SEQ ID NO: 504623 - DNA, 475 bp, Homo sapiens
  misc_feature (51)..(51): n is a, c, g, or t
agatctcaaagtgcactcttctatatctacttgctctgtccaggcagtatnatcaggtaatgccaagttgatgagaagaaatggctataatttcattgaatatttgagttggggttattttcagcttttgtacttttttagccacaccaagcatttaacgtttcatgttcacaagaagggattcttgtttgctttttactctaatctttggaggtataacttcctttgtggtctctgacaatcacaatgttagttcagctaatatgtctccagctcacattggggtctgtgttactgtgctgggtatgctatgtgtttgggatggacaaaggaagatgtggccccgccttcgaggcggcctggttaggggcacactgcaaaggggcacttggtatggtggaaacagcactgcaggcaggaggagaaaggctttctgtgtgtgttgtggttggtagatatagaagagtgccttttg

SEQ ID NO: 504624 - DNA, 596 bp, Homo sapiens
gggggcaatttgacagtttatgtagactatagcattaatgttcccaaatgttcagtgcatcctggctaatgtgttattgaaggtgttttcacgtaagcagttagaggaagcacttcacccctattactaagttattaaaatgcctcctaaaggtagcattttaaattagtatacataattgattagtaatttgtcttctcccaagcataaaacagcatagcagagttaagtgtgaccagtgaagtattcagccgttggtctttgaaatttcctgtgatgtgtttcaatctagatgcaaagaacatggaaaaatcaaagtgctcgagtggtttaaatatgttttgggtattcctgtttatagactataatacttttccaattaaaatcctcagttgtcacgcagaagaaggttaagctgtatttgattgccagttttactgaaaatgcttagtattttacagtatcaccaaatatattttgtttagccaaggtataggaaaaataaaataaattgtataggttgacttttttctaaaatgtctttattggattgaatgaatgtttatacctgaaaaaaaaaggttcaaaaaaaaaaa

SEQ ID NO: 504625 - DNA, 474 bp, Homo sapiens
gacctaggctgaggtcaagaggtcactgactttccaaggtggtcgtagtggtggagttggagttgaacacaggcctgaccctagcagtccacaccctgagccaaatcaattatattgcatcttgggtccataaaccctaatccataatcccatcaagaaaagctctgctgctcttagctctaaataattcagaatctattctcttctctccagtcccgtagttatagtcttcactcatagacttaagatgatcccatcaccagagaggtttctctaccattagcttccctcttccggccattcttcacaaagtcatatttctaaattctgtgtcacatacgatgatggcatttctggaaattccttcaggtgctctcaagccctgctgcagagatcctttacagagcacacacagtaccagcccatctgtctcaccctctccggtagtatccagctccaagacaaacttcagcc

SEQ ID NO: 504626 - DNA, 252 bp, Homo sapiens
gttttgttattttagtagcagaaatgggatgattgttaaagttcccccaaaatggtggcaggaaattaatttttccctccttaaagtcaagggccgtagaggaagaaaaacttttttttcatatcatgccctatgtaaacagacccattttgctatttgggtcatcaggaaagggtaagggggaggggagagaccaccctagacatttgcatttttgtaagttagccagccaataaagaaaagcagaatgga

SEQ ID NO: 504627 - DNA, 858 bp, Homo sapiens
ataaacaagctggtaatagcaggaaagtaagtatttgaataagatgtcaaactgatatttcatgtgaacctaactcattttatggtaactaataattatcttatttaaatcaataggtaaaacctgtttagaaattaaaaatgagttacgatttaaagaaaattcagatgactcattgtgagtgctagttctcttgtaggatgccactggaaatgttgaaatgaaaaatgtaagtatatctttggtggaaaaaaggatagtctctaggacacaaaattactgttttatttttttctcaggagtttgcctaagggtgtgacagatgatctctgtcacttgtcttagttgtgtcctgcaataaactggatgctttataaaatactagacctgtgatttcgtatgctgtaatatttcatttctccatcacccctccaaattatttcttagttggagtaaaataataaatgtattatagtcaacatctcttgacccctctttagtttcagctaaactaagcatgtgtgttgtgtgttcattttatagttcatgtgtagaactatgtgaattaaatttaagaaacatgtaaagtagaggaaatagttttctggagaaatttttccttttggatattatgcccttttccattgcttttctctgcttgaaagcaaaaaaaagtaccctaccccctgttctcctttagggaaaaactattcctataaagtatttttaaatcgtgcaagtcattgcctaggttagctaaaacatttctttttaacaaaggagaaaatgcccctggctttaacattttcttgtattgtatctattaagataacagtttactttgatacgtacatacca

SEQ ID NO: 504628 - DNA, 929 bp, Homo sapiens
gggaggagaggtgagcccccgcccgggccaggccctctggccgcgccgtccgcccctctagtcgtgtcccctcgtgggccgaacggacgcggcggtgccccgcgcccgaccagacgtcccgtgggctagggcctgggcctcgggccgcgtcggcgccggtcgagcctctccgggtgtcggggttcggggcgggcgcgcgtgggcgtggctcctctgtccacgcctgttcccttcgtcgccgcggctctcgtccgggacacggctttccggagtagagcccttggaggtgttaagtgtgatgcttccataatacatttggatgctgtcagctaagttcacttctgaactaaggggttcctccaaatgttggctgaaattcatcccaaggctggtctgcaaagtctgcaattcataatggagctactgtactggctattggaaggaggagattctgaagataaggaggtaaaacctgtttagaaattaaaaatgagttacgatttaaagaaaattcagatgactcattgtgagtgctagttctcttgtaggatgccactggaaatgttgaaatgaaaaatattcagccgttggtctttgaaatttcctgtgatgtgtttcaatctagatgcaaagaacatggaaaaatcaaagtgctcgagtggtttaaatatgttttgggtattcctgtttatagactataatacttttccaattaaaatcctcagttgtcacgcagaagaaggttaagctgtatttgattgccagttttactgaaaatgcttagtattttacagtatcaccaaatatattttgtttagccaaggtataggaaaaataaaataaattgtataggttgacttttttctaaaatgtctttattggattgaatgaatgtttatacctgaaaaaaaaaggttcaaaaaaaaaaa

SEQ ID NO: 504629 - DNA, 856 bp, Homo sapiens
gggaggagaggtgagcccccgcccgggccaggccctctggccgcgccgtccgcccctctagtcgtgtcccctcgtgggccgaacggacgcggcggtgccccgcgcccgaccagacgtcccgtgggctagggcctgggcctcgggccgcgtcggcgccggtcgagcctctccgggtgtcggggttcggggcgggcgcgcgtgggcgtggctcctctgtccacgcctgttcccttcgtcgccgcggctctcgtccgggacacggctttccggagtagagcccttggaggtgttaagtgtgatgcttccataatacatttggatgctgtcagctaagttcacttctgaactaaggggttcctccaaatgttggctgaaattcatcccaaggctggtctgcaaagtctgcaattcataatggagctactgtactggctattggaaggaggagattctgaagataaggaggtaaaacctgtttagaaattaaaaatgagttacgatttaaagaaaattcagatgactcattgtgagtgctagttctcttgtaggatgccactggaaatgttgaaatgaaaaatattcagccgttggtctttgaaatttcctgtgatgtgtttcaatctagatgcaaagaacatggaaaaatcaaagtgctcgagtggtttaaatatgttttgggtattcctgtttatagactataatacttttccaattaaaatcctcagttgtcacgcagaagaaggttaagctgtatttgattgccagttttactgaaaatgcttagtattttacagtatcaccaaatatattttgtttagccaaggtataggaaaaataaaataaattgtataggttg

SEQ ID NO: 504630 - DNA, 556 bp, Homo sapiens
  misc_feature (53)..(53): n is a, c, g, or t
ggccgagactgacttatacctggaccacacaaaaaaacacgcataaatgaagntaaaactgatttgcttacttcttccggattacaagtatcgaggcacggttgcgtgaactgcaaaaggacgtggagagataacctttctttcctctagctgggccattatttcctttcgtcggcgatgtagttcatctagactaggatgaggctggggaggaggaggaagccggctataaggaggttcctaaaaatagaaagattagttaaaattgaaagagaatttcaggacagattaattcatttaatatactcagcgtatattttaagttatgaaacagcttgtatacccttcttaacatttggaaacaccaacacttaacagaacaaagtaaaacaaaaccccccaaactctcaagatcttccaaatagctaaatttaggtttcttttatttggtcataattaccaagtagatctagaattgttaattaaaccatctaaagttcagaaactaagaaaggttaattgtggggacgaggcagatttttttctcattataata

SEQ ID NO: 504631 - DNA, 991 bp, Homo sapiens
gctggggtggctgcctcgccgcgccgtctgttattgtgctgcgcgtgcccgacgtggtgcgtccctctgcgcggtagtctaccgctgtgtggtcttgaggcatgctgctatcatcgaggttcgcaagtgtccgggcaggcttgtggcacacatatgcccccctgaccgcgggttatcctgctctcggtttctgctgtctccccccccattgtgccccccccgaagccccgtgttgtggggtcccacccgggtcgcgtgctaaggccagttctgtgtccgggagcgccagtcctttccgcctccgtgtggtgttcaacctgggggcagcgcgcccaatttcttgcggccttctgcggggagccgcccctttgtacttggcggttctctggcgccgcgccccacttcttgtgaggaagtgcttgtgcaagcaaggcaccccccatgggggttggcccctgcgcggtgctgcgagagaaagttggccgacacgaccccagcacaccgggtgggcgtcgctccgacacaatccactgggtcccgaccgcagcgtctttggcgtttgggtcaccgcgtcacttccagcatttcttctctcgcgccagcgactaccacagtgccttcatgggatcaatttcccccccccagatatcccccccccccctctcttatcaatcacttgttgcaaagactcgttcttccataacctgttttctcaccagctgccctactatacaacttctgtgctctgtcagaataccctgttcttctaatagacacaccaacacgtgtgtacaatccctcccacaagaacaaaaacgtcgaatattttattcaaggtcccccctgccgccttgtttttaaggacatcacgtccaaaatttattcgattattgtcagtagttccaacctcgcaattgtttatccatacagtctaacggtgcccacccttccccccggcattcttggcaccccttttaaacccaacaaaaca

SEQ ID NO: 504632 - DNA, 531 bp, Homo sapiens
agcgggagcgtccgcggcccgcgcgcccgcgcggcggaggagaggtgttaagtgtgatgcttccataatacatttggatgctgtcagctaagttcacttctgaactaaggggttcctccaaatgttggctgaaattcatcccaaggctggtctgcaaagtctgcaattcataatggagctactgtactggctattggaaggaggagattctgaagataaggaggatgccactggaaatgttgaaatgaaaaatattcagccgttggtctttgaaatttcctgtgatgtgtttcaatctagatgcaaagaacatggaaaaatcaaagtgctcgagtggtttaaatatgttttgggtattcctgtttatagactataatacttttccaattaaaatcctcagttgtcacgcagaagaaggttaagctgtatttgattgccagttttactgaaaatgcttagtattttacagtatcaccaaatatattttgtttagccaaggtataggaaaaataaaataaattgtataggttg

SEQ ID NO: 504633 - DNA, 951 bp, Homo sapiens
  misc_feature (64)..(64): n is a, c, g, or t
agaagagtggaatgataatatagaccaccgagtgccgcagttatccgagcttttaaagtgcctnttcttcctcctgatacatacagtggtcgtgacccctttttccgtaccaggtaggtgccgcatcacataagtggcgctcctacaccttctaaaacaaggtctaactgtaacatataaaccccacaaatttggcgcctggctctcccccttattatcgtacttggatcttcccccctgtggaaaccgtgtgattccacgccctaggcatttatattcgctgacgaccctatcattacccttctcttccccccctccaatctttttggttcctgtccccccctccccccgttaattgacaatcccgcctttttacccccccctgtttttatggcctttcccccagtcccccccaatactacagcgtgctttctataacacacccctggtcaacaaggcggccatttttcaataacaggttcagaagtatatgcgccacccatgacacccaccccctgcgagatgttccctcgggagcccacactagcaccacaacgtgcttgttgtacaacacccgggttccttcataacccaccgcctctgattatacatttttcatacaactggcgggtcttcaaaccccccccaagagcacttttgaaaagtgcctttcattcaacccccctcccatgccctcacaaaattggctttaccacaaacctctgtgcgaacctcatgttccaactgcccagattctccgcatccacgagtgatgaccacttgttcagaaggccctccttgtcaacaaacacattgattggattcagtcttctggtcgctacataaaattttttcggttccattttctttcttcttcaaaacacactcacgcaaatctacgtccccttttcgccaaaaaataaaatcgccgcccccgaaaaacaaaaacaa

SEQ ID NO: 504634 - DNA, 318 bp, Homo sapiens
aaagagaggattagcctgaggccagagagtttgaggctgcagtaagttgtgattgtgccactgtactctagcctgggagacagaatgagaccctgtctcttaaggaaaaaaagaaatcacgctatctacttataacgcatccgcttatacaaaatacacctccctgaacttcccctttaggctaataccctatcagggcttggagagtggcccacttgccggatgatctgtgagatggtcacaatgtaggccagatgccaaggggtaatcaggtgacaatgccaactggcaggactaacagaggtcatttacggtaga

SEQ ID NO: 504635 - DNA, 200 bp, Homo sapiens
  misc_feature (27)..(27): n is a, c, g, or t
  misc_feature (40)..(41): n is a, c, g, or t
  misc_feature (58)..(58): n is a, c, g, or t
  misc_feature (62)..(64): n is a, c, g, or t
  misc_feature (77)..(77): n is a, c, g, or t
  misc_feature (122)..(122): n is a, c, g, or t
  misc_feature (136)..(136): n is a, c, g, or t
  misc_feature (158)..(158): n is a, c, g, or t
  misc_feature (170)..(170): n is a, c, g, or t
  misc_feature (182)..(182): n is a, c, g, or t
tttagggtgattttttaaaaagacttntgcaatacatttnnaggtgaaacttagtggntttnnnctgataaattagngcatttaattgactattttattcaggttgatctgttgaatatttnctaaagaccagttntttaagctaagacatgtaaaanatcccaaatggnagtacctcattntttacttagcttttgtac

SEQ ID NO: 504636 - DNA, 450 bp, Homo sapiens
  misc_feature (50)..(50): n is a, c, g, or t
  misc_feature (99)..(99): n is a, c, g, or t
  misc_feature (117)..(117): n is a, c, g, or t
  misc_feature (122)..(122): n is a, c, g, or t
  misc_feature (127)..(127): n is a, c, g, or t
  misc_feature (129)..(129): n is a, c, g, or t
  misc_feature (134)..(134): n is a, c, g, or t
  misc_feature (138)..(138): n is a, c, g, or t
  misc_feature (145)..(145): n is a, c, g, or t
  misc_feature (151)..(152): n is a, c, g, or t
  misc_feature (172)..(172): n is a, c, g, or t
  misc_feature (175)..(175): n is a, c, g, or t
  misc_feature (177)..(177): n is a, c, g, or t
  misc_feature (183)..(183): n is a, c, g, or t
  misc_feature (194)..(194): n is a, c, g, or t
  misc_feature (197)..(197): n is a, c, g, or t
  misc_feature (204)..(204): n is a, c, g, or t
  misc_feature (208)..(209): n is a, c, g, or t
  misc_feature (214)..(214): n is a, c, g, or t
  misc_feature (292)..(292): n is a, c, g, or t
  misc_feature (303)..(303): n is a, c, g, or t
  misc_feature (305)..(305): n is a, c, g, or t
  misc_feature (318)..(321): n is a, c, g, or t
  misc_feature (338)..(338): n is a, c, g, or t
  misc_feature (349)..(349): n is a, c, g, or t
  misc_feature (351)..(351): n is a, c, g, or t
  misc_feature (386)..(386): n is a, c, g, or t
  misc_feature (403)..(403): n is a, c, g, or t
aaagccctaatggcgcgtaccctattaaaattcaggacctctccaatatnctccctctccgttattaactctccgtcatctcttcttttccctttaaanaaacattttcacggtttntcccncacangnccatntacnttcttgnctatcnntatacaattcaaaacatctnttncncacttngactgtcaccntcnccaggcnggcnnttganatcttattttttttccaactcatttttattaaaaaaataaaaaaatccccccactatcagctttacaaaatctctaanggaaacacaanancaaggtgctgagnnnnaaacacctgcggtagcntcttctgtgtntntttctcgttaaaaaaatctgtgaatttaacgcccngggccaacaaccttggnaaatttctactttcctccacattttttttttttaaagaaaggccccg

SEQ ID NO: 504637 - DNA, 494 bp, Homo sapiens
  misc_feature (388)..(388): n is a, c, g, or t
  misc_feature (397)..(398): n is a, c, g, or t
  misc_feature (400)..(400): n is a, c, g, or t
gccgcaggactgggagcggtctccgcagggactgggagcgggctccgcagcgcactctagcccgcggctcggctcagtcggtctgcgaggatccggcccgccgccccccgggggacccgatggcctcggagggcctggcgggggcgctggcttccgtgctggctggccaggggtccagcgtgcacagctgcgactcggcgccggccggggagccgccggcgcccgtgcggctgcggaagaacgtgtgctacgtggtgctggccgtgttcctcagcgagcaggatgaggtgctactgatccaggaggccaagagggagtgccgggggtcgtggtacctgcctgcggggagaatggagccaggggagaccatcgtggaggcgctgcagcnggaggtaannangaggcggggctgcactgtgagcccgagacactgctgtccgtggaggagcggggcccctcctgggtccgcttcgtgttcctcgctcgccccacag

SEQ ID NO: 504638 - DNA, 175 bp, Homo sapiens
ctttggcccccccgggttttccctttttggtttcgggttggtttttgggggggatttgtgaggggttccctttttcccccgggaaccgtttttgcctggtttcggtttttattcggcccccttttggggatttggcccctggggcccaaaatttgggccggggccttggcccgga

SEQ ID NO: 504639 - DNA, 153 bp, Homo sapiens
gtgggagaatctggtgaacaaggacgtgcggagtcgtgcacacccagctacaccctgcaaggctaggtcagcggcgccaccagctccacccagtgatgccaggaggaccggtgcaatgagaagctgcacaacgctgctaccactcgcaccgct

SEQ ID NO: 504640 - DNA, 1053 bp, Homo sapiens
  misc_feature (14)..(14): n is a, c, g, or t
  misc_feature (26)..(26): n is a, c, g, or t
  misc_feature (209)..(210): n is a, c, g, or t
  misc_feature (213)..(213): n is a, c, g, or t
  misc_feature (224)..(224): n is a, c, g, or t
  misc_feature (227)..(228): n is a, c, g, or t
  misc_feature (230)..(230): n is a, c, g, or t
  misc_feature (237)..(237): n is a, c, g, or t
  misc_feature (258)..(258): n is a, c, g, or t
  misc_feature (270)..(270): n is a, c, g, or t
  misc_feature (284)..(284): n is a, c, g, or t
  misc_feature (336)..(336): n is a, c, g, or t
  misc_feature (372)..(372): n is a, c, g, or t
  misc_feature (384)..(384): n is a, c, g, or t
  misc_feature (484)..(484): n is a, c, g, or t
  misc_feature (503)..(503): n is a, c, g, or t
  misc_feature (546)..(547): n is a, c, g, or t
  misc_feature (562)..(563): n is a, c, g, or t
  misc_feature (568)..(568): n is a, c, g, or t
  misc_feature (571)..(571): n is a, c, g, or t
  misc_feature (600)..(600): n is a, c, g, or t
cggcatatggatcncaggcagcagtnagcccgcgcccgcctgtgtgtccccagagccatggagagagccagtctgatccagaaggccaagctggcagagcaggccgaacgctatgaggacatggcagccttcatgacaaggcgccgtggagaagggcgaggagctctcctgcgaagagcgaaacctgctctcagtagcctataagaacnntgntgggcggccanagnngntgcctgnagggtgctgtccagtattgangcagaaaagcancgaggagggctcgngaagcgaacgaaggggcccgaggtgcgtgagtaccgggagacacggttggangacttgagctccagggcgtgtgcgaaccgtgctggncctgctggacanccacctcatcaaggaggccggggacgccgagagccgggtcttctacctgaagatgaagggtgactactaccgctacctggccgaggtggccaccggtgancgacaagaagcgcatcatngactcagcccggtcagcctaccaggaggccatggacaatcagnnaagaaggagatgccnnccacnaancccatccgcctggtgcctggccctgaacntttccgtctcttaccactacgagatcaggcaacagccccgaggaggccatctctctggtcaagaccaattactgacgagggcatggcatgatctgcacaacctcagacgaggacttccgtactaaagacgagcaccgcgtcatcatgcaggcgtgctgtgagataactgacactgtggaactgactcgacaaacgaccggggaagaggggaggcgaggctccccaggagtgcaccagagctgagtctgttgctccgtaatggcaagaagacatgcctcaaaacatgacgcactgtcacttcaataaacggcaactgctctatgcagacttcactattggtatcttggacaaatagatggacaaatcaaaagggaacatttccattaacctgacaggcacccagtaaatgcctgttcacctgcaacacgtgccctatctatcggaaataaaacg

SEQ ID NO: 504641 - DNA, 110 bp, Homo sapiens
cctagtttagaagtttcaatagcatgaatagtcaaagcacaagcgagtgggccgggggttctaggactaggtgctattgaaacttctaaaactagggggtaccgagctcg

SEQ ID NO: 504642 - DNA, 801 bp, Homo sapiens
  misc_feature (33)..(33): n is a, c, g, or t
  misc_feature (79)..(79): n is a, c, g, or t
  misc_feature (83)..(84): n is a, c, g, or t
  misc_feature (89)..(89): n is a, c, g, or t
  misc_feature (95)..(96): n is a, c, g, or t
  misc_feature (110)..(110): n is a, c, g, or t
  misc_feature (158)..(159): n is a, c, g, or t
  misc_feature (178)..(179): n is a, c, g, or t
  misc_feature (186)..(186): n is a, c, g, or t
  misc_feature (229)..(229): n is a, c, g, or t
  misc_feature (236)..(236): n is a, c, g, or t
  misc_feature (243)..(243): n is a, c, g, or t
  misc_feature (245)..(245): n is a, c, g, or t
ataaccatgcacactacgtataaccaccctaancctgacttccctaattccccccatccttaccaccctcgttaacccntaannaaaanaactcnntacccccattatgntaaaatccattgtcgcatccacctttattatcagtctcttccccacanncaatattcatgtgcctagnnccaaganagttattatctcgaactgacactgagccacaacccaaacaacnccagctnctccctnanagcttcaaactagactacttctccataatattcatccctgtagcattgttcgtgacatggtccatcatagaattctcacgtgtgatatataaactcagacccaaacattaatcagtgcttcaaatatctactcatcttcctaagttaccatactaatcttagttaccgctaacaacctattccaactgttcatcggctgagagggcgtaggaattatatccttcttgctcatcagttgatgatacgcccgagcagatgccaacacagcagccattcaagcaatcctatacaaccgtatcggcgatatcggtttcatcctcgccttagcatgatttatcctacactccaactcatgagacccacaacaaatagcccttctaaacgctaatccaagcctcaccccactactaggcctcctcctagcagcagcaggcaaatcagcccaattagggtctccaaccctgactcccctcagcctttttagcccaggaaacagccttagccatgattcggtctttcccgtgacgtagttttaccctcaggagcgagctatggc

SEQ ID NO: 504643 - DNA, 886 bp, Homo sapiens
  misc_feature (33)..(33): n is a, c, g, or t
  misc_feature (79)..(79): n is a, c, g, or t
  misc_feature (83)..(84): n is a, c, g, or t
  misc_feature (89)..(89): n is a, c, g, or t
  misc_feature (95)..(96): n is a, c, g, or t
  misc_feature (110)..(110): n is a, c, g, or t
  misc_feature (158)..(159): n is a, c, g, or t
  misc_feature (178)..(179): n is a, c, g, or t
  misc_feature (186)..(186): n is a, c, g, or t
  misc_feature (229)..(229): n is a, c, g, or t
  misc_feature (236)..(236): n is a, c, g, or t
  misc_feature (243)..(243): n is a, c, g, or t
  misc_feature (245)..(245): n is a, c, g, or t
ataaccatgcacactacgtataaccaccctaancctgacttccctaattccccccatccttaccaccctcgttaacccntaannaaaanaactcnntacccccattatgntaaaatccattgtcgcatccacctttattatcagtctcttccccacanncaatattcatgtgcctagnnccaaganagttattatctcgaactgacactgagccacaacccaaacaacnccagctnctccctnanagcttcaaactagactacttctccataatattcatccctgtagcattgttcgtgacatggtccatcatagaattctcacgtgtgatatataaactcagacccaaacattaatcagtgcttcaaatatctactcatcttcctaagttaccatactaatcttagttaccgctaacaacctattccaactgttcatcggctgagagggcgtaggaattatatccttcttgctcatcagttgatgatacgcccgagcagatgccaacacagcagccattcaagcaatcctatacaaccgtatcggcgatatcggtttcatcctcgccttagcatgatttatcctacactccaactcatgagacccacaacaaatagcccttctaaacgctaatccccggaatccccggtcgaccggtcgaccggggattggaacaggttgatgagtctggttagggaaacgtggagttaggaaatcagttcctatgttgtgctgtgttgggagctctgggctgggtggtggatctagatttaggtgtcatcagcacaccagtggtaggttggttgaaagtgattgagatcacccagggaagcttgctgagtgagaagaggaagtctagggctgagccgtaagcaaatgccaacat

SEQ ID NO: 504644 - DNA, 187 bp, Homo sapiens
actcagtaatgcaagcaactatgcttttacatcaggattccacggctgcacccaaagcactcaacaggaaaaatgtactctgagcgagggataagaaataatccccctataactgtgtattacgaagtgtgaatatcatccaagatcagtaactacaacaaaaatcaacattacagcagcatgcata

SEQ ID NO: 504645 - DNA, 163 bp, Homo sapiens
cttggattgtggacttcacctcatccactattggccaccatgttttcgttgtgtagtgagcaagggacagggaactttcctgccttatttaaacctagggccgaggattcgtggaatctagcttgatcacgagactctgagagccaacaaaccgcatacatac

SEQ ID NO: 504646 - DNA, 452 bp, Homo sapiens
  misc_feature (8)..(8): n is a, c, g, or t
tcccaccncaggtttttcttgtaacacaacagtaccgacaatgtaatgaacaccaaataaatgccagctgtcattgctaagtcctaccccttttccctgattgtatttgtttatatatttttttactaccccagcttttgatccttcattttacatttacatagattcattgtttactacttgcccttcaactatgtcttttccaatactgagttttccaatctttaaaaaaaagtttaaaagttgctacataatattttgcatatttatagggtaataagataatatgtgatattttgttatatatatagaatgtgtaatgatcaagtcagggtatttatttgacatgtctatcactttgagtatttatcatttctatgtgttgggaacaattcaagtcctctcttccagctactttgaaatacagaatatattgttgttaaaaaaaaaaa

SEQ ID NO: 504647 - DNA, 1114 bp, Homo sapiens
cagccctccctttttttgttgacaagttgcctgtctggtacccaggcaatgaggtgcctactggatgggtcttgtatgaagcggaagctccattcctttcccttgggtcccccaagaggtaataaaagtacctggaggagacatagtcaggtgattgaaccttctgtcctgcctactactgctacggtgatgtaggtggcagaacagccgtcctggcctgacctgatcctggggttgtggtacctgacattctttcgtagcacagagcatgtctccgctttgaatcacacaggcgttgcttgtctccagctaccttagactttgtgaccttcttcttgcatgccttgatggagcttaagaaccattacactgggcttggaacagtgcctcagccccttaccgtggggtactgagtgcgttcgagcaacctaaggactaaaccttatccaagactgaagttgagtccagttccaaacgcagtctacttattgcctaggtctgccagaagaaacacactctttgtggattctccgagagacctaagctccccccgaagattgttacaggactatttgacctaggattcggaagatggctctggggcgaaatttccacagaaggggtagtggtcgtagttgtcttggtggtagtagtcgtcatcgcttgtagtcgtcgtcctagctcgctgtcgtcgtcctagtggttagtagtagtcctggtgtcgtcgtaataaattctagcacgtgaaactcgatgggctcacacatggtacagcgaccccagggaagtcgctattgaggagctcaagcgaatagtcccttattgcgtgtacaacactcgatcgtgcagctcactgtagtcactctaagtggtggccaacccaagtctacgccgtttaaaaagccgaggggctataagggacgttgccgcttaactcgaactacaggggggaccatttaaatgtgacagtcctccccttagaggacgtacccgggggccccggacacaccgtggttgtgcggacaccaggcgggttaccgtggtcaatttccactgattctatccttctaggggtatcgggccctaaccgctagcgaaagaacccctaataacg

SEQ ID NO: 504648 - DNA, 444 bp, Homo sapiens
gatcagaatcgcgcatggacagcgtgttgaaaaaggccaagacagggtgctgtgggcgggcgtctcccccagctgtgatgacacaggcaaacaacagaatggctaaaggctacctgtatgaggtgacagctgacatgagtgtgcaagtacaagttaggggttaactggtcggtcacggggggacctgaaggggccaaggatcccacagaggtacaaagatttttctaaaacacagcagtcttatttcacgaagtatttaggataactaacaagacctgacaggagccatgagagctcagactaaaccggctggcaggagccagtataaacgattactctcttgctttacaatccacatcatgacttgtcaaagacagaaattgcttagcatttctgggggacgaagtcacccataactagtctacatcatttggccaatcacaa

SEQ ID NO: 504649 - DNA, 165 bp, Homo sapiens
tgaatctgaatgtgtttggtgagactagggtgttgtgagtgtaaatatgcgatgagtaggggaagggagcctactagggtgtagaataggaagtatgtgcctgcgttcaggtgttctgtgctgtgttgcgctcatcagtggtgactgataagccaaggatggtgg

SEQ ID NO: 504650 - DNA, 294 bp, Homo sapiens
acgccgggtgcagtggctcgcgcctgtgatcccagcactttgccgggggggagcacttgaggccgggagttcaggaccagcctggacagcgtggtaaaaccccgtctctactgaaatatgcaggagttggttgggtatggtggtgggtgcctgtggtcccagctacttggtaggctgaacaggagaagtgcttgggcccggggggcgggggttgcagtgggccgacgttgtgctactgcattccagcctgggtgacggaatgaaactctgtctccaataaataaataaataaat

SEQ ID NO: 504651 - DNA, 104 bp, Homo sapiens
  misc_feature (32)..(32): n is a, c, g, or t
  misc_feature (66)..(66): n is a, c, g, or t
  misc_feature (73)..(73): n is a, c, g, or t
  misc_feature (95)..(95): n is a, c, g, or t
  misc_feature (101)..(101): n is a, c, g, or t
gatctttgatatatcatagtcattaaaagacnttttcgtatttgtattgataatgtattaaaagtngtttgtncttaataaaagacttctttaancatctnaaa

SEQ ID NO: 504652 - DNA, 259 bp, Homo sapiens
caaaaaattttttgggggccccataaaagggggccccccgggggggggggggggtttttcggggggccccccccgcccccggggggggggggggggggaccccggggggggggggcccccccctgttgttcccccccccccaaaagggccccccccccccttggcccccggcggggggggggggggggggtttcccccctttgggggttccccaattttttggccccccccccccccaaaggggggggggtccccccca

SEQ ID NO: 504653 - DNA, 222 bp, Homo sapiens
tgtggatcatacaagtcttatatggagaacaagtgattatgctacctttgcacggtcagaataccgcggcgttaaactggtgtcactgggcaggcattgctctaatactagtaaatggctagaggtgatgtttatggtaaacaaggcggggttatgtgtttgcccgagttccttttactctcttttaattctttccttgtgtgcactcctagtgtatgggtt

SEQ ID NO: 504654 - DNA, 296 bp, Homo sapiens
  misc_feature (250)..(250): n is a, c, g, or t
tgaataaatcttctcagttcctgctcccaggccatgaagaagatgtacagggtgcctcaagtacccgatggaaacagaagcacctgcctcacttcaagcgtggtgcacgcgagcagaccgttgccgagctggcctgtcggagtgtcggtgcagcatgcggactcactggagaacatcgacgagagccggtggccgagagcagagaggagcggatgggcggccgggcggcgagggcagcgacgacgacgancggtccacctagtgcgcgcaccgcttcagggacggagacaggatac

SEQ ID NO: 504655 - DNA, 319 bp, Homo sapiens
gcataaggacaaaaaaaacagtgagataaagatggaccatctagaaaggccaggctgtcctttggagtcaccaaggagaggagttttgggagggaagaaaaatgggatgggaaacgacccattactatttgtgaaagtgacaaaagaacccagggattttgaggctgaaatttatacccctgggccttcagtttgagagtcatttagcctatatggaattacctgtgacattacattccagagagatgagaaattttgagacccttattatcgatgtttatattgaaaaaatggtaataaatattttgagattttcaga

SEQ ID NO: 504656 - DNA, 985 bp, Homo sapiens
accacactgtgcgcatctacgaggggtatgaccatcccccatgccatcctgcgtctggaacctggctgggcgggatctgactgcactacctcatgaatgatcctcagcgagcgaccgggtacagctttaccaccacggtcgatcgggaactcgtgcgtgacattaaggagaagctgtgctacgtcgccctggacttcgagcaagagatggccacggatggttgcaggtcctcgcctgggagaaagagatatgaggctgactgacggccaaggtcatcaccattggaaaggagcggtttccggtgtcctgaggcgactcttccagccggttccttgcctggggcatgggaggtcctgttggcatccacgaaactaccttgcagctccatcatgaatgtgtgagcgtggacatccggaaagacctgtacgcgcagcacagtgctgtcggtgggcatcaaccatgtaccctgggtattgccgataggatgcggaaggagatcatctgccctgggactccagcacaaatgaatgatcaagatcagttgtcctcctgagcgcaagtggctccgtgtggatcgggggtccatgctggctcgcagtcgacgttccagcagatgtggatcacgcgaagcaggagtatgacgagttcgggccctccaatcgtccatcggaggggcttctgagcggactatgacttaagttggttacacggttggtgacattagctaagttgggaggacaagagatgagaaatgccatggggttaattgattgggcggtaaggcccaaggtatggtgggttgacccagttaaaggggtggggaagtgtgctgtgtgtgtgcggggtccagagaaagggggggacttagaaggtgtgtagattcacaaagtaggttgaaaaggggtaaacatttagaagggtccacgggggggtgagggagaaccatatgaagggcccaatggtggtgggtttattatttggggtg

SEQ ID NO: 504657 - DNA, 253 bp, Homo sapiens
tactgagaagtgtcgagatcccatagacagaacacagggtgtagtggtcggtcgcgctgaattctcaattctgactctgctccctagtggccatgtgatcttggatcaaagacttaaccacgtagggcctctgttttctcatctgtacaacatggggctcatttgtctgtgcaaacaaaaaaaggaccccgccccagaactgtccatcaaagatgcacagtgggcatactcacagcacactgccatcctatat

SEQ ID NO: 504658 - DNA, 1660 bp, Homo sapiens
cacaaaaaaaaacaaagccaggaagaggccgggttaatcgagcagaggggacacatgattctcagcaaacaacgattacatgcagacagaagaggactgggaccgggacctgctccatggacccggcctgtggagaagcagcagagaaagacattcactgtgcatggtgtaactcccacctccgtgaacggctggggacacagatcgatgaacatcgaagacggacttccgaggatgtgactgaagctcatgcttgctgctgtgagtgctcatctcagtgtgaactgctatgagccaagcccagaagcgcaggccaagcatgagcagtgcaccacagatctcgcaacagtccaacacaggcacctggccatttcatcagcccagacaacaggacgtcaaaactaggatgtcccatcgagagcctgcacagcaaatccgtggcatcgggcacatgcttgcacagcactgcaccactaggcgcgactgcatcctgcgcaccaatccatcactcgcgacttatgccacatccaacggcaccatcatccgctggcacagcagcacttcacagaacacgaacaggcagacggcgcctcgactccactgcctcggccggtccacgaccgcaaacgagcacgcaccccatataccaaccaccctgctccacacacatccacgacacctacccaccataaacgcatgcgcaacggcatgcgaccctcgccgccatactcgtgggtggccaccccggaatacccaacacagcacacaacaccgggcacacgaagacattgcaatctcgacactcaccgcgagacacagccctcggacgggcacacgggcaactgcacgcccccagcctaccacccagaaacacacatacgaaaaacagcagcgaccacacacggcacggctagggccacagcacagcaacacgataaccccagacggagcaaaacaatcacccccccaaaaaggacatagacctatcggacacatttggcccccgcaacaccgaacacaacacccgcaaccgagcagcaaccctacggcgccccgacaaacaccgagacacttacacatcacaacccaccgcccaccgtccacctggacaccgctacaccacgagtaggcacccatagagcccagtacctgacaaccaaacgagcccacaacactccaaggggaacagaccccccaacggacaaccgggcagcggaccaacacacaagggcaagaacgaaaaaaaccacgagcacactacttttgcacaaaaggaatcgaaaagagagacccacagaccacacaagccccgacggaacgacacacacagcacagagcagcagccgtcaaagttgcggacagagccaacacccaacaagaaaaagcacggccccacagaccgccacacccctggaaacgcgccgcctgacataaccagaacggacgcacaatgactcaccaagcggctccgggacaaataaaccaacacgagcagaacacacagtaaaaccaaaaccaaacatgacaatcgacaaacgacacaccagcaagcagcctgtgacggcgaagatcaccagagacaacacacgaccaacaagcacaccacacgacccacgggctgcgacgagaccccaccacccgagaccccaacccaaccaca

SEQ ID NO: 504659 - DNA, 177 bp, Homo sapiens
atcccgtatctccaggcctcagccacaaattgctgctctctcagatagtctctagcagggcatccatgaagtccagaatgacttttgcacgcgcttctaccaagagcccagcaggattaaaaaggctgcttatgagaggcttgtctgggtcctccatgtgtagctccccgagaaaat

SEQ ID NO: 504660 - DNA, 210 bp, Homo sapiens
cattactcgagttctccccctttcagatcagcagcagcattagattctcatagaagtgcgaaccatatggtgaactggtatgtgagggatctagagtgccatgttcctcaagagaatctaatgcctgatgatctgaggtggaacagttcatcctgaaaccattcccccatccacagaacaattgtcttccatgaaactggtccgagcgga

SEQ ID NO: 504661 - DNA, 683 bp, Homo sapiens
ctggtgaatggtatcacaatgcgatgtagagagcttctcatcactggaaaggccaatttcattcttagctcttcaacggattggtgacagttctatgcgatcatctggtcagtcccatgaaagtagctttcgcactatggtgaactcattctcatgggcacgcagctctgaagagtttgggcatttatgctggcagtgcttcagctgattcttggacagataaagtcgttgcaactctacgaaggtgtaaatgctccaggactaactttgctatctatattgttggcaagaatcaatgcgtagaggttcttcaggttcgtacagtctccatctttgattccggttattctgatgttctgcaggtctagcagagttgtgtcaaggggaagatcctttggcactgtgtccagacgcaaatcagaacactggacctctcgaagatggcattgacaccggaaggggcacactgggcctaggtagggctcgaagtcacggtcgtcaggaacttctgggcctatcccagaagcctcatcttctagcataaagtcgaataagcctctctgttgaaacggtgcagcccaggaaactcacaaccagggaaccttgcaacagagttgtaacgattaaatgagatagtggacttctctactgtgtcccctggctcatacaggcaagagtctgcg

SEQ ID NO: 504662 - DNA, 118 bp, Homo sapiens
atatatgtaggatataggtagtggtgtgagcttgaacgcttcttatgggctgctttaggcctacatgggtgtaatttgtactctctctacaggtttttcctagtgtcaaagagctgtt

SEQ ID NO: 504663 - DNA, 587 bp, Homo sapiens
gctgatcagggccgagtatgtctcggcggcgctagacgatggcctcgcacccaggacagtccccctccccggggctctctcctcttgcctacgagtcccctctcctcgtaggcctctcggatctgatatcgtggggtgaggtgagcaggcccggggagggtggttaccgctgaggatgctgcagtgctctgtcgcatatcgagtagagtgtactgacaacaactgactctcagaaactggtacaccagactgaatgcccgtgtcggaaccgcaccctagatgtcatggcaataggtctgtcggttgggaggacgtaagttgagtctgtagcagcagatagatggcctcacgacatgactgcacagactaaggggactctttgcaacatgtaacacgatcctcttgagtctaactcagtttcttagcgctttgacacagagacatgtcgtctagctgtgaatctactggaccgattcctgtctacgatcgaaggtacaggccaagcaccttgggtgtgttggactgagctgcttttatttggtgtcaaaatcactagcagcggaacaggaatgtcccattggcctgac

SEQ ID NO: 504664 - DNA, 101 bp, Homo sapiens
tgggctgttaattgtcagttcagtgtattaatctgacgcaggattatgcggaggagaatgtgtcatgtaattatactacattagtcttctatagggtgata

SEQ ID NO: 504665 - DNA, 90 bp, Homo sapiens
  misc_feature (25)..(25): n is a, c, g, or t
  misc_feature (39)..(39): n is a, c, g, or t
  misc_feature (56)..(56): n is a, c, g, or t
  misc_feature (58)..(58): n is a, c, g, or t
  misc_feature (74)..(74): n is a, c, g, or t
  misc_feature (79)..(79): n is a, c, g, or t
  misc_feature (81)..(81): n is a, c, g, or t
atcgagtgtcatatagctacattcncacccttgtatccngggtcctagagaccctntntcagacagtgaaagtnaaatngnctgaattgc

SEQ ID NO: 504666 - DNA, 1905 bp, Homo sapiens
  misc_feature (890)..(890): n is a, c, g, or t
  misc_feature (1207)..(1207): n is a, c, g, or t
  misc_feature (1477)..(1477): n is a, c, g, or t
gcaccagatcgaactcgcatcaccgtggcggtttctcatcgtcgcaagggctctgcgggaacacggacgagagacgggaagtgcaatggacatcggcggctcctgaagcgtgacggacttcaccagaggcctcgtgtcatggcatgtgtgtgtctgttgccttgtatgacgcggccatgacgtcaggaacggtcgaagagaaactgttggcacagtagcctccgagcagatggcgtggcgttgagtgattagagccaacggcatgcgtccagcgtgtgtagcgagaggatcctcgcaagacacgtttgccaggacgttacacatcccgacagacacgtagtggcccttctgatacgcgcacgcaatgtgcgcgcatggaaccccggcggacatccgagtacgagtacgtaggaattgagccgagtatcgcgatggacgcgacccctcgcacgaccgggctcgggtggagtcggaacgagaggtcgtacacgttgagtcatacggtgatggcagtagggggacgcacaaccaggtgacggtgacccccgtttgtagccgcagaggccaccttattcgtgggaacctagacgtaatcctgcgatagggcgaacgccggggaataaaggcattacttaaccgttaacccctacatactagtttgtgcgcaagaacccaagtgcggaaggttcccgaaataggccccttagaagttacaatagtcttgggagccgaatgtttaaccatggaaaacctgccataggggtcagagcaaagccttggaatttggttccaggcggaaaaaatggccttggtacagacgttggtgccaatacatttgcgcctaggtccatgcattactggacctgacaaaatttgtacgacggttgcancagtccgaacgaaaagctatagtacttatggggcgccactggtctatggcgtggggtccccaaccatatgggagcggcttgtatatgcccctctatgacgaacgcgacgcattgtggtcataaggacctccgtgggcggcacacagtcccacaagaggggtgtaagtaccaagattaatttggcgatccgagcgataccaagctaggacacaccttcgatattgatgggcgtcccgctttggcggaccttagagatgggaataggctcccctcggagagtttctcggaaacggacaacccgtatatttattcaaacngagtatacaggaggtcttgagacagcgggagccgagggagaactcggaatagagacacgagagcacgaaagtacagtccctccacatagagccgcaattggaggttctccgagagggaatacctaaagggacaccaagggcatatatggggacacaccggtccggcccacttaacattgtagagcgtggaagtgccacgtcgacagatccgctcttaggagactatcggcgagatgccaaggggggaccacatggagcattggaggaccncctttaacagtgtatacgcagagaaacacgtactgcacttgtgtgagctccaagagggttgacgccccaaaaatgtgtgactctgtggtgtccccgatggaggcgaccaacgcaacgagctctggttcaccagtataattttggttgacggagagcattgaagaaggtggatttccaccgcgtgtcgtaggatgttgacacacgaccaggacaactggaagcggagactctatgaatcaacaatgaaacgctatgtgatgtcaagatctagacaataaaagaggcggaccaacagagcgcagcgcgagataatcgattcgcgccaccacatcatcgatttgtacacagcagggagagcgatacatagaagagatcaggacgagcctacatgacctgacacagttgaagagaataagatcgatgcttca

SEQ ID NO: 504667 - DNA, 258 bp, Homo sapiens
  misc_feature (5)..(5): n is a, c, g, or t
ctagngtaagaagggcaggttattagagaaattgtgacatatgttgcagtggcagctcagcatagaaggggctacctgcaaagaggcgaaggctggaggaaagtcttatagggtcctgctttagggtgctacgtgtgagatgaggtcattgtgcccgcaggttgtttgtgattagctgtctctaacaattgttcatacgataattgttcattattgttctcaacttggggctctccccaacctggggacccttcctta

SEQ ID NO: 504668 - DNA, 1119 bp, Homo sapiens
gggcgagacggagacggcaatcgcacctggggcctgcctaacaggacccccgattgaagccgtggaacggctcacacctggcactgtgctgcacctgcccacctgtcttccatcacctgccacacctgctggccaaggagagcatgtctgcagcccgctggtgcgctgtgtggccagggcctgcacctggagatgtctgcgtggtgattgggcatcccgagacgtgcgtgcgctgaggtgcactctgtacctgacttgacactcgtgcacatctgctcatctccgacgctgagccctgcaggacgaaggagtgactcgcgtcagtcgtggtgcatgctcgccgaggactgagctcacatgtacactatcgtgccagtgacatgagaatcatcaagtgcctttgttcccctacggacgatccaattctggtgctcctgcgtggtcatcgtcaccctacccccacacttctactcgtgacttctcccgagctccgagcagtcctgttgggagaccccaatggagagagtcaggtggaggaacaacgcggaacctcggattacttgcttcctcatgatagtacgcgcagttccacacgtgcatctaactaacgtcgacagctggacggatgacattcgttgggccacaagcgccacaacttaccttgagcaaccatgacacgcaactttgcacgtgcagcacgccttcaggaggactggctgatacctggaagtcctacccacgctgggcttcactccggtcaagactgtccacagtcgctggaaccttagccctgatagtagaggttcatccgtccatgtacatacccgggaacaagcccagtcgaagttggcctccgctgggaacccactacttcctgtgttgcgctgacacatggccattgccagccccactgatcgacaccggagtggcgccacaggccaaaagtgtgaccgcgggtgccgcatccggcctcactcattggtagaaatcctgcgtttgacaaggccggtgtcccgtgtctatcccctgccatagcgttgtcaggcgaaaacactatcactaccatccgtcatgtgcctgtgggcacgtactcacggtaaacgctggtgcatggctcac

SEQ ID NO: 504669 - DNA, 97 bp, Homo sapiens
catggtcgaactcaagcttctaacaatggacggggacaaggttgtggttaatttggtttatttttgttccccaagttaaataaattataaaactcga

SEQ ID NO: 504670 - DNA, 770 bp, Homo sapiens
tttatctgcaagcatgagagtagtgtaactatgtatcaagcattatgggggcctgagagacgagccagagctccatggtgtagcagccccgaggcggtagcattcagagcctccagtgacctgtggggctggaggtgaagtatgggggcccatggatgctgctgcatggtgctcaccctcctctgacagcactggtgcccatactgtgtgctgacgccggccaggagctaaccatgaaggctcagcttcccgaccagaaagccctgagcctagtaagctgtttcagcggggaggcgtcttatttggccacttgtctcctggacctgctgaactgactacctggactgccatagatgaggcccatggcagaccttgcacgtgacgctccagatacccacatgcaagagttcatcctggccatgggcttcttcctggatcctggatgatggagcagatcacactggcttacaaggagcagacagggccgtacaactcatggaggaaacaagggctctagctagggcaccagtgaatggtagggccagaaacattggacaatgatgggaccaggggtcccacaggacgagtaggagcccctagacaaccccctcagacttgcaatgcctgtgtaactaggatgttcttccctgcccctccactccgtgtacgaggagctggcggatagactgaaagaagacgggctcaaggaccatggaactgtgctgggtttgttggtccaaaggacatcctgatgacaactgcctaggatt

SEQ ID NO: 504671 - DNA, 250 bp, Homo sapiens
  misc_feature (145)..(145): n is a, c, g, or t
tgcttcgatcttatcatgttatctggaactcatatattattagaagtatggttccctttgtacagtttaatactggaatgtggaggtaggtcctatttgagataaagatgtagggagtccttcttactcctcattctcaactganccagctagaaaactattaagtataataattggatttataaggctttacatttgtactttacttttaaaaaatgtagtgtcttgtattatttaaatctaccggggg

SEQ ID NO: 504672 - DNA, 1004 bp, Homo sapiens
  misc_feature (815)..(815): n is a, c, g, or t
tggcggttcctggacacacgacactgcttcaaggagggtctacccatatccctgaaaaacggcaggaaccgggtgtgtgggaaaaatacatctaaaaaccgctgctgcgacaggcaccccgtacccccggtcatcgcttggagactggggaagaagagattcccggcaaagtgtggaccaaggaaccgtgcaacccgggaaaggtcggccccgccacagcatttcgccccggggggaaaaatccagggaaaccagtgggccaaaaaccgggcgcgggccccccagagacaaaaaatcctccggagcgccctcgatcccaggaacccaaattgtggaggatgcctcacagaaagttaactagaagggacgtttcatacggggggaaagaagctaaaggaaattccccggagctaatgggaagaaatcaataagggcccggcatctttccaaggagggttgatgggcctgaattgaagggccagaaggtggctaatgggggcacacgggatgccgccactacgcaacaatagcccccaccatcctcacggacgggacccccagtccccggtgaagcaagaggagatctcgggccctggctgcccatcgtggccggcgcagcctggaggaggccatccagttcatcaaccagcgtgagaagccccccggccctcacatgttctccagcaacgacaagggaacagcggcatgggatcctaccatggcaagaagagcttcgagactttctctcaccgccgctctgctggtgaggccttgatgaagagaaggctgaaggtcagataccccccgagcccgcnccaagatgaccagcactgaggaggggttgctccgctggccgggcaatactgtgtccatcggagtgcgaccaccctcactgctctcctggcctggagaatcgctcctgcaagccccagcccagcccactcctctgctgacctgctgacctgtgacacccactccaatggccaacctcacattcaagttta

SEQ ID NO: 504673 - DNA, 1421 bp, Homo sapiens
  misc_feature (1004)..(1004): n is a, c, g, or t
tgcagccactccctccaaccgccacaagcagcaaagggcatagatgaccacaggagagccctagggggaggccggctccaccagcagccccatacatggcactcccaggtaccccctgggcaacgtggatgacagcaggtctaaggacagcccagcaggagagccccaaggtcaggtcccactcacagcagatgtcttggcagtgagcagctctgtcgcatccactgactggcaggatatagatcaggcctccttcaagacggccacccccagggccatatcaacatctggagacaaagacaagagtgcagttgttccagaacacggccagaagacacccagaaaaatcacacctctgcttcccagccaaaatccaagtcccctgcaagtgtctatgagccttcagaatccagcgtgggacaggcaggttcaagacgcaaggacaagtcagagtctagtggttttcccaagtcacctcctgggtaaagacaagatgtcacaaatggcgagtgttcctgagagagagccggagtcagccccctctgccccgagtgctgagctacagtccacccagcacatggaggctcagcccgtcgagagtgatgctgaccatgtcacagcaggtgccaatggccagcatggccctcaggctgccagcaccaccaagtctgctgaggagaaagctgagcatccaaaggccccacaccctgaagctgaagctttaccatctgatgagtccccagtggcaatgggggcaaatgtggtggacagcttaggagacctgcagacttggttcttccctccactccagcaggcagtgtgtccccgtcgcctggcccccacgaggtggccctggggagaaggcccctggaacccagcctgtacacggccagtgaggagaacagctacatgcgctccatgaacagcctgctggacaggggcgaaggctccatcagctccctggcagacatcctggtgtggtccgagaccaccatgggcatggncatagccacaggcttcctggattccggccacagcactgtggcagacctgctgcacagctcggggcccagcttgcgctcggtccccagcctggtgggaagcgtcagctcggccttctcctctgggctggtgtcagggaccagctcagccctgcgcaccatcacccgtgtgctggagacagtggagcagaggaccgtggagggcatccgctcagccatgcgctacctgaccagccacctcaccccacgccaggcccaggctgaccccaactatgattagagccctgcacagggacccccgaagggctggttcagtggcctccagagatccctgggaccctcacgccctgctcccttgcccattcttgctctggacggttcccccagcccatgcaataaatcaccagtgagcatttaaaa

SEQ ID NO: 504674 - DNA, 142 bp, Homo sapiens
ctgtcacccttctgtgttctcctctgcgaggtcgctccctgatggtgcgctggctctcatcatttcaaattttaatttagcatgaatgaaaagatgtgaacttgtatatgtccttattttctacaaacaagccatggatcga

SEQ ID NO: 504675 - DNA, 100 bp, Homo sapiens
aatgcctttcccagctccctgatacaggccaatgtgaccgtggggacttgctcgggcttttgttcccagaaagagttccccttggccatttttagggcct

SEQ ID NO: 504676 - DNA, 143 bp, Homo sapiens
  misc_feature (135)..(135): n is a, c, g, or t
gaattctggatcctccttcagggaaaggggcaccacatatctgtcctgtcaccatggcaaagctggaagggtctgcaaacctacccaccatgctgctggtgttgttgtaaccaaccaaaggcaaattctcgccangaaaaatt

SEQ ID NO: 504677 - DNA, 469 bp, Homo sapiens
tgaggtgccttcccagtggcctggcttgtcggagcaagtttcatcagcccctagggaaaacacggccctcctgggaaccttccttacctggagtaaccggacaccttagacggaggtgcctgagggtggggtgggatttgcagggtcattatcagaacatgaggataacttccttgcccctgctctgtagccacctccttggcaccggcctctatttgtcataaggcggcgtgggcagaagcctgacacaggccagccttggcacgaggggggccaggggttctgagaagcgctgccctgtgagaccacgctggcctgtgagagccacgctggccttcgtctccatctctggttgacgggctgtccgtgtgcctcctgtgtgtctgcagacaagtcttgctgtgctttatttgtgaaactttaatgaggaaaaaacaaataataaatgttctcgttttgaaactcaaac

SEQ ID NO: 504678 - DNA, 213 bp, Homo sapiens
attaacaggctggtgagagaaaaatattttacattttctcttaaaaataaccattgtctactcggagtattcatcacacatgacagtgggaaagcacttatcctgggatgcagtagaagttactaaaatgtagcttaagcttgtaatcccagtcattctcccaatagctgctcagaagcatgcgtgtcgaaagattcccaatgtcttagacat

SEQ ID NO: 504679 - DNA, 271 bp, Homo sapiens
cagtaagctctccttaccataaatgtttcttggtcgacaacatctaagacaatattagtgggatgaaaaacgaggagctggggtgcttttggaagcattgttagtgttcctcaaaagtcggaacacttgcctgttgatatattaataagaccttaaaggcaaattcttatgttggcctgtcaaatgatttggatgccactctgcaaagtatttctaacctttaattcccagttgtaaaacagatatcataacagcatttaattggaatata

SEQ ID NO: 504680 - DNA, 530 bp, Homo sapiens
tgaggtgccttcccagtggcctggcttgtcggagcaagtttcatcagcccctagggaaaacacggccctcctgggaaccttccttacctggagtaaccggacaccttagacggaggtgcctgagggtggggtgggatttgcagggtcattatcagaacatgaggataacttccttgcccctgctctgtagccacctccttggcaccggcctctatttgtcataaggcggcgtgggcagaagcctgacacaggccagccttggcacgaggggggccaggggttctgagaagcgctgccctgtgagaccacgctggccttcgtctccatctctggttgacgggctgtccgtgtgcctcctgtgtgtctgcagacacacaggtgagagccacgctggccttcgtctccatctctggttgacgggctgtccgtgtgcctcctgtgtgtctgcagacaagtcttgctgtgctttatttgtgaaactttaatgaggaaaaaacaaataataaatgttctcgttttgaaactcaaac

SEQ ID NO: 504681 - DNA, 598 bp, Homo sapiens
  misc_feature (231)..(231): n is a, c, g, or t
cgcaaaggggtcgggtccctttcggagagcccaaaggtccgtgtgggggtgacgcgcccccctcttatttccgctgggttttacccctgcggtctctgcgtggggcccacccttaacattcccgcgccgcaatgggcgccttgtcttctccgagggcttgccgcgccatttattctcgtcgccctctcttgttgccccgcgggatagagggtgcccccttcctccgggcgnagtataatagtctcacaccccctccctcttaacccccgccgcggttcaatactgagacccttttgcgcccgggttgtttgcgagcgcctcgggcaaagtttcatatctgggagcgttcctttcccaatattggggctcggtgaactcttgtccaaccacgcgtgcgaggtgcacgaaccaacacggaaggtcctcgcccccctccactcggttcgggtctcaccggctaaggagaaaacaatattggcgatccatcagtacaaaaggaattccgagagaggttcttgattgatgaacagggccttgggttttttggaaaaaccccttttaaaaaaaggtccaaaaaaaaggggaccccccaaaaaaa

SEQ ID NO: 504682 - DNA, 444 bp, Homo sapiens
tgaggtgccttcccagtggcctggcttgtcggagcaagtttcatcagcccctagggaaaacacggccctcctgggaaccttccttacctggagtaaccggacaccttagacggaggtgcctgagggtggggtgggatttgcagggtcattatcagaacatgaggataacttccttgcccctgctctgtagccacctccttggcaccggcctctatttgtcataaggcggcgtgggcagaagcctgacacaggccagccttggcacgaggggggccaggggttctgagaagcggtgagagccacgctggccttcgtctccatctctggttgacgggctgtccgtgtgcctcctgtgtgtctgcagacaagtcttgctgtgctttatttgtgaaactttaatgaggaaaaaacaaataataaatgttctcgttttgaaactcaaac

SEQ ID NO: 504683 - DNA, 280 bp, Homo sapiens
  misc_feature (138)..(138): n is a, c, g, or t
  misc_feature (179)..(179): n is a, c, g, or t
  misc_feature (193)..(193): n is a, c, g, or t
  misc_feature (266)..(266): n is a, c, g, or t
caaaattcaaataatagtgatgcctcctattaaatttcttttataaaaaggcattcaaaggggggaaactgaggcagaaatttcaaaaataaatatgccatttcattcactccaagcaaaagtttaacaggtcaaggncaagggttaaaaagaaaagaacaagttttccctcggcctancaagctcacttcanggacagttataagataatgttgtttgagaagccaagtccaaaggaatgggttccagacatccctcccctctanaacaaggttgaagg

SEQ ID NO: 504684 - DNA, 225 bp, Homo sapiens
aatgtggttcttgggttttatttcccccccaagaaaagagggtctggctctgtcaccggggcgggagtgtatgggcccaatcatagctcattacagcttcgacctccgccctcagctccctgagtgccggggactccgggggggccacatcaccccgggtccccaactaagaaaaggtcctggaggggcagaagaggggggcacctctaagaagtcgcacggcag

SEQ ID NO: 504685 - DNA, 85 bp, Homo sapiens
gggttccggtctgtggagaggttgtgcggcgacagtgaagactgcttatcccagcattcttgctgagctcgcatgtgctgcgggg

SEQ ID NO: 504686 - DNA, 292 bp, Homo sapiens
  misc_feature (4)..(4): n is a, c, g, or t
  misc_feature (20)..(20): n is a, c, g, or t
  misc_feature (48)..(48): n is a, c, g, or t
  misc_feature (144)..(144): n is a, c, g, or t
  misc_feature (284)..(284): n is a, c, g, or t
acangcaggataaactgatnggaaataagggaacaacagctgtcagcngtaaacacggaaaacaagcagaagaccccatcacaactactcatccgcctaaggactggggctgggttttgcagagctgcactggcttccacgganaggccaccaaagtcgattttttttttcagacaggacttttttagggaaggtacagcatgcattagatggggaaataagggccatgaacatggatctgttagtaggtctgtgtttcttagaggagtctaccagggctggtnacagtttc

SEQ ID NO: 504687 - DNA, 519 bp, Homo sapiens
taaagacagacacctggggcaagtcagacactctggacaagacagacactaggggaaaagataacactggtattaactctcgaggagtttcctcaccaataaacagacaacctcaacggccagtgccctgcagcctcgggccacagcggcagcctggttggccttcccacctgcctctgccacaccgggtggctgaacatctctggtcgcccagaggccaggtgggggccatcctccaaggagggatctctgccctcaccgccggccacggggcaggatccctttcctctgcagggagaggtggctcctcggccatgcagccccgggcaggttccttctaaacatgcctgtggaccgggagctggcgccaccaagtccagggccttgccagggccagacaggtaacacgcgtgaacccgagggacagctcggaggggcggtaccggggtcaggagacaaagcgggcaggggcaggggtgaacgggaggcaagtcaagtcaccggtggcctgtggggctg

SEQ ID NO: 504688 - DNA, 416 bp, Homo sapiens
  misc_feature (372)..(372): n is a, c, g, or t
  misc_feature (399)..(399): n is a, c, g, or t
  misc_feature (416)..(416): n is a, c, g, or t
tcgaactcgagcttagtaccctcgataagggccaccacagcagtaagtaaggtgtatcgggaatgggtggggtatggggagcatcgtggctcacgctgcgggggactgtgggtgacagtgcgccaatggagtgccagccgtcacaagaggtatctctagtcatgtgtggaaatgatggaattagtgcctggtgacacacccctgcccacgcctacgggatgtatcccaatatgccgccggccgcaacactcagtgccgcaccatcaagagcccccttcctctgatgaggcagtggtcgacagacatgggcctgaggcggcaagtggagaatgggaacatggagcgtgggctcagaaccatgaaaacattggnagaatcttagctgggactttggccttnatcgagggggatcctcn

SEQ ID NO: 504689 - DNA, 396 bp, Homo sapiens
actcttacacgtgtggcaacctcctgtcatttaccactttcaacaagatgacagagcgacctgctcagatgctgaggggcggggactgccaggaaagatggctaggaaacccagtcctctccacaccctatagtaacttgatgccttgtgagggacacaggcgaagttcaattccttggaggtcaagggagactgagcagagtacagctgcagcactgagggagtgactgaacttcttaactggggatggtgggaggcttcgcagctggtgaggtggcatttgcagctaggcctctgcacagaggagcaggtcttagcaacttgcattttaggtagtacagcattgcgcgtgcaagggtgacactgtgagcggggatggcattcaggaaaatccaa

SEQ ID NO: 504690 - DNA, 358 bp, Homo sapiens
  misc_feature (6)..(6): n is a, c, g, or t
cctagnagaaggaacaactgagtgctcaaaaactatcttgtacagattctcagacctaccatgggatggaacttacttatgagccccagactccaaaaacatcacatcctaccagattcatggctgaagcgtctgaaacaagactaacaagactaacgagattaacaagagaaaaacatacaaatttttaaaatataagttgtatgtgacatagaagcatttataaagaaaagaagaccagaagaaacgggtagacctgggtatttttatgctacttttgatgaaaatgggaatgcttttggagacgcatgagtgaataaaaaaatatgatctaatggtaataaactagaggaaacag

SEQ ID NO: 504691 - DNA, 347 bp, Homo sapiens
  misc_feature (5)..(5): n is a, c, g, or t
  misc_feature (9)..(11): n is a, c, g, or t
  misc_feature (24)..(26): n is a, c, g, or t
  misc_feature (37)..(37): n is a, c, g, or t
cctangtgnnncctctgtcacccnnnctggagttcantggcatgatatcggctcactgcaacctctgcctccccggttcaagcaattctgcctcagcctcccaaattcatggctgaagcgtctgaaacaagactaacaagactaacgagattaacaagagaaaaacatacaaatttttaaaatataagttgtatgtgacatagaagcatttataaagaaaagaagaccagaagaaacgggtagacctgggtatttttatgctacttttgatgaaaatgggaatgcttttggagacgcatgagtgaataaaaaaatatgatctaatggtaataaactagaggaaacag

SEQ ID NO: 504692 - DNA, 1273 bp, Homo sapiens
  misc_feature (5)..(5): n is a, c, g, or t
  misc_feature (9)..(11): n is a, c, g, or t
  misc_feature (24)..(26): n is a, c, g, or t
  misc_feature (37)..(37): n is a, c, g, or t
  misc_feature (1187)..(1187): n is a, c, g, or t
  misc_feature (1200)..(1200): n is a, c, g, or t
  misc_feature (1203)..(1203): n is a, c, g, or t
cctangtgnnncctctgtcacccnnnctggagttcantggcatgatatcggctcactgcaacctctgcctccccggttcaagcaattctgcctcagcctcccaaattcatggctgaagcgtctgaaacaagactaacaagactaacgagattaacaagagaaaaacatacaaatttttaaaatataagttgtatgtgacatagaagcatttataaagaaaagaagaccagaagaaacgggtagacctgggtatttttatgctacttttgatgaaaatgggaatgcttttggagacgcatgagtgaataaaaaaatatgatctaatggtaataaactagaggaaacagagcaaagtctgttcagatcttctctgtgatgctttgtcttcagagctccttcagggttggaaggaatacctttacttgggggcatgtcaattcgtttttctcacttgattcatctttatgacttcctgaggacagatctaattctaaagtaaccagaagcctggccatctcagagcagcaaatccctcaaccttggagcacaaatgatcgctgatagagtctgcataaaatcatcttcctctatctgacagccatgagcagagccttgggggtaaaaaaagccacagccttaaatctcttcactcagaaattaccatgaagataaaataaataaatggaaaggactatcaagaagccaacaaaacataaacaccaaaccaactcatcttgtttcactttggaaataaactgttcccagatgtgagaccaacaaaattaatattaagcaattaaaccagtaaattataaactgatttatcatttgggaagtttaaagtacagagagatgaggtacctgtagccagaattacacatcatttcaaaatatgtagacaaaaagaaaactgaatgaacagagaaacattgcagcaatgcacagtcttaggacgaatgttgctgtttgcagacagagaatgtttgccatcttgtgtatagcctcaaagccatactgagataatagcattgttgtcaattgcttgaaaaattttcacattcaatccttcatgctatattggttggaagaggagggaagtcagttcttactgattacttctcagtgaacttctaatatttgcactggcacttccattcagggaatgaggtgggctggtcttcgcccanggcccataatttnaancacacaagcgttttgaggatccaaagggaaaaggagatttcaaacttgatttctcctcaaaaaaaaaaaa

SEQ ID NO: 504693 - DNA, 957 bp, Homo sapiens
agcggaaagatggcagcggctggagctggccgtctgaggcgagtggcatcgtgtctgctgctgcggatcccccgcctgcccgaccgggagtctgtcggccccggaccgtactctatcacaagaatggttgtggactcattatgaaaatcctataacacgtagggtcccattgacaagcactatctaaagaaatgttgcgaacatgcgacctggattggaggcgtctcctaagacactgtgagatcggacgataatgagatagttcacacgacttcaatctggtactgaagaagcgggaagattagtgtgagtgcctaggttttacactacactttggctgtgggtaccagctagatttgcctccatttgtcattagccactgtaatgcctgacatggaaagacggtggacgaagccttgcactatctaaaagacatcgagtatgtctgccaatgggagcctctgtcattcctctccgatgtaaatcatgcttcatgcatctcatgcatgtgcttgaacatgtcatatctaatgtcgcgtacctggacgtgacttatcgcagatttgtatgacatggaaccccttgagagggacgtaggctagatgagtaaatagagccctcccctcggacgatgcctccaagtcacggtccacgatccacgtcttgttttccccaacctggcattgtggcttatcaccccttgtgacttttcacacatgccgtttttcgctcttccatcgtggaaagagtctatgagactatcgcaacataatattttattgcttgtgtcactggtttattgacctcgttcgatgcgaagccgtaattacgacagggtttcagttggtttctgaaatccctggttggctaaccctttcagcgccatcttttttaatcggcctataaacctaactctaatgttattaatagcgaaacttggggttgttataaaacctc

SEQ ID NO: 504694 - DNA, 1250 bp, Homo sapiens
tctggagtgtcggggatatatttaacggggggacccacacaaggttataatataattgtcgccccccttgtgtgtagttgccccacaatgttttataaaaggggtggttgaaccaccttgagaacagtttttggcccccgctgctccttcaagttttattcatacatatgtgcctctttcggtggcagaaccgaccaaatggctttaggcaaccccccgggccaaaaggggtcaatccccagtggcaacacttttgggggaaatctcgtgagaaaagggatcttatttgtggccacccacggttccaacatgcgcaatcaagtgtggcccacgcccccggaaaggacttcggtggatatgtgggcccccctcccggggggaaaaacttgtttgggccgtgtatgtcgcccctcgcgggggctttttcacacgagacaacttcaagtctccctcgtcccgtctatcatggcgcgcttgtccaaaaggccttgttggggcacaaggttcaaatcccttgaggctttaaacgggaaaggcttcatcttgggcaatgggccctttcccggggtcccccaccgtgcgcacaaccggtgtcacaatggtgggagcactgagacctgtgccgtttttaggagaaaaaaccctgtcccccaaaatatatgagattgaaacacttcacacgaaagtgtgtgtgtaaagcacacgggcgctccgcgagggggccaccctcacaaaaggggcactcacctggggggtatcacctgagaggcacccacgggtgggttctctccttcttgagacttttcacacacacggcgagacacacccacacttccttccacccttttagaacgcctgtgggggttggcacttggccctctcacaccgaaccacctttgtcaaaggtcaatttcctggtaatgacacacgagaatttggctaacaagcaaacacagggtggtggagacctctaatggcgccacacacatggccctccacaaggaggtataagagacccctggagccacccagccccacgcaagaggcaccaagagggaaagaagagaagagccctcaactgctggggaggtccctgccaacacactcacgtcccccacccaccacctgaaatctcccctcctcacacacaggttgccacatgtagagaccccttgaagaggggaggggcctagggagccgcaccttgtcatgtaccatccaatataagtaccctgtgcgtcaacccacca

SEQ ID NO: 504695 - DNA, 984 bp, Homo sapiens
  misc_feature (5)..(5): n is a, c, g, or t
  misc_feature (9)..(11): n is a, c, g, or t
  misc_feature (24)..(26): n is a, c, g, or t
  misc_feature (37)..(37): n is a, c, g, or t
  misc_feature (898)..(898): n is a, c, g, or t
  misc_feature (911)..(911): n is a, c, g, or t
  misc_feature (914)..(914): n is a, c, g, or t
cctangtgnnncctctgtcacccnnnctggagttcantggcatgatatcggctcactgcaacctctgcctccccggttcaagcaattctgcctcagcctcccaatccttcagggttggaaggaatacctttacttgggggcatgtcaattcgtttttctcacttgattcatctttatgacttcctgaggacagatctaattctaaagtaaccagaagcctggccatctcagagcagcaaatccctcaaccttggagcacaaatgatcgctgatagagtctgcataaaatcatcttcctctatctgacagccatgagcagagccttgggggtaaaaaaagccacagccttaaatctcttcactcagaaattaccatgaagataaaataaataaatggaaaggactatcaagaagccaacaaaacataaacaccaaaccaactcatcttgtttcactttggaaataaactgttcccagatgtgagaccaacaaaattaatattaagcaattaaaccagtaaattataaactgatttatcatttgggaagtttaaagtacagagagatgaggtacctgtagccagaattacacatcatttcaaaatatgtagacaaaaagaaaactgaatgaacagagaaacattgcagcaatgcacagtcttaggacgaatgttgctgtttgcagacagagaatgtttgccatcttgtgtatagcctcaaagccatactgagataatagcattgttgtcaattgcttgaaaaattttcacattcaatccttcatgctatattggttggaagaggagggaagtcagttcttactgattacttctcagtgaacttctaatatttgcactggcacttccattcagggaatgaggtgggctggtcttcgcccanggcccataatttnaancacacaagcgttttgaggatccaaagggaaaaggagatttcaaacttgatttctcctcaaaaaaaaaaaa

SEQ ID NO: 504696 - DNA, 1335 bp, Homo sapiens
  misc_feature (197)..(197): n is a, c, g, or t
  misc_feature (784)..(784): n is a, c, g, or t
ggcatcctggccgacgagatgggcctggggcaagagcatccagaccatcgcgctcgatcacgtacctcatggacgacacaaactgcagtcattgggcccttcctcgatcatccgtgtcgcgtctctcaatcggctgttcaagtgggcggaaccgcgagttgcgacgaacgtggagcccctctcccgtcgtgtcgaangagtgtcgtctacgaagggcatcaccgcaagtacgctaagacgagggcactattgtccgcgcctagcgtcccgcgcatgtgggaacgttcaacggtcgttagcagaacgaccgtacagagtacgatcatccagacgacgaggcactattctctggcaaggatcgcgtgtcgcgaaggtacattgcaatctgtgtgcaccgaatgcgtcgacccgcgatgacagaacgctaccaattgcaatgcgttgacggcacgagttgctcaaataactgcacttattgtaggcaaacaccgccagccctcgctagctatgaccggagtccaactacccagctttgccatgtacatctaaggctatcccacagaaggtctgcgtggtgtggcgccctcgccattctacaacgtggtcatcttggtcgttgccccctatcacgagttctttccacaagaaaggtcttcgtgaagcaaccgcttttccgaacggcaaggtagcgttctgtaaagaaggccatacgaccgtgttctgctctcaatgggaacccccggggggaacagaccacgggcttgtggaccaccttgcaataatntgaaggggtacggggaaagagtccaattggcctccgagtgctagtccgccgggggcgaatcatgcccccacttcatgcgctagcttgaagcgggcgacatttcctattgggcccccggagcggcaatttgccacccgcaacgggacaggcacacacaagggccaccacagaggttcagccccccggaaaagaagggatcccccagatgatccgcttcgcatccctaagctagttggcagaacgacctagattctgcgacggccttgggagttctggaaggtcagccttcttacacgggggccataccactaagcacgttagccccaactggtgtactgtgagaagtgggctcggaacctggcatcgtgggctgctcgccgacatagcggacccacttgaaacgggacccaatggctggacacctattgtagcggccagcatggaaagcgatccaattccttaggccacgcactacgccggaaacgtaaggatagcacagaccaaccacgctaacaaatagtggcccaacgccaccaataggaccgccattc

SEQ ID NO: 504697 - DNA, 450 bp, Homo sapiens
tggggccctttggggggggggggataaaggggggaaacccgggggagggggaaggttggaaaaaaggggaggggggggtaaaaaaatccccgggggggcccaattagggtccccggtgctttctgtagaacaaaaggggtggccccaacagagggagcgtctgataaaaaaagcagcaaggcgggggcccgggggataaacaacgagccgtggggggaggaacaaaccgcgtcacgcggggactctgggagaggagagacccaatcctcgcgggggggaagcccctacgggggacaacaaccccacagagagaagtttaaacccgccccaggggaaacatacaaactccacggtgggtagtcggggtgacaacaaccgcgaaatcgcggcgcgcgaaaaattcgcgcacagggacacgacacaaattacccccgggccacagaaaacagt

SEQ ID NO: 504698 - DNA, 112 bp, Homo sapiens
aagacccttcaaatgccagcaccacagctatgccagtgacccagtctgtcaagaaacccaggtaaggcctgtaagaagaaccatgcttttaagatgtttggaaggccttccg

SEQ ID NO: 504699 - DNA, 1286 bp, Homo sapiens
  misc_feature (5)..(5): n is a, c, g, or t
  misc_feature (9)..(11): n is a, c, g, or t
  misc_feature (24)..(26): n is a, c, g, or t
  misc_feature (37)..(37): n is a, c, g, or t
cctangtgnnncctctgtcacccnnnctggagttcantggcatgatatcggctcactgcaacctctgcctccccggttcaagcaattctgcctcagcctcccaaattcatggctgaagcgtctgaaacaagactaacaagactaacgagattaacaagagaaaaacatacaaatttttaaaatataagttgtatgtgacatagaagcatttataaagaaaagaagaccagaagaaacgggtagacctgggtatttttatgctacttttgatgaaaatgggaatgcttttggagacgcatgagtgaataaaaaaatatgatctaatggtaataaactagaggaaacagagcaaagtctgttcagatcttctctgtgatgctttgtcttcagagctccttcagggttggaaggaatacctttacttgggggcatgtcaattcgtttttctcacttgattcatctttatgacttcctgaggacagatctaattctaaagtaaccagaagcctggccatctcagagcagcaaatccctcaaccttggagcacaaatgatcgctgatagagtctgcataaaatcatcttcctctatctgacagccatgagcagagccttgggggtaaaaaaagccacagccttaaatctcttcactcagaaattaccatgaagataaaataaataaatggaaaggactatcaagaagccaacaaaacataaacaccaaaccaactcatcttgtttcactttggaaataaactgttcccagatgtgagaccaacaaaattaatattaagcaattaaaccagtaaattataaactgatttatcatttgggaagtttaaagtacagagagatgaggtacctgtagccagaattacacatcatttcaaaatatgtagacaaaaagaaaactgaatgaacagagaaacattgcagcaatgcacagtcttaggacgaatgttgctgtttgcagacagagaatgtttgccatcttgtgtatagcctcaaagccatactgagataatagcattgttgtcaattgcttgaaaaattttcacattcaatccttcatgctatattggttggaagaggagggaagtcagttcttactgattacttctcagtgaacttctaatatttgcactggcacttccattcagggaatgaggtgggctgttatttgcacagatggtcccatgagttttgagaccacagcaagcagtttttttgcaggaatccaaaatggaaaaatgtaagaattctcaagacattgatatttcttctttc

SEQ ID NO: 504700 - DNA, 685 bp, Homo sapiens
gagtctgatctgagaggccacaatggtaacaaaataagcacttactccgagccaggcactagctaagcactgtacctggactggctcatttgatctcatgttatcaatgttcccatttcacagatacagacgctgaggttcagagaagctaagggctttggccaagagcaaatagccactaaatgacaagttgagtcccagccgagtaccacccaaagaccgggctttagttttaaccatggcctgtgctgtctctggacagtgtcacccctggctccctgccccgtgagctgggtggtggtctctttccaggagtggggcaatggtttgagccccaactgcagtggtttttgcctagattcagggactgtaactaggtactcagataaactgcacggcctcccaacagccctgggaagtaccccactgtagctcagaaactgaggctcaaggaggccaatccacctgcccaaagtcacactgctgctgagtggcagggccaggatgtgggtcccgtttccttctgcagcaccaacactacttaaacctctttgtaactccctcaacctcatgcagagagaagatcctttcattcttagcaaaccttacagtgaaactgagacttctcacagggaatcaaatctccatctggggaagtgttcattatttgacccagaccagccat

SEQ ID NO: 504701 - DNA, 439 bp, Homo sapiens
tgttcctgtatcagccagagggtgttcaggtcttcatgcagcagtcagggctgcaagccctggaaaggcatcaggaagaggcccagttccaggattgtgtgtatgctttccagcagacagctcttcaagggtgatcttgtttttcaatgtccctaattcccttttatggtgacatgagggttggtttgtccagtagagcgtcctccgatttaggcccgtaataaggtcgcatgttctttgctttcaaacataaccgaaggccgttgggtcccaggtcatccctttggcatggacgagctatgcagggaggagcatgaagaacgcccttcagtgggtacatggcctacatgcggccgagggtaccttgaccgtctgggaccggtcatgagccctctcgtgccccatccacccagacaagcaataaaagtggtttcctccc

SEQ ID NO: 504702 - DNA, 665 bp, Homo sapiens
gtatctaggtgactctaaggatcccctatgctacctcttcatcatatatcctgacacccagttgctctacagccagatgagtcaggccagtcctcagtgcctgcgcaagaacaggactcatcttctgagaaggatggatgcagcccaacaaatgggacaaggaccacattcggtgtgccatgagttgcggtcatgatcttcagcaagcggcaccaggccctggcagggcgcaccagggtcaccccaaccaggataaccggaccgtcagccagatactgagcaagcggtggtacaccctgggggccaatgagacgcagaaataccacgacctggccttccaggtgaaggtggcccacttgcaacaaggaccgaaagaagtccagctcagaggccaagcccacaagccaggggctagcaggagtgtaacaagggctcgtgggagcggagaatatcagagacgggcactgccactgcccctggggtgtccctctgaactcctgtcagttgcagcccaaacactccagagctcggataccaaggagcggcttctgtggggcagaatggctgcacacagtcagggaacctggcttagcctggcccaaagcttctcccacagtggggaaacaacctggacggcaggaaatagaccgtcaggcctaacggac

SEQ ID NO: 504703 - DNA, 183 bp, Homo sapiens
tgcctcggctctgacgtgtctcggtctaccttggctcggctctaccttgtctcggctctaccttgtctcggctctaccttgtctcggctctaccttgtctcggctctaccttgtcttgggttaatcgtgtgaccgcggtggctggcacgaaattgaccaaccctgagacaaggtagagccgag

SEQ ID NO: 504704 - DNA, 198 bp, Homo sapiens
acccccgtgtagtgcagtgcagcctttatctgtggctgaaggtctgagagcccctggtgtaggtccaagagtccaaaagctgaagacttggagtctgatgttcgagggcaggtagcatccagtaatggagaaagatggaggccagaagacctagccagtctagcccttccatgttcctctgcttgctttgatcctatc

SEQ ID NO: 504705 - DNA, 302 bp, Homo sapiens
ggctgcagtcagtgagatttcgcgtccagggcgttgcaggaagtgcttcgggagcggatgctcgaaggcagcatgctcgttacgagtcatcaccactccctaatcttaagtacccagggacacaaacacttcggaaggccgcagggacctctgcgctaggaaaaccagagacctttgttcacttgtttatctgctgaccttccctccactattggcctgtgaccctgccaaatccccctctgcgagaaacacccaagaatgatcaataaaaaaaaataaataaataaataaaaaagagcaaa

SEQ ID NO: 504706 - DNA, 412 bp, Homo sapiens
  misc_feature (291)..(291): n is a, c, g, or t
  misc_feature (293)..(293): n is a, c, g, or t
  misc_feature (387)..(387): n is a, c, g, or t
tgtccatataattactgtttattgaaagaaactattccttagcccacacatattcatgtttcatagttcaggagcgcaggtcagcaatgaacttctttggagcgcaatccaaagaattctttgcattctgaaatcacttggcactctgaaagataccagcctttcctcatctcttcgaaatctttcatggaatcataatttctgtagaattctgcatacgccttctttcttggctcagcacgccaaacttataggcagcggcaactcccagggccacaatgaatgcgccanantatgaacccgcagacgcttggccagaagaccacgcatctgtggtttgggcaacagcgcaccggaactcatggtagcctcgtgccgaattcgganagaagaaccatttggacatttcaga

SEQ ID NO: 504707 - DNA, 773 bp, Homo sapiens
gaaaatagaaagggacctctttcatataatgcttgtagtttcagaattaacccccattcaaggtcatccacttcaatttagtgcctacttgtgccaggcactgtgctgggtactgggaatggacgttaatattatgatgcagaccaggtttatttcatatgttgcttgctttatggtcttatcctcttgaataaaaaagagaagtaacaggccagatgtagtgactcacgcctgtaatcccagcacttggaaagctgaggcgggaggattgcttgagcccaggagtttaagaccagcctgagcaacatagtgagaccccatctccacaaaaagtgaaaaaaattacctgagcatagttgtgcatgcctgtattcctaaccttgtgaggggctgaggtaggaggatggcttgagcttgggaagttgaggttgcagtaagccctgatcatgacactgcactccagcctgggcaacagcaagaccctgtcttcttaagaagaaaaaaaagacaaagacaaaaaaaaaaaatgtgtgtggcgccggcctggggccccagaaaaaggtttctaagcccattccggtggggcgcggcggccccaaggagtggaagcgcacctgggcacaagcggggtcccaaaaggaggacccggggcacggcactaggggttggggttcccccccaataaaaaacgccggggcaaccgaggtgctggaaaactccagaggggtccggggccacgcggaccatcacccggggcaagagtcagtagcgcg

SEQ ID NO: 504708 - DNA, 383 bp, Homo sapiens
agtgactgaagcactgggggaataatgaaaccataccttataaagtctaatgctcctcttctacctaagccagctgaatgtgcccagacaatgcaacattctttgctacttatacagaatcaaaatgtgtgaaacaccccagtttccaggacttagtaggtcaccatctattagatcacagtgtagagtctttaaaaagaatcatactaagtctctgattctataattgcccataggtgtttgtttgtactggattttaggtataatcaaaagaacttacttaagagtacggtggggagggaaaggaggagatgctgcactgctgaacaccagctttgaggagctgaaataatgatgcctgttgcctagcaaccttttttttt

SEQ ID NO: 504709 - DNA, 477 bp, Homo sapiens
atgacttgagctccacctctgtctccgtctgggtgcctcgtgctcaccaaggaaggggtgcacgtgtggtgtgcagtcctggtgggtggtgctcaaggtcatcccctggaccccctggcctgagcaatggacccccagcccctcagtggggccagcgaagagcctagcaggtgacccaatctgaaggagggggcatgcagcagcagtggtgctggctcccctggcccccctggtggatcctcaggcccttgcagccccacagctgtgctgacactgcctgctgaatgaaattcttcctcctcctcatccccctcagagcggctctggcagaagctctccaggaaggcaatctcctccgccaacctgttagtgctggtcctgggagcacagagatgccgtggtgcggaaaagagcccctctccagccctggtgggccctggatctcggaggagcaattaccaatttggaaggcatctc

SEQ ID NO: 504710 - DNA, 667 bp, Homo sapiens
ccttaaggaagcggtgcggaagcagggacaagaagccgcgggatctcttcggtcccccaggacctccaggtgcagaagtgaccgcggagactctgcttcacgagtttcaggagctgctgaaaggtcagccgccctgcactgcccagagaccagacgtgcctgggccctgtgctgaccctgctggccgcctgtgccctcctccccacagaggccacggagcgccggttctcagggcttctggacccgctgctgccccaggggcgggcctgcggctggtgggcgaggcctttcactgccggctgcagggtccccgccgggtggacaagcggacgctggtggagctgcatggtttccaggctcctgctgcccaaggtgccttcctgcgaggctccggtctgagcctggcctcgggtcggttcacggcccccgtgtccggcatcttccagttctctgccagtctgcacgtgggtgagccggatggggcagtgccgtgtgctgtgacggggctgggctgagctttctgggggcgcctggcatcgccggccccgggtgcgggtcctgttagggacctatcccctgcccatggggggccttggactgggcatggggtccctgctgcacgctgctcaggggccccttccggcccagctcctggctgtctggtttc

SEQ ID NO: 504711 - DNA, 217 bp, Homo sapiens
tgagctggtacgggctcatcttctggcatacactaggagtggaattgccaggtcaaatggcaactgtacaactccctgaggaacttctggactgttttccaaagcagctccaccattttacattcccaccagcagtgtataaaggttctgatttctccagatcttcagaagatacaatttttattaatattatagccatcctaatgggtgtaaagtg

SEQ ID NO: 504712 - DNA, 136 bp, Homo sapiens
agctcggtaccatcgtaacctagtgcagatcaggtcaccagactggtcctgagaaaggaaagggtttgatgaagggttgatgacagagctttgatgacaggatatgatgaagggtttgatgacaggatttcgatga

SEQ ID NO: 504713 - DNA, 680 bp, Homo sapiens
  misc_feature (3)..(3): n is a, c, g, or t
  misc_feature (9)..(9): n is a, c, g, or t
  misc_feature (14)..(14): n is a, c, g, or t
  misc_feature (17)..(17): n is a, c, g, or t
  misc_feature (41)..(41): n is a, c, g, or t
  misc_feature (44)..(44): n is a, c, g, or t
  misc_feature (53)..(53): n is a, c, g, or t
  misc_feature (61)..(62): n is a, c, g, or t
  misc_feature (74)..(74): n is a, c, g, or t
  misc_feature (80)..(80): n is a, c, g, or t
  misc_feature (95)..(96): n is a, c, g, or t
  misc_feature (102)..(102): n is a, c, g, or t
  misc_feature (105)..(105): n is a, c, g, or t
  misc_feature (118)..(118): n is a, c, g, or t
  misc_feature (122)..(122): n is a, c, g, or t
  misc_feature (126)..(126): n is a, c, g, or t
  misc_feature (130)..(130): n is a, c, g, or t
  misc_feature (134)..(134): n is a, c, g, or t
  misc_feature (159)..(159): n is a, c, g, or t
  misc_feature (161)..(161): n is a, c, g, or t
  misc_feature (169)..(169): n is a, c, g, or t
  misc_feature (184)..(184): n is a, c, g, or t
  misc_feature (189)..(189): n is a, c, g, or t
  misc_feature (191)..(191): n is a, c, g, or t
  misc_feature (202)..(202): n is a, c, g, or t
  misc_feature (205)..(205): n is a, c, g, or t
  misc_feature (208)..(208): n is a, c, g, or t
  misc_feature (218)..(218): n is a, c, g, or t
  misc_feature (228)..(228): n is a, c, g, or t
  misc_feature (237)..(237): n is a, c, g, or t
  misc_feature (273)..(273): n is a, c, g, or t
  misc_feature (277)..(277): n is a, c, g, or t
  misc_feature (294)..(294): n is a, c, g, or t
  misc_feature (301)..(301): n is a, c, g, or t
  misc_feature (328)..(328): n is a, c, g, or t
  misc_feature (353)..(353): n is a, c, g, or t
  misc_feature (359)..(359): n is a, c, g, or t
  misc_feature (377)..(377): n is a, c, g, or t
  misc_feature (393)..(393): n is a, c, g, or t
  misc_feature (425)..(426): n is a, c, g, or t
  misc_feature (449)..(449): n is a, c, g, or t
  misc_feature (466)..(466): n is a, c, g, or t
  misc_feature (473)..(473): n is a, c, g, or t
  misc_feature (477)..(477): n is a, c, g, or t
  misc_feature (489)..(489): n is a, c, g, or t
  misc_feature (495)..(495): n is a, c, g, or t
  misc_feature (499)..(499): n is a, c, g, or t
  misc_feature (513)..(513): n is a, c, g, or t
  misc_feature (525)..(525): n is a, c, g, or t
  misc_feature (540)..(540): n is a, c, g, or t
  misc_feature (555)..(555): n is a, c, g, or t
  misc_feature (560)..(560): n is a, c, g, or t
  misc_feature (577)..(577): n is a, c, g, or t
  misc_feature (581)..(581): n is a, c, g, or t
  misc_feature (648)..(648): n is a, c, g, or t
tgncggggnttcanagnggactttattgggaaaagttagtnagngtaaaaaanattcaaannaattcaaaaaanttaaanaaggggaaagtaaannaaaccntgnagttaaaagtaancaancaancaancacnacagtaatcacaaaaaagggaaagncnaaattacngccttagcaaacacnatgtngncagggttttcngcngcnagcccaaggngggaaacacngcagtaatnagaagggagcccaatgatgaatttgcatttgaagcngggngaaagaggaaaaaaagngggtccngattatggcatcgagacactgtagccnaaaaaagcaactttattaatgtccngcagcngcgtacattagtaattanaacaatgcattaaaantttcatttcatgtcaaagagaatcagttttcnncatgaaacattatgttttaccgngggagtttgtccccccngagaccnttcngggaacatgccncccccngggnctgcctcccaagangcccaggttgcntaccacagggcatcnttgggcatttaaaancagtnaagctgtctggactgcncccnctcaactgaagttgagccaaattcccttctctcaaaccctaacgccgccatcactaagagaatgggnatctcggcttggtcagagcattactaacaagc
